United States Patent 11,913,074 (METHODS FOR ASSESSING RISK OF DEVELOPING A VIRAL DISEASE USING A GENETIC TEST) - sequence listing, part 24

SEQ ID NO: 2445 - DNA, 237702 bp, Homo sapiens
  source 1..237702: mol_type = genomic DNA
aactgcatttcccagcgccccacgcggcggcggccgtaaagcgcggcggtcgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtgagtgtggggggcgtagcgggaggcctcggggctggacagggggacggggcgccgagctccgggtcggggctctaggaggcgtgagagcggcggcgaagggcgcccggggaagcccgtgtggtggttaagagcgagggctcgggagtcagggcgcctgggttcgaaccctgaccccgtcgctcttggctgtgtgaccttggacaagtcgcttaatttctcagagtctccgtatccccacctgtaaagcgagaggatgcgatttcagtttatggacacagactttgttcttgacggtgtccaccaagtttcctggcggggtacttcttaaactgaacagcttagagggtcaaaggcctgggtcctggagtcgggcagatctgggtccgaatctatctgtgtgaatgtaggcctcaggttccccacttgtaaaaagagtagagtgacagcacctgcttcctgctattgtgttgagagttggttggataagagaatgaacgttaagctcagaacacgtacaattgctcattaaacggcattaattattataaaagaacagattattttccgaggggagtctaagctgggggcatgcacgctgagacccaggattttggggcgattggggaggatgatgaaaaatagagacctctgaggagggaatgactctacagctctgggggaggacaggtggcagatagggtcttgggaccaggagtgcagaaattaagaggctggctttgcagccacacctgcgttcaaatcctgaaaccaccatttactggctgtgtgaccttgggcaaattacttcacctctctgagcctccagattcccatttgcaaatggggatcgtgaacattgtaatggaaatggaaggtgactgacccagtaggtacatagtaggtggccagtagtggtagctgtgtttattatcagctcagcgaggccttcccagaccaccctacctaacgtgctccccccatcccagttcctatccatcacatctttctcttgctttcattgagtgcttctccactctctgcgattattctttattttttatttatacttattttctgtcttctgttaaactggcacttcacgagggcacagactgcttggtttgttcacagttgtattcccagcatctaggactgctctctgcttacttaaagagtggaaaaatgaatgattgaattggggagagatgaagagcatgcaggccaggacccaggatttgggggcaggtgtggaggatgatgaaaaatagagatctgtatgaagggaaaggctttagggagggaaatggcggggatgctgaagaggggagtagacaaatcttcagtgtcaagaaataggcaggtttccagaaggagatcctgagactactaatgggaaaggaggaagatagggttagggatatggtgggaagtagtggaagggagacggggctgtggaaaggattggtgggagggaattagatagggacttctcatgtgtccccgggagtggggtaggggtagtggcagggccacagttctcagctgtgacctttctagcatggagcagcatttagtaaacgtttgtgagtcttgaagagtggggagcaggagggttcactatgtggtgaggggcacttttagagcaggaggtggtgagagaagacaaggggaggaaagaggcccaggacaagtctggggtgggtagggaggtggggatcttagatgggagggcagctggccgggaaagggagtggttgaaggatttcaggaatttatcgagtgggcggaggtggctgaggaggggaggggagttatccagaggaggttgggcctcctgccggcatccaggtacctccaggttctcacctaactctgcttaactctagcccttttaaattaccttaatttattaatttatcgaatgcattattctgtaccaggtatttgctaaggactgcctgtgtgttaattcccttagtcctcacaagtctgagttacaggaaccattattgtttccattttacggaagtggaaactaaggttcagggggcttcagtgacttgcccccaggtgtcagcagctgaagggtaccagaggcaggatttgactcccgagcttgtgctcattatactgtctttctgaataaaacttcccaataagtctgtttgagaacacttttgacttggctgagtctcatcgccaatggggcatctttgccagccagcagggaatggtaaacggtctctggttcctttgcagtatcctgggaactgcctgggttcattgtttagatcacatgtctatcggatgcttctttggaaacccaagttgcctgccctgaatcaggcagatcagcttaatccatattacagccccaagaacctgagatttgtgtattggtgggggggttagaagatcccccagtgacttggaaaagagttttgtaaacagccagtgcccaccctggggcttgtgccactctgcatttggctctgttggtaaacatcttgggtcttgggtacagaacagctcgttccctgagggagtttgcaggctggtgggggagacagctgtagagccagtgactgtacagtgtgataagtgctgagatcgccatggacccagggttctgtgggaacccttattgggagctttctggaggagacaacaccagcgcgggttctccaagaatgaacagaagccaccattggcgggcagcaggggcgggaggcggagcactgtgaccaggaccctgcgggttttgtggcatgtccaggtgggggctgatagctgtgggaaacaaggctggaagtaggaaggggcttgggatttatctgacacttcgggtgaccaaccgtcctggtttgcctgggctgaggggtttcccaggatatgggactttcagtgctaaaactgggaaagtcctggacaaactagtataaactggtcaccctaccagtgacaagtgacagttcttaatacactcttaccttgacctagagcagtatggatggagagggaaagtttaagatagttaaaagaattatttatttattattattattttttaaatacacaaggcatctggaaaccctcttctttttttttttgagataagagtcttgctctgttgcccaggctggagtgcagtggcacgatcttggctcactgcaagctccgcctcccgggttcacgccattctcctgcctcagcctccagagtagctgggactacaggcgcccgccaccacgcccagctaattttttgtatttttagtagagacggggtttcaccgtgttagccaggatggtctcgatctcctgaccttgtgatctgccctccttgacctcccaaagtgctgggattacaggcatgagccactgcacccggcctagactttacttttttagaacagtttgagatttacagaaaggttgagaagatagcacagagagctggaaactgtttttagcttcattattctttgtaacactcccagcttgcaaactggaaaggaattttcctgttagggttttacttttgctaaatggtagaaaacttcatacctgtggtctctgtctgctgaactgagttagtgatttagctcaggcagattgaagtagtcaagaggttatttgctacacaccatgggtggtttattgtccagattagtggcaaggctgtgacattgactgacaaatgtccaccaccaagcggaagcctgagtgatggaatcgtttgattgctactgaaacatcatctttaccagggactgcaagtctgcggctggtagaaattggtcgtttttgtattgtggccttcattctggtccactttgtgtgggggtcaagatttttggttccagtgacagaaacccagctagaattgccttaagcctcaaatggattgaatagctcatgtcactgaatggtctgtccccgctaaaccatggctgaatccaggtgtttggagccgtcagaaatcggcctttttccacctttcagctctacctttttcctgttggtgtcattttcaggcaggctgcaggcttacatcatatcagcttagcattcctgaggaaaaagagagcttcttttctcaatattgccagcagaagtccagaattgagattgagtatccctggaccagcaaggtctcatgccacccctgaactgtcactctggccaaaggtatagggggatctgattggccattcctcactcatattcccttccctggagcaagagtgggattagctccactcaagctagtggaaaagaatgagagaaaagagtggttccccatgggagaatcaggggttattgcccaaagaaggcggagaatggatccatggcaggtagacagacgcacacctactcttggtgctttcaagttttggctaaggtggcactgacagtgttagagcttggggtacaatattgccatgttgattttcttaaaatatcgtcttcaccatgccacatattatgggtcctaggctcccactatgtcacgtctaagttcttccaggccttcccaccatctagtttgggagcacagggagttaggaacatccttgttaggcagacgctgtttaaatggagaccaacggggtgagtcgttgttaccaggcagcggggtgtcaggtggaaggaaggatgtttcaggcagaggaaaaggcatttgagaaagcctagtggggcaaggggagcagtgcacattggcagaactcacgtggttcagcaggggagtgttcactgggtgaagaggaagtgaggacccaagctcagagccatgcttggcagtctccagaggccaggtcccctggggccctgtaaatcactttaaggaattcagactatgagtgagaacagtagggagccactgaaggttttttaactacagaaaggctgtggtctggctgaagctggcagaatggattggatgaggggcagactggaggtgggcctccacatgtgttggtggggcggggagcaggggctctgctgccgtcccctggtgagttacggtagcagctgctgtcatccaggtgtatctcctgttggtggtccactcacacacatacctcgcctgcccacttgaggtcccctgctcttttcctcctgcccatccaaatccctagctctatcccgaaaatgccagttcttccctaaaaattgccctggtgacttcagccaacaagagttttgctgtcttctctaacttcttctgtgcctgttcacactgtcccacacagttaacacattattatatacttctcatcgccaaagagtgggtcggctgttagctcctgtgcgttcttaaagtttcatctcggccttgagttagaccctcaggaagctggccggggttcctgtcctttggctatcagacattgtcttcctttgttacatatcttttttgttgttttctcccaatttgaacataagaatcatgaaagcctgtatggcttgttcagctgggtactggtatgccagcacaggacgtggcagatagtaagcaatcaacaaatatttgtcacaggatgaacgagaggcagacctctgttttcagaaaaggccagtcttttcccaacaactgcttgttctccccagtttagtcacagcacctgtgccacagccatgactttctctagggctaaagccctaaagaaagctagggtatagccctgcctataccctacacatccccggcccagcctcacttgccggccctgtttgacatctttgggggatgattcaccaggggaagcacagcctgtgaacaccttctctaatcctctagcctgattccaccctccgtgaagcttctccttgtcctgctggccagaaggctgaacactgaccagatggtggttttcagggcacagagtgggacacactggggaacgtctgcagggcctctgcccgagtgctgaacaggccagacagatacaggctctgtgtctcccatccctctaccacacctgagacattgttatttggagctgtgtggacattggggggtaaatttctaacccccagacctcctatcattctgcttatcctttctcatgccccaccttgcaaatgtacatttcaaaatcttgaaggaggagcatcctaataagctcattatggtgcaaggcatagcacgtgcagaaaatgctgtcactgaaatgaacttggacctagtattcctgtctctgaaatggactgaattgctaatttttgaaggatatggggcattattaactgtagtggtttaacctgtgaaattagtgactcttgagaaagcagaggctattgaggccagatttgtttacgtctgtcatccttggtgatgcacctcgagtgtgttggttacagtttctcttctccaggcatttcaaactctgaagctcatctgtcggtggagagttagctaacaggcaaagctcggatattgagactgcatctgcagagctcctgctggggatatgagaatactggctcttttccagacaaatgggagttagagccttttataaggactttccataagatctgatagtattttcatgcctttttggtttatctatttggtgtttttttaatttattttttgtgtgttaggcattcataacctcatgtaaattcttggccaataaaattgttgcttacttcattgtttgcatttctgtagtcctagaagggttgtaatcatggggtctggagttcagtctgcctggttgtaacctaggcacctcctgtgctgcaccagggccctgggcagatgcctcagctcccagagcatcatccccaaagggtcgattgtttctgggattaaacgaagcactcagacagagactggcagtaataggaagcttcatctgttttactgaggtacatacatagtttgagaaaacacgttgtcattctaacagtggttatcattgtaagagaaacattttaatttgctgccgttaagtagcaaggtaattattctgtcctttgaaacttttctgagataaagacacagctttccatacaaagatggtcatagcaacattgttatcactcacacaattaggaatcttaatgcccttcaaaagagttgctactgtgcttgtcctttcagtgtcatactgtgtagccattacagatatttgcaaacagttgtcaataaccaaaaaaagtgcttttgttttagctgaggtgggaaataagattggcactgaaatggataatgcaacatgacctcaactatgtaaatatccatagcaaagaaaaagacccgaggaaatagattgcaactccagcagcagtcatctctaggcaccacggttgccgtttctctttcattgttgtcaaagtttcctacttctctaaagtgaatgttacatttataatcagaaggttttattaaaatgggccgggtgagttggctcacacctgtaatcccagcactttgggaagccgaggcaggcagatcagttgaggtctggagttcaagaccagcctggccaacatggctaaaccccatctctactaaaagtacaaaaattagctgggcatggtggcctgcgcctataaactcagctacctgggaatctgaggtaggagaatcgcctgaacctaagaggcggaggccgcagtgagccaagatcacgccactgcactccagcctgatgacagagcaagactccatctcagaaaatgacaacaacaacaaaaagttattaaaatgtttatatctctgaggtggttgaattacctaatcttccaaagccctggaattagatacaccattaaaacattaaatcttaatccattcagcctttccccccattacattcaagcaaatgtatattgagcatctcttcctaaaacactgtgtaaaacggtgtgccagggcattgtgggacagaaagacgagcaaggtgaaggtgtaaccctcattgagctttggagcttgcagtctactgagtatttctgtataccagcaaaagacatttagaaaatgaatatttgaaacaatatcatttacaatagcataaaaaaatgtcgactacctagcagcaactctaacaatagatctgcaagattcctgtcaagtgagcatggaaacaaatgctgtaaatatcagaatgttacactattgtaaatatgtcagttctctccaaatttagccatagatgtagggcaagtctaagaaaattttagcacgtatttttgtggaaatgaagaaggtgatttttgaatgtatatggagattaaaagggccaagaataggcaatattgaaaaacagaaggaaagaagttggaagacttaattactatatggcaagatttactgtaaaactgcagtaatcagacagtatggtcttgatacaaggatagacaaatagatcaatgaaactggagtatccagaatgagacccacatgggtagtcacctgattaatgacaatggtggcgctggagtgcagtagagaagtgagggccttttctgtaaatggtgctgggtcaagtagatttccatatagaaaaacttaattttggccagtacctcatatcctacacagaaatcagttccagatgtactcaaagtcagaatgcgaagagtaaaacagtaactttgttagaagtaaaaagcatttccttataaccttggggtaggtaagaacctcttaagcttgatacaagaaacaccatccaagggaaagattaataaattgaactacattaaaattaagaacctctactcatctaaagacccagtataaagggaacgaaaaggtaagccaccatcagagaaagtatttgcaatatttatctccagtaaagggtttgtggtcagagtatataaagaaaagcaagaaaaagccacacagcctaattttaaaaatgggcaggctaggcgcggtggctcacgcctgtaatccaaacactttgggaggctgaggtacgtggatcacgaggtcaggagatcgagaccatcctggctaatacagtgaaaccccatgtctactaaaaatacaaaacaattagccgagcgtgctggcgggcgcctgtagtcccagctattcggaaggctgaggcagggaaatggcgtgaacccaggaggcagagcttgcagtgagtggagatcgcaccactgcactccagcctgggcgacagagcaagactccgtctcaaaaaaaaaaaaatgggcaaaagacttgcacaggcacctcacaaaagaagatattcaaacagtccataaacatatatgaacaggcacccggtttcactactggaagaaagcccccacgcaatatcactgcatacccagcagatggcgccaccgaccagggcaaagaacaccaagtattgagaggccaagaaacaaatggagttctcagacctttcttcctggccacaggtctgtgggcgagctactgaacgtcgccaaacctcacttgctgtcttgtcctgtgcagtggcaacagtgtgcacatcttcaggttactgtgagtctgtaggtcacatgaagccctcgcagagaaccaggcacgtgggggctcctagaatctttttttcaggacttaccgccctgccctctctgcctataagggccttctggtagttactaggtctttttcccccagaaattatttaataagggcaacaataacaatagctagcacttgtatcatacatagtaactgccaagttagttatctgttatctcccaacaccaccaaaataggtagatactaaagtattcaggtaccattgctgtttacattttactggtgagacaactgaggtgcacagagggaaagtaacctgctcaggatcacccagctaataagtgatggaggtgtgctcagacccaggcattccagtgtctgtgattaaccctatgttctaattataccagtgtttgtaattaaccatatactctagtgcctctcaggaaataccagactttctctacttcctgctctggtttcgctgaaccttcccatcacgactcctgccctgaagccctctttccctgtttgaatctagcctgatctcttttctaccttcctggaatattccttagataatgtagtaataatgtgaataacggcccccaccacaatgaccataatctaatcaccatggcagccaagcctgcttctgttgagcccttgctctgtgccaggcgctgtgcttggctctttctgtgcatggtcacgttgcctctctggaacaacccagtgaggaagccttgactgttcccaccactgtgtagaatctgagctgcagagaggtgaagcgccttgtccaaggccacagttaggaggtggcagggccaaaggtcaagcccaagtctgtctgccagactccgaagcctgacctcttcaccagagctctgtgctgtcacttgccgtgtctggcgtttggatccctggctatgttcagtcgtgtatgctttgatctaagttatgtttacaaagaccatcccctgccccattcagcatttattgaacacctgctgtgtatcagacatttggagtgtattggggtcagcaagatcaataaggtgatggtgctgaccttgaggagctcaggtctagtatgggaggcagatctttgcaaatgagggtgggctgtgcagtagcaaatatgtgtgggtacagaggtgccagtgaggagggaacaattaaatccacctgggaggggggcatggggaacgctttaccaagagatgcccgagctgggttttgaaatgtaaaagtttgctggatgacaaggacagcaagggcattctaagcagaaagccccatcaattgaagtcatgtggtcctaaagaatttaaaatttcttcttcttgttggggatcttcagagcagacccacccacctaagccaccgtctcccattgaccaggagtatgatgtgtgatgctaatagatgtacacagaagagaggagggagaatctgcccttctcccatattgccaacgatgtcttgtcactggcagggtgtcaggcacatgggggcctgcgtggagagtgtcactgatggccacagctggagtggtgcggtgactgtcagacttcagtgggattggggccctgcaccaaaagtccaattcaatgggtctgggacaacttacaaaggtgattctgatgcaggatgcctgggaactgcagtttggaaaactctgccgtttgaaactcttggggaagatgcacttgaggcaagatgaagatgtagatttgggagtgggtcctccaatgattcatcccagggtggttcaagtgctgtttgagttacctaattatagagggaaactgggcccatgccccctcccgcagccttttggtagatttgggtacaagtggttgaggatttgtgttttttgagggctcttctaattactgcatattaaaaattacatgcaatttctaataaattaattaaatgcttgattatactaggtctttaaagcataacaaacagtattcgtaaataaaccctagcccctttaaatagcagattgttctttattgtttcatcttcaggctgcttcctctttatgtcttacccgtttttagagattgtagatgggacaatcctatctagacgtttccttccttgctctcaccagacccccagccctgaaaactgaagttagccataaaagaaatcaggagaggagggcccttttcctgagtcacttcctcttggtgtctgcttttccttctcaagcctgagctcccttgacaggtgaagttacctggggctgtgggccctggagaagccatcttaaaagccgtgcccggtggcactcccagggcatccagctaggcttctggtccccgcgctgctcaggactggcctcggtgattcttttggtctcccccaccagcaaagaggccttgaggactggaaggtgtctacctgtctcagctccagcacctggcattcaggcctgtttgggtagatgaagtacagcaccatagcctctgcagcccttatttatttatttatttatttatttagactctcgctctgtcacccaggctggagtgcaatggtgtgatctcggctcactgcaacctccacctcccaggttcaagcaattctccctgcctcagcttccagagtagctgggattacagacttcgccaccacacccagctaatgtttgtatttttagtagagacagggtttcgccatgttgaccaggctggtcttgagctcctgacctcaggtgatccacccaccttggcctcccaaagtgctgggattacaggcatgagccaccgctcccagccagcccatttaactcagtgaatttaacaatctgttctcagcaaataagaccattgcccttgggctgcaaaccacccagatcatttgagccataagttctgatgggctcactgcacttgagaaggattgtgagcattccaaggggaattgcatgtgatttttgtcccagcaactgctgtgggacccagccttcctaagctgtggctccatctctctaaacctcaacattagcctggctgcaggccccgtgttaggcatccagcctgagctgtatgtccccacttgctctgaaggcatcaacatgatgggaagcatatgaaacaggtggctacttgctcttctctcagtcctgctgaatctgaatttccgagggggctccaggagcccccacttgattcagttctccgggtggttctcttgcacactgcagtttgagagtagttgacttcaagggtttgacgattttcttgtctccgtctgggttggtgtgtccttggtttaacccttcaaagcattgtctgctatttttctggggttgtgagttacatctaatctgaatgggaaattgcattacccaaacctgaaaaagcattgctgcattgtctccaaaatattgctaatggtcatggaacttggcttgcatttcagttggtaacctttaatttccttttctctcatttctctcaggtatctgtaccacgttttgaccaaaaacaccacagtcacagaacagaaccggaacctgctagtggagaccatccgttccatcactgagatcctgatctggggagatcaaaatgacagctctgtatttgagtaagggtttctaatgattgctgttctttgattattcttctttgaatgtttttctaaatgtatactatgagtcattctggatgatgtcaggatttgacgctaatttgatcttgcctagatatctatctctgtctagctgtaaaaaaaaaaaaaaaatgcccttgaagcactatagaaatgcaagccaaaaatggggaagttatggaaatgagtgtctctagaaaacctgaaaatgtcatgggtaattttccttcaggttgtgtctgattattttcccaaaggaaggagaacatgtctggtggttagatttgacatgaacagaaggcctgtgccctgggggagtccctgagggctcccagttaccatgtttactgatgaccaggcacagggctgagctcctgatgagatggtccacctaagtttcccacccaccccatggtagaggccctgttggtgtccccttttttgctcaaggtcacatagctggtaagcggtggaaaagtgacacacccagaatcagtgaggggtcccgcaactcaccacttcctaggtgagcagtcctcagccaggctcttcatctccctaagcctcagtttctttacctttaaaagagagagaaaaagttctctttgtctagtgcctggtacaggaataaatgatagcaaatgataaagacagacgtgcctcactggacagttaaaaagcaagggccgccaggcgcggtggctcacacctgtaatcccagcactttgggaggctgaggcaggaggatcgcttgagcccaggagtttgagaccagcctgggcaacatacagagacctcgtctctacgtataattaaaaaattagtcatgcatggttgtgtgtgcctgtgttcccagctactcagaaggttgaggtgggaggattgcctgagcccaggaggtccaggctgcaatgagccatgatcttgccactgcactccagcctgggtgacagagtgagaccatgtctcaaaaaaaaaatagcaagggctgttaactgtgaactacctccctaatagatctgccttgatgtcttagtgcagaaggatttggggctgggttatgacaaccactaaacacgggtgtgtgtgtgtgtgtgtgtgtgtgtgtgtgtgtgtgtctgtattataaatattgaggccacttttaaaactcatttttgaaaagtaaaagtgttctatttttaacctggtttcttattagatatccgaataagaaggatattaccttttcatggattcagacagaattaggcagcactgagcaagttcctgaatataggttcagggtagctttatattttcatcagcaaggttatccaataaagctacttgtggaaatgcagactctttaaaatgcaaacctgtaaacagtggctatgatctccaaagcagaacatgcgagtcatgaatttgtgtttatatacagacctagttcctttaaggatccatggggaattttgttttttttgttttgtgagatggagtcttgctctgtcatccaggctggagtgcattggcgggatcccggctcaccgcaacctctgcctcccagtttcaagcaattctcctacctcagcctctggagtagttgggattacaggcatgcaccaccacgtggggctaatttttgtatttttagtagagatggtgtttcgccatgttggccaggctggtctcaaactcctgacctcaggtgatccaccagcctcaggttccctaagtgctgggattacaggcatgagccaccgtgcccagctggaattttttttttttaaatatctttttggaaatcaaaaagacccttgggttaaagatgagaaactgtgtcccccttgactagaatggacttatttttttttttagagacagggtcttgctgtgttgccagggctggtctcaaactcctgagctcaaacgattcttcctcctcagcctcccaacatgctgggattacaggcatgagctactgcaccctgcctagaacggacgtgtcattctaggtcccaagatgacaccctgtccatctgtcatcttagaaaagctgctgagctcttagggtctccatgattcttaaacagttatccaacaaagtccctaagaaaattttgtttttactacattttaaaattttggaataattttagatttataaaatagtttcgaagatagtatagaatgttcccattgtaagtgtcttacattactggggtgaattgggcaaaactaagaaactgacattggtacagtattgttgagtcaacttcagccctcatttggattttgccagtttttcattaatatctcctttctgtcctagcatcccatccatgttcccatagtacattttgttgtcgtatatccccagcctctgatctgtgactcttttttagtcttccattgtttttgccaccctgaaagttttgagaaatgctagccaggtctcctgtggaatgtctcccaatctgggtttgtctcatgtttttctcatgattaaactggcagttaaggggaagaaagctataggagtaaagttcccctctcttgccatcatcacaaggcattcacaatatccacatgacatcctggtgatgttacctttatcacctggttaaggtgctgtctgccaggtttctctactataaagctactgtcttctcctttccccacactgttctttagaagagagtcaccaagtctaccccacgttttcatgatgagggggtgggggttaaggtctaccttctagaagggggcagtatctacatgtattatttgaaattcttctgcatggaagattcatctcttctctctcatttatgcagtcatttgcttatattaatatggactcgtggatatttatttatactttgggctataattcagtatgttgttattttattgctcaagttgtttcagccttggctattaggagctctttcaggctggttcttgtatcccctcgatatgctctcttccttttgttttttgagcacttcttacttcctggtactgtaaaatgctccagtcctacaatcacccttttttcccaatgaattgcccactcccctatggagttttaaaaaatctaggttcatggattttatgctagacctaccctgtcaatccccggggcaagatctaggtacaggcattttaacaagttcccaagttggtcacagtgcggcagtgagtttgctggtggcccttaggagtcactgatttatgcagcttgaactgaaggtagacaaaaataggccaaatgacagaaatactctggaggtcaacatgaatggcatttacaggcagatgggcctccgagttggagaagattgtaagggtcttttttaggccatttaaattttttcatttatccgttcatggattcagacagaatcaggcagcactgagtaagttccaggcccatgacctcaccactgtggagatgccagacgaggacagagaggcacccacaactgagtcagcccgcaggcacacctcatttcttccaagtgtcccagatgcaagattatctggtgttagcttgagtacagagaacacataactagaaacgtcattctcttcctttagagaaaggcactggatggtctgtttccttttcaagactgaaagagccaacgtgtacccccagaagccagtgccgctaggctgtgtacagacaagtatcctatccacaaggagaaaggcagaaacagacctggggatgggttagtagggtttctccaccacatcagtacctgtgtatttctttctagttattttcccctagaacttgacaatttgggagccacagtacatttggttgtcatatctccccagcctcctctgttccgtgactcttttttagtcttctgttgtttttacgaccctgaaagttttgagaaatgctggccaggtcttctgtggaatgtcccccaaaatgggtttgtctcacttttctcatgattaaactggcagttaaggggaagaaaaccgtagggctaaagctttttgggaacttttttttcttttttttcttttttttttttttggctctgtcacccaggctggagtgcagtggcctgatcatatctcactgcagccttgaactcctgggctcaagcggtcctcccaccttagcctcctgagtagctggcacttcaggcatgcaccaccgcctaattttttttttcttctctgtagaggtaggggtcttgttattttgcccaggctgggtcttgaactggcctcaagcgatcatcctgcctcagcctcccaaagtactgggattgcaggcatgagccactgtgcccagatctaaaactcatttaatactcataattatatcttattcctttgctgggaattccagttgtggcgggtgacaatgggtggcatgacctgtgcagataccttgggggagaggggtgaatctaatacttgtgttgtgaatgaaaccagataataatttctgtttccacatgtggaagcaagccactgatgcttttccattctctccccagcttcttcctggagaagaatatgtttgttttcttcttgaacatcttgcggcaaaagtcgggccgttacgtgtgcgttcagctgctgcagaccttgaacatcctctttgagaacatcagtcacgagacctcactttgtaaggacattccttggtatttgcctctgtgctgctgtgcatgtagcagggtgaagttgggcgtggttttctgtgtctgcgcttactattcgtcggctcaggctatcctaacaaaataccatagactgagtgggttaaacaatagagatttgttttctcactgttctggagcattgaagtccaagattggccaggcatggtatctcatccctgtaaccccagcacttaggaggccaaggtgggcagatcacttgagctcaggagtttgagaacagcctggacaacaaggtgaaaccccgtctctacaaaaaaccacaaaaattagctgggtgtggtggtgtgcacatgtagtcccagctactcaggaggctgaggcaggaagattgtttgtcaaggaagtcgaggttgcagtgagccgtgattgtgccactgcactccagcctgggtgacagagcaagaccttgtctccaacaacaacaaaaaaaaaagttcaagatcaagttgccagcagggttggtttctagtgagggctctcttcctggcttgcagacggccaccctcttgctgtgcatggcctttcatctgtgtgtgagtggagagaaattgagagagtgctagctggtgtctcttcctccttctatggggacgccagtcctattggatgagaacccccacccttatgacctcattaaccttaattacctcgccaaaggccctgtcttcaaatacagccacaatgggggttagagcttcaatgtaggaacctgagggagacatagttcagtccctaagcctgtgtttgtttctgtgtggtgggtactatcagagggttcccctctgctgatgatgctgggggtgtttgcagttcttctttatgacttgctattaaagagttggggtcgctgaatcatcagccaatggaataagcactggaagaagtaagacaaggaagatctctgccagagggcaggcaagggtgtgtgcattggtaccaaccctcctgcttcagtccctccacccagctagtgagtgtgtgactccgaacttcttacctgccctcactaagcctcagtttcgtcatccgtaataaccacccctgagaggcaggtgccatcagtgctttcattttaacacccaggcgccagctctagcaaagccagaatagagaaggggtttcatcccaggcgattagctcagtggtcttcagtgaggggacatttggcatcatctaaaaacattcttgggggtgctgctgacatctagtgggtagagggtaggggtgctgctaaggacaggccccccacaacagggaattacccagcccaaattgtccccagtgccgaggctgagaaaccctggtttggttcctaatcctccacgctagactgctagctttgttattccaaggtgacttcaccaagcccgggccctgcccgccagaagtgggggacaagtggccaaatgtctatatcagaggcaggctctaagtccccaggacaggtctgaaaaaagtctgcagtgggcagaaagaggtagagatggtggcattcctctggccaagagggagaggtgaaagggctgctgagtgatggctctcgcagccgccgctaggtggtgctgctgcctcagagacgccttatgcttcccggtgaccgcaagttgacaaatgtgggccgactcctgtctccctaaatggtttcccttgttaccagcgcctgtttcactggatgtgaaatgactgcggtttctaaaagctctgaggggaagatccagctcagtggcacaggcccttgactcagactgaaccaggtcccaggcccagttctgccccacactggctccctgcacgtgcctggacagtgaaggctccgagctgctgtttgtgcatctgtcaagaggagagcacagtggctgcagcatagagtggctgggcgtgagcgtgagagcaggtgttcagagcgaggcacagggtctggcagataggacatggccatggtgtcggttttatcctttaaggcaacatcaccctcagtgtccctgccctgggaagcctctcaaagtccagctaggcacggggtgactggattgagatgggggtggggcgatcaaaacttacggcttttagagtgtttctctgaattatgtggcttttaaaaattgtatatatttaatgtgtacaacttgatttaatatatacatatacacaaaaaaatgtgtacattgtgaaataatcacggcaatcaagtgaattaacatatccatcacctcacttttgtgcgtgtgtgtgggtgggggttgtgtgtgcaccttgggtgatgaaaatatgcagtagatctgttagcagatttcaagtctgtaacacagtaggatgacctgtagtcactgtgctgtacatgagagctccggaacttactcatcgtgcgtcgtaccctttgatcagcgtctccccatttccctcctccccagtccctggtaaccaccctttgactctctgcttctatgaatttgactgtcttagattctccctgtaattgagatcatgcagtatgcgtggcttttcttgtcctggcaccgaaaagggtgccctgctgtgggaaacccaggcagatgcccctggctttatagccccttcaccacagtgcttttataagccctgcaaaaagggtagaaatcattgcacgtttacagaacttggatttgtaaggggtgaggaggatagaagacctttgcttttatttttgttttctaatcacagaagaaaaaatgtcctcattgttaaataacgaaaagccaaatgttagaaaaatgtaaagtcaagtttctgcagaattcaaccctaacgatccattgtgcaccagccattctgctgtttgcttttctttttcccaccttcccagtgtatcctagatctcattgtcccgttctgtaaccctgcctggtttggtttaggagtggcagcttgttgtgctataatctatttaacctgaccacgggcatttaggtggtttccagcttttcactattacaagctaccatttcacaaatgcacctgttgcctgttggggttagtgacctaagtgacagagtcccgagagactgagattacgtacaggctcccgggtttattagaaaaggataccacagaaagtcagccacacagtgagggggtagtagaaaaatcccagcctgataatagaggcacctccaactgtcctatggtggccccccaccacccacagagtcatctcttggaggccctggaaaagtccctgctggggagtggagggagcctgtcgctgttccagctccagggtacagctgagagactcacagttgcacatctgaagctcccagtatggtgtctgtgctgctggtggtctggaagccactagccagtcacagcagggctcagtaagacaccccaacagctccttatcctgccagcccattacccctccctacttctcccccagcaagagccagaatgacacagaaagaaaaagaagtgctctgggtatcagaatcacctgggtgacacgatacccatgttagactccaggtggataaataaactgtggactattcagagaatgtactactatatagcaaaaaagaaaagaaaaaggaaaaggaaagaaggaatgaactactaccattgcatacacagcaacctggaaagccctcagatgtggtaataagcgaaagaggccagacataggaagtgtgcgtactgtctgcttccattagataaggttcatggacaggcaaaacgagtctgatgtgctagaagcagaataagggttgcattggggtagcgggtactgactgggcaggggcatgaggaagtcttctggagagctgggaatgtcagatttgggatctggatggtgcttacaccgtgtgtatatgtaaaaattcatcatgctgggcacttagggttatgtatctatgtgttttatacgtagatatacccgaggctgggtactttataagggaaagaggtttcattgacttacagctcagcactgctggggaggcctcaggaaacttacaatcatggcagaaggtgaagcaaacacatccttcttcacatggcaacagcaaggagaagaatgagtgctcagcaaagggggaagccccttacaaaaccatcacatctcgtgagaactcactatcacgagaacaggatgggggaaaccacccccatgattcaattatctccacctgatccctcccacaacacgtggggattatgggaactacaattcaagatgagacttagttggggacatagccaaaccatatcatacatatatgtgtgtgtatatttccacatatgtcaagctgtccacttaggatttgtgatatacataaccccatctttaaaaacattaagattcctaagattctgccttagacccattgactccttgcttggagggatccccaagcactgcctcagtagtgttatgagcaggcgattttgaaaactgctcttctaagactacaaaccgcacagcctgtctgccatgcctgctcagagtgcacagtggcttttctgaatgcagtggctttcccggagaactgacttccaaggaggaccacgccacaggcccacactgtggcttccatcacgatcccgggctcccagattcctctttgtggtgtttttgatgattcccaacagactgttgagtttgactttgatcgacctcagttaggtacctcgacggctccaaataacttaatggtttatttcctcttcacccaagagcaactgttttcagtcctggaatatggtagagattttctttgtttgttttgtttttagagacaggtctcaccctgtcgcctaggctagtctccagtgatacgatcatggctcactgcagccttgaactcctggcctcaagctgggaccacaggtgcacaccatcacacctggctaaagctgagattttgaatctccgaataatagtaataataataagaagaatggcagttaacattatcgagtgcttgcattgcggcccatgctgtccattcacacagccagtgaatcagtgactactactactgtcctgagtgctttctgtgcattttctccattaactcttaccactacttcatgaggaagttttggcttcatgaaactggggcgtggggagggtcagcagtttgcccaaggtcacagcacagctaggaagtggcaggggcgagatgtggacacaagcaggccagtccaagtccacgattaaacccagagcttcccaaacactagcacgcatggggagccctgcacacttctcacatgcagagtgctgggcccacccctggagattctgactccgtggcgcagggccggggcccaagatcctacaggtctgacaagctccggggttgctgtgctccccatctgaggacaagactctgagtagcgaggctccaaaccatgcccccagcaggtgtgaatcgtgttctgcctttagctgtcctgggggccgggcaggtgagctggtgcagcactcacacaacattccaaaggacaggcgatgggacagcagtgcctgccttgcagggtggctggtaagaacacagagggaaatatgcctggcaagggcccaacactgagatatcaaactgcaggccataggctgcagctggctagtagacatgtttttgccggccagcacagctttaaaagctagttgatttcagtggcaaacatgtcaggatcaggagatgcagtgttggaatctggttttgcctctcttcactgttgaaagccctcaccatactggcctgcatttctgcagggccaggcgctgggagctggggaatggggttgctcttcagttgaccccagtgcccttgggccctcatcacccagttttcattgttgggcccccataatgcatgacaaactctgacatcagacctaagtttgaatcccttctctgtgactgtctctgtgcacgggtaagttaacatctccgagatgtttttgctcatctgcaaaatgggaagaatgagcaggatcatgtgatggttaatggtcatgtaaagcactcagcctagtggccggcatgtagtagggattcagcaggaagggacctttatgcaatcatgttgctatataaggaggaaaaaaaccctactgtggccttcagagttgatgatgtgatttgtgatggcagaagggggcagctttttaccctcattcatgggtggtttgtgaaaatgcccacacaccagctaatctccccctactcccagctctttgttgcactttgccatcaatgaaaagaaaatgttggagtgtcttttttttatttggtgtgggagggcggggaagggctgttctctggtgatgcctttgaacttcctggtgactgtacattgaagatgatctctttgctggttaaaagttaagctcttcccagttagtgtgtttaatcccagcaacccagaggcttacctgattcaagtacattaacgtggtcatctgcttgttacctggcttatctttcctccagcatgagttaacctgttttgtttttttctccctctagattatttgctctcaaataactacgtaaattctatcatcgttcataaatttgacttttctgatgaggagattatggcctattatatatcgttcctgaaaacactttcgttaaaactcaacaaccacactgtccatttcttttataatgaggtaagtaattgccagaggggcacgtgtgggtgtaaagccacacgtggctttttttttttttttttacggcagcgccttatatctggatggtcttgtgtctgtttacaaagctcttatatgcttgttatgattttcatggcaacacttttgactttggcatgtttaaaaaatttttttaattaaataagttacctttctattaaaaaaatgtaattctttgtagagacagggtcttactatgtttcccaggttggccttgaacttccggggcacaagcgatcctcctaccttggcctcccaaagtgttaggattacaggcatgagccacagcacctggccagcctttccattgttaatgtaaaattcagtttgttctgagagctttatacttggtagagaggagacatgcccagatgttgtcttggggaagtgttgccctgtgggaaaaacaggaactccagtcagggctggttttgtcacttccctgctgtgtcaccttaaggaagtcccagtccctttctgaacctcagtttcctcatctgagaaatggggataagaatatacatcttgtagggttattaggggttaaattaaatgagatgatgtcttcaaagtgccagtatgtacatagctccctaaaagcatagacgttgctattgttgataagataatgtccctgacattctttgggagaattattaaaatgaacaacttaaataaataaattgctcctgtcctcacacctaaaaggggtttgaacaatagggtcaatgtatcacccacaccaaaaggtccaggcactggtcgtgctggggctggttcatcctgtggttcaacagtatcagcgaggacccaggctttcccatcttgctgctctgctgactatacagctggcatccatcctcaggttcaacccctcatggtcacaggttggctgccactgccaaaatgcctgatgagatcacttcccttcttgtgtccctttttaacttccaaagaaaactttctcagaaggttctcaccagccttcccctcatgtttccctgcatcccactgagtacttcttaggtgtcaggtgctgggataagcacaagaccagaaatgatctcatttaatctggaaaccataaagtagatgttattatccccatgttatagatgtagaaacagaggtttagaaatactgcattgcacaggttagaagtggtagaatgggtaatgaacccaggtctgacattatctggactcattttctttttaattataattttcaaagtagagatgaggtctcgtcacattgcccaggctggtctcaaaactcctgacctcaagcaatcccccctccttggcctcccaaagtgctgggattctgggcatgagccaccactcccagccaatcaatcagtgattactactactaccactactactgctcttttttcttttttcttgttttgagacagggtcttgctctgttgcccagcctggcgtgcagtggcacgatcacatctcactgcagcctccaactcctgggctcaagccaacctcccacctcagcctctcccaagtagctggtactatgggtgtgcaccaccacacggacttggactcttctgtttcttccatggctttgccttcctgtccctttctacatgccccattgggaatgaaccactgacttacggttcacattggcaacatttttttttttttttttgtctttttctgaagtctctgatggaattcagagagttggggtggggccaggcctggcttatgggcttataatttgttttcgttatttcttttgttttagcacaccaatgactttgccctgtacacagaagccatcaagtttttcaaccaccctgaaagcatggttagaattgctgtaagaaccataactttgaatgtctataaaggtaagtgtcctcatgggcttgtgtctcggctgatttctgacttggcagcaagcactcactcccgtgtgtgtgcgtacagttctccgattgtcacgagggagcacattgatgatgagccgtggcagcttctctcatgaaaaacttggaatcccctagcatttagctggccgctcatggaaatccttgccttctccaggcatgtcgaagtcttgctcatgctgctacatagaagtaggatgtcctgagaggcacgtgtgggattcagagtggctatgttttagaatttgagaaagcaaagttgtctttttaatgtgtcatttaaatttttgtgtcttggcttgtgaaatatactttaatacagctaaggggtaatttgacttttaagtaatatataaaagcatgtcacattgtgaacagcagggggcaatgttgtattcccaacaggctgcaaagcccagcactaacaattcctcctttccctcaagatgttcttaatgcccaaaacattgccccagggaaaaagccattcccccactctccgctgcactgacacaaaggctgcctggccacaagtttcctgaactggaattgcccttccaaggcgatgcttggaagttctctgcctaattcctgggttattttccccggagtcaccacagtggagatgggactattttctcagggatgaaagggctttgactttcatgagccaaaatgttattactccctaatgagggtgggggcttctcagggactcactccagcctagcactgggcttacattaaatttaagaacctttctaagagcccaactggacccacccaggggtcgcaaactgaggacctgtgggccatatccagccatcagacatgttttaactggcttagtttttgaaaaaatgtgtagttgccagtatttaaaaattgggagatcttccatgataatctggatttgcaccttgaagatgtagatttggctagtcaaggcccacagtcctgcagttgggggggtcagctggcacagaagcagctgcccctttggggtcaaggcccgtgctcccaggtcacacgctggacctctggcaactagccaacgtggcaggcttgtaagattgtgaccctggtccaagccacagttggttctgctgcctcctgctctgttttctcctgtctccttctaaccttatctctctgtgcagatgcctcccaccctagtctctctccctctgagcagctctctcaccttcccaggtcctaaccctgttaactgttgtctgttttttgcttttccttcaatgacgattcctgtgttccttattccagtgtcatgtaagttattaacctctggttttctgctttcttaatctacccttatatgtaaataccttgcttgagaatggtgtaattctcagtgtagtctagctcagtctgctactgataagtaggctctcccatgcaccattaatgtttagcccaactaatttatttttaagtataaaatatcataagaactgccttgatgactatagttttatgaataagataaacatttttaagtatttccaggaaagacagacaatttcagattatagcagagggctttttcattgtggtttttgggttttgctttgtttttgttttttttttaatcttccccaagttatttttggtagcttgactttttttttcttctgtgaattttctcagtggataaccaggccatgctgcactacatccgagataaaactgctgttccttacttctccaatttggtctggttcattgggagccatgtgatcgaactcgatgactgcgtgcagactgatgaggagtaagtgacacccccagggccactcagtagatagacagggtggttaggggagaattctgttttcatcaaggaaaaataaacacaagaaccgcacttccctacctctgtgtaggcagagcatggacttccgtactgtaaaaggtcctgctcacctatttgtaataatgaaatgctggaaacaactcagacgcctcccagagcaggcggggtaaatcaattcagtacagccatagatggggctgctacgcagctggtgagaaggtcaaggggctctgtcagctgatgaatgcattaacaaaatgtagtctgtctgtacgatggaatagtgtttggcgataaaaaggaatgaagtgctgacacttggtgtggcgtagatgaacctcaaaagcattatgcctagtgaaatgcccagaataggtgaatctataggggcagaaagtagattcgtggtttcctagggctaggatgttgtgtggggacataggaagcaactgctaatgagtatagggcttttttttcttttttgagacagagtattgctctgtcacccaggctggagagcagtggggtgatcatggctcactgcagccttgacctcctaggtttaagcattcctcctgcctcagcctcccaggtagctaagaccaccaggcctgtgccaccatgcccagctaatttttttgatttttagtagagatggggtttcgtcatgttgcccaggccaatcttgcattcctgggctcaagcaatcctcctgtctcggcctcccaaagtgctaggattacaggtatgagccatacatccggccaagtaaggggctgcttgcttttttttttttttttttttttttttttttgagacagagtcttgctctgtctcccaggctggagtgcagtggtgcaatcttggctcactgcacctctgcctcctggattcaagtgattcttctgcctcagcctctggagtagctgggattacaggcatgcaccaccacgcctggctaatttttgtatttttagtagagacagggtttcaccgtgttggctaggctagtcttgaactcctgacctcatgatccacccacctgggcctcccagaagtgctaggattacaggtgtgagccactgtacccagccataaggtgcttttttttgcaggggggataacagtgttctaaaattgactgtgatcatggtcaggcaactatgtgactctaccaaaaaccattacattgtgtactttaaataattgaatgttatggaatgtgaattatacttcaataaatctcttttaaaaaacagattaggatggtggttttgtcctcaaagggatgattagaagttccagagcaggatttctttcccttggctctattgacctcttgaactgggcaccattgttgggggggctgtcctgtgcgttgtaggatttttagcaacatcgccagcctctctacctgctagatgccagtagcacccctccccagtcgtaccaaccaaaaatgtccccagacattgccaaatgtcccctttaaggcaaattcaccctcacttgagaaccactgctccagggtgacagctttgcccaggcctagtgagaggtgcacctagatggggtcaggatgctaaagggaccagggcagacccattggagcaattgggaaagctagaagccttatggatttaaacagtcatggatgcgagacataatgagacacttaactatagaaagaacaaagttatacaagcaaggaaatgaaatcatagtcctctatttggctccacagggaatgttatgacatcaaccccaattactgataactacttgtggggaaggggcagagagaatggaagagttctgtcataacaggaggtcaatagataatacctaaaatggctcaattgcaaaataggagtccatgcagattttctagaaatatgggaggaactatctgcagaaacaagtaactgcctctggacagtgaggagaagtagaggagggctgggtgcggtggctcacacctgtaatcccagcactttgggaggctgaggcgggcagatcacttgaggccaggagttgaagaccagcctggccccatctctactaaaaatacaaaaattagccagacatggtagtgcacccctgtaatcccagctaccagggaggtcaaggcaagagaattgcttgaacctaggaggtggaggttgcagtgagctgagatcgcaccactgcactccagcctgggtgacagagcaagacactgtctcaaagaaaagaaaaaaacagtggaggaggcgagtctgggccaggagctgctctttttcattatcagcttatcaatgctatttgagttttaaacctagctgcatatattactttgatattttttaaaccaaagtattaaaaagtgaggcactttaaatataccattagagaaaatgttccaaagtatcttattaagtgggagaaaagtgcaaaacattgtgcataaatgttctaggtctcaggcgcacggtgggttcatagacattcattatactgttaggctttacaacatgtatttgctgtaaatatttaccaaatatcttttttcttttcttttttgagatggagtcttgctctgtcacccaggctggagtgcaatagtgcaatcttggctcactgcaacccaatctcccagattcaagtgattcttgtgcctcggcctcctgaatagctgggactacaggtgcatgccaccacccctggctaattttttttttaatatttttagtagagacgggtttcaccatgttggccaggctggtctcgaactcctgacctaaagcaatctgcctgccttggcctcccaaagtgctgggattacagacatgagccactgcacccagctgaaatatcttgttgaagtataagaaataattggctgggcatagtggttcatgcctgtaatcctaccactttgggaggccgaggcagaaggatcacttgagtccaggagtttgagaccagcgtgggcaacatggtgagacccctccaccctctatgaaaaatttttaaaaatagttgggcattgtagcaggtgcctgtaatctgagatgctttggaggctgaggtgggaggatcccttgaacctgggaggttgaggctgtaatgagctgtgctcatgccacagcactccagcctaggtaacaaaacaagaccctatctcaaaaaataataataaataaataaaaggaataattatccagaattatgtaaaagaagcagaattgatcttgtttttactttttttttttcaagtatatacagttagacggatagaaatgtgacatctatattttagatgtgactactactaggagaggtaaaaatgtagaaaaaacagacattagggttataagtcccaaaatgttaatagtggatatttgttagtggtgggtttgagactttgaattctatttgcttttatattttaatttgctgttgtcaaaaatgatcatctatcagttgggtaataacaacaatacaaacaaaatgcctagctagcatttgctgcatactccttgggggtggtgaaagcatcctcaccagctgtttctggagtgtgagactgactccacccaagagacattaccccctggccccccatccccagcatgctgttgctaactgctgggagacggagacctccagggcaggggcctgggggaggggtgtcatgtctttgctctatgtctgcatgtcgtcagggccactggggtggccacggctctggaggcctgcttttctctttagaactcctctggagcattttaattacagtggatttattgctccattagtgctgcttatctggggagccaggggatcttgccacagtggctagtagctgtgcttatgcagtggcttgctggaagagtttagcagcattttgctttgtttacctcattctgggagaccccagcagtcccctgaaattgattttagtaaacctgcccattttcccttgtatatctccccagtaggggccaggataagtgtctcttgagactaactcaaatatgtggatgaactcacagtgacctaagtctcaggccattgatgttaggctcaaaggctcctagtgttggcctccaggctgaggtggtcatttctcctggcaggcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaaggtgggtccagccccgtggctcccgctggctgaaggccatcagaagtggggaagaacagtccccagtcccctggaatggggctgagcattgcaaatcaggactgaggttttttttttgtttgtttgtttttaaaagacggagttttgctcttttacccaggctggagtgcagtggtgcgatcttggctcactgcaacctccgcctcctgaattcaagtaattctcctgcctcagcctcccgagtagctgggattacaggtgcataccaccacgcctgactaatttttgtactttttggaagagacggcggcatttcaccatgttggtcaggctggtctcaaactcttgacctcaggtgatacacctgcctgggccttccaaagtgctgggattatggccagaactgaggttttgagcccaagggagattcctttcaaagcacactggctttcctttcctttcctttcctcttatttcctgagacagagacagagtgtgtgtgtgtgagaagactataaaagtgaatgagaaaagattaccgacatcaggaggaaacaggaaacatctacaaatgtagggttttggtttctgtgcatccttccctgaagtgttctcctccccagtaacttttcctggtagttgccagaacccactgatttggagaagatacagacagcgacagaacttgcgcagcatggagggaagggatggagcacactcagggaacggtcccagggtggtgactgtccactgttagcaggccccagaggcctgtggggatgacggctggtaacatgcagggcctcaggaccaggaatctgcatgtctcacctatccctcaggtgattctgattctgtgctgctggttctcagggcccccctgtgaggaatgctgcttctggaggggaggcctctgtgcagttcctccggaggtaaaagggcctcagcaggaggcaggacagagccagctggtcaccatgcagaggtgctccaaggggatggagttttcaagattctcactacagatgagtaaataaaagaaagtgtatttttagtagaaacggggtttcaccatgttggccgggctggtctcaaactcctgatctcaggtgatacgcctgcctcggcctcccaaagtgctgggattacaggcatgagccaccgtgcccagccaggactgaggctttgagccggagggagactcctttcaaagcacgctgcttttcctttcctttcctcttatttcctgagagacagagacagagtgtgtgtgtgagaagactataaaggtgaataagcgccttagctttaccagaggcagctctgggaggcagagacaaagtatgagaattggagttttcagacctgcattcaaattctgcctcttccctttcctaactctgtgacctaaagcagttaacctgagcccgtttcttcggctgcaaaatgagggcctaactattcttctctaacagggtgggtgtgaaatggagcatcttgaaattcattataaacgaggggcttttccaaggccagagtgccctaaacctcctcccccatgctttgaaaataacttcccaagaacaggcctcctggaggcctctcctgccggggcgtccagtgccccagctggtacaaatgaacgtgcttggtaacttaaggagcaagttctcgtgggtcagcctctcatccgtgagtaatggtgaaaggtttctcagatggaaaaatagtgtccttgcaaacagtattgagtgggattttgcggagtggacttttgagtagcaccaagaaaggacagccctagggccgtggaggaagtcagtgggacaggacgcctttgttcacacagaaggcttttggctttgtgtattttgtgctgctcgcttgtgtgacctgatctctctctctctctcctgccaccctgcactagggaggagaacggccgaaaattagcctgccggtgtctctttatcttctgtcacaggtatgcttgatcattcaccaatgtccccactacatttggggtcccttggcgtgccactgccttgaagaaaatccccaggccttatcaccccatcttctctgtcccccccatgctggagtaaaataacagcaaaacagaaggggctttctgttttccaggtactaaatagaggtagtgtgtatctttttcatggtaggagatggaaatccaaagagaaatgaaaaataaaccaaacctaacttgtatagttgatttttaccatgaagactgaggtttccaaaacaactgaggagtgcttgaaatgccctggaaatgtgggctgcatcgcttttactcctgcagctttgaatgaagccccacactgcagaacccacagcgtgcatacacacagcaaccttggtgtaacaaacttcctgaaatgagtctattgttaaagggctttatcgcggttctagttcccagattaccgtgtggaaggaatcttgtagcaaccttagctctcagatttgtgtcttgagccaatttatctccctcccctccttcaacaagtgtgtttccttcatgtaattatgtaatatttacaagaagggaaaaactccatggcgacccagttacataactttaaaaatatttttattacaagcagtccagactctcagggcatctcattagactattaagtagtccagcatttacccagaattctgtttccgcttttgcaatggcacaggtatttatttgctttgatgaggaactgtccttctgacttgatccccagctgttttgaatttggggcggggctttgtctttttggcccaagaggagaggttcagaggccacctcctccccggcaggtaggccaatccggacatgtcctgaccatcactcacagcccagagtcctattctggggctatttgctcagagctctgcacgaggccaagtttgtctgaatgccgctctgtacgacggcgctgagcataaaccccagcctctcctggcagcttttttctgctgcctctttccaagtctgccggcatctcctgcttgagattctgagagtccaacaggacccaagcaagccagttctcagccccaggaatcatatggaaagcatcctcaggacccttcagctgttggagcattgcccgggcagggtctcctccagagagcatggccgccaactgcccacagcgggaacgtcagtggagagagttaggacttttctctgagactcctccctcaccggtttgctttgtaaaggaccagtagcccatgcacccaattacttgtttcagtatctcacagaaaacatagcttgtaattcattgttcctcaaacttgagtaatacatcccttttaaagataaacaacctgaagccctgtttccccctgcattttcatttagcttaatgaaaatgtgacctaaatgtgtgaaaaacctaaaatcaggtataaatcctgtgtcctgaaagcccctacttcaatataaaatcattgcatacttgcaaattattttacaagcatagctagaaaaccatgaaaatttttatggatgacgttaatttggtgtgacaggtgatgctgtcctcctaaaaccaaactgctaacagagtgtggtgtaggcagctgggcccagctttttgagtctggcctgcacgtgcttccacgtaccttacagttactcaccctccctcttttttgggttcagagccagggaaatgagcactgtgtgtgtccacaggcaggaattggttgctttgttcaggggggcctttgtaggtgctcactgaatgcttgtggactgaaaagaaggaataaatgatcagttaaggccgcattcattcaaggtacgtaacggatatttgagaatgaatgaccacagtgattggtgttttgtgttgttggtagagtgatgtgtggcagtaattcggccataaggaaggtgagaaaaatcatcattgctaacatttaagggcctgccaagccttggacgtgggttaactcattgaatcatactatgtggtctctgtgatagaaaaggttcccagtatttttttaaaagatgcaattttttatagggaggtgccacatggccattctgcctgtaccttttatctaatttgaattctatgtatttgttagaataatatattccccttgttcaaacagtacaaaacatggcatgtgaaaagtctctctcactctataccctgagcacccaactgcactccccagaggcagcctgtgttgatttttgccttcactttttaaaaaataattttttttaaacaacgttttttaaagttaaaaagttcaaacatgtaaaaaccgggtttctgttctagttttgttcaggctcctgacttctatccccagagacaattagggttacagggttctcgtatgtcctaacagagacatctgtcaggggttcttaactaggggcaattttgcccctcaggggatacctggcagtgtctggggagatgcattcagttgtcatgaccgaggctggggtgctactgacatctagtgggtggaggtcagggatgctgctcaccagcctgcagtgtctgggacagcctccctccatactcagttatagcccaaattgtcagcagtgccaagattgagaaaccctggcctatgcatatgtaaataagcaaatacaaacatgcacacgcttttctatgcaaatggtagataagccacaccctgtgctacaccctcttgcctttacattttaaaacaaaatagcaggcatgtctaggccagctttgcaagacagttttgaataccctgattcttaaagctggtcctctgaacattgggcaacaggtgtgggagcagggccagcttagcccagaggcagccctctgattttgcatcctggcccacctgggtttgcctctgtctcgtgtgattttcagccccgtagttcacatacctcctgacgatgctgtggaatccccgtgtgctaaaacccaccacagggtcagagctccctcccgtgatggaatctctgtgtagccaaccctctgccaagtccttgattggaacaaaactctccggccccttcttcttgtatcactaaagtattgggacagtgccttctagtcttctcataaccaaatttgacactaaaatgcccatggaaaggaaggagtgtgctggtttggctgttctttcccgcattgctccacttcagccggatttggcttcacccagccatgagggacagtctcgcattaatgcacttccttccgaggaagagcagccagccaaataggcaacagtctgaaggagagactgaccttacaagagtggaaccgagtcctgcttcctgtggctcattctttgaattttgcatcgtaggaattgctgcttaatacaggacttaggtagcccagcctggtcgcttctgatccaggaagcaagaggttgaaaataccgcacactttcatgcaaatcccgtttcttttttttccgccaggtcttcttaattatacatcatgcaccgctggtgaactcgttagctgaagtcattctgaatggtgatctgtctgagatgtacgctaagactgaacaggatattcagagaagttctgtaagtcattagcttcgggactgaccttaacaggaaaccattgctcattttgctaatctgtgtgtttctctaaaatcagaaactaacattctgaatatatagcagtgatgatgcataagctggtccgggattcagtgaacctaatcagagtcttgattgcatacccaagagaagctgggatcagggaccacctggatttgattgattgtgtgttcttaaacatggaattgtaccactccgggccttaggttgcatatctgtgagacactgttatcgggacacagtgagaaaatgccttatcagaggaactaatgtctacagaagttgggcgatgaacatccatgaatgactcaggccccaggtgagggcagtagagagtggcgaggggtgtggcaaattggagagtgtatgccaccttggcgagcagctcctgttctaccccaggctgctgctgttctgcaggaatatggatgtaggattactaggttttttcatgtttctagagaagcgggaaaaacgcattgttacgtgtaatctctagttttaaatgatcatcaagctttggactaagtagcatgtttgtggtctgcaggaaggagctttggcgttccatttggtacactgctgagggaaaacacctgatggccagtgttgtgacttctcttgaagcttttccatcttgtcctctgtatatctctgctgtcatctctcagatcctgctcacatgtcctgagctccagctgccttaatcctggtctgacttgcttttcccccagcatgtccagcatttgtgcctttgaacctgcgcctttaccgtacctacagcctggttcctgatgcacctggttccctcttttcaaaggtcttacccactctaagctccttatggcagggatctcacctgtcactgaatcagctgcagtctgggctgcacaaatgctcatctcacttatgcggagcccaggctgcagctgattcagtgacaggtgagatccctgccataaggagcttagagtgggtaagtgagatgagcatagtgcgttttatacaagggctgtttcataaaggtttcctctctgcagccaggtgctcaggcagtggccaggctggtaaaagggccagctcgccctggggtagtagatttgctgccccacctacatgaatgggtggaatgtgaccctgtggatgaaaggccaccactgcatggagtacaattacaagaggcccctgcccttccactggttttggtgtatgatggtctggccaggtcattttgttattcaggggagcattagcgcctctgaaaagcttcccagaaactctgtccttgttagtggtggtggcattagtgaattgattggggccttttcatggcccctgtctggcctatccctttcttgattcattcagcagtgttgatggagctctttctttgggccaagtatcatgctagttctggggatacacaatgtcataaagagtctgtgccgtattcgagctttacagtacagtagagaggtggacatggatcagatatgcaaataactcactgtcttaactcttataagcgctctaaagggaagaagtgtttggtgagaggctttggcctagaggtgacaggggtgatgtgttaaagattttcctagtggtccatctcatgacaacacacggtctggcaaatgtacagctgactcagagtttatggggccctagatatttctctgcaactttcttaaactagcgtttgctaaatgaatgtaagtcacggaaggctgagtcagcagaatcagcagggcctccagttagaggtgcagagtgccctgccagccacctggtctcgggcaggttgtttcactccatttagaaaacaggcagcgcaagccctgctctagagagctgatggagatgggggcaaaatataaagtgcccgctgggcacggtggctcacccctgtaatcccagcactttgggaggccgaggcgggcagatcaccgggtcaggagatcgagaccatcctggctaacacggtgaaaccccgtctctactaaaaatacaaaaaaaattggccgggcatggtggcaggcgcctgcagtctcagctactcgggaggctgaggcaggagaatggcgtgaacccaggaggcggagcttgcagtgagctgagattgcgccactgcactccagcctgggcgacagagcaagactccatctcaaaaaaaaaaaaaaaaaaatatatatatatatatagtgcccatcaagtgcctgctgggttgcaaactggccaccagactcatttggtttggtctttgcagtatttaaaagaaaattttctgaattgccaacattaaaatttaggaagaaaagtccagatttttggaatcttctccaacagtcagaagatctggtccccatcaatgcacgtttctacgggaagcttcgcagagcctgcccccatcagatgaggcgtgtttaccgtgaaacctgcccactgctaactgggactacattgatgttaatatgttaatagcaactggagatgtactgggtccctcgggacttttttttttttttagttgcatgatttccaagcctgaggatagctgccgtggcttcatctcagattgtcttactgtaagataccctctgcagtgctgaagctagacttgtcgttctaagagatgaaaccagagattgctgggctctggggtttgcagcattgtttatttatttttatttatttatttattttgagatggagtctctgtcgcccaggctggagtgcagtggcgtgatctcggctcactgcagcctctgcctctgggttcaagcgtcagcctcccaagtagctgggattacaggcatgtgccaccacgcccagctaatttttgtatttttagtagaaatgggctttcaccatgttggccaggctgctcttgaactcctgagctcaactgatctgcctgccttggcctcccaaagtgttgggattacaagtgtgagacactgcacctggcctgcagaattttttttttttttttttttttttttttttttttttgagactgagtctcgctctgtcgcccaggctggagtacagcggcacgatctcagctcactgcaagctctgcctcccgggttcacgccattctcctgcctcagcctcccaagtagctgggactacaggcgcctgcccccacacccggctcattttttgtatttttagtagagacggggtttcactatgttagccaggatggtctcaatctcctgacctcgtgatccacccgcctcagcctcccaaagtgctgagattacaggcatgagccggcctgctgcatttttagagttgtgataagaacacaacatgagatctacccttttaacacatttttatttgtatggttaacattattgttgagtgtaggcacagcatcattcagcagatttctagatctcatttatcttgcatactgaaacttcagaagtacaatgtgctatccattgctctgtggagtcacctgcatgactgatacttcatacccactggacaacaactctccatccccccagccccagcaatcaccattctcctctctgcatgagtttgacaattttagatacctcgtataagtagaatcgtgcagcatttgtctttgtcactggctcatttcacttaatgtaatgtcctcgagattcatccatgttgtcgcatatatcagaatttatttctttaaggctcaatgtgtgtgtgtgtgtgtgtgtgtgtgtgtgtaccaagaaatataccacattttctttttctttctttatccatttatccatcattatgcagttttagtttttttgattttttttttggtgtgttttgttttgttttgtttttgacagagtctggctctgtcgcccaggctggagtacagtagcgtgatctcggctcactgcaacctctgtctccagggttcaagtgattctcgtgcctcagcctccgaatagctgggactacaggcatgcaccaccacacccagctaattttgtttgtatttttagtagagatgggattttaccatgttggccaggctggtcttgaacttctggcctcaagtgatctgcccgtcttagcctcccaatgtgctgggattacaggtgtgagccactgcacccagcttttatgcagttttttttttaattgaaattttttactgagataattatagatttgcgtgcagttgtaacagataatacagagagatcttcctcagtttcccccagtggtaacatcttgcaaaactctagtacaccctcacaagcaggatattgacagtgatacataggatttatgtttgagcaaaagcaaactgcgggttactggcaacctctcagtttaggacactggctgtagctcaaccatttagtcaggggaagtgtttaggagatctgtcctctctcctgatatggcctcttcttaggatgaaggtctcacctcccttgtgagagacacacaaactgcctttgggatgtaagagccagttgtggtggacacctgaactgaaaatgagactctgtagcgtggagggaattgctagcccacatgtgtcggctttctgcttccagttactacctttctctcagtgtgaagttgaagttggttgtaatctgatgactatcgttcaggtttgggaagagcacaggctgaattccttctgtgacttgtttgataatagtcctggtacgatttaccttccttccctatgagcgagaacagactcctattgtttcctgcccaactcggatgtggtttgattatacttgttttaagtttcttggtcttttttaacctactttctccttcccgtaatttgtagataagttactggtattgcctcatttttaccagcagacctttcacaaaaccaaaccaaaattgaagagagagaagcagaggggagatcacagttatttgaaaggactgtaatttagggttaaatggaaaacacatcagcatggttagatgaatgtctaattgaaattcatctgtgcgttaaaatcatatggttcctgctaaaggctaattcttgctataattcgaatgcagagcagatagtgtttcttgtgtggggaaatcgagtaggacaacactaattctgaaactgctaacatctcgttgtttttgcagaatgaacatatagattagaatttgggatatgcatcattacttgtaggtactttttttaaaggacttttttttcctcttgggtttctgtggaatggtttccttcatttttgcattcattcatttattcatctattcatccattccttcagcagccatctgttgtgtacttgtgctgagagatgagggatgtggtggtgcactggaacgacctgacccctgccctccctgggcttccctcctcccatgaggacagggaccatgtctcggagatgcctgtgccacctgtgccatcatggggcttgccagagatgcccagggaggtgttcggtgcaggagtgaatgactcagtgggtgaagtggtagcagagtcacaagggctctcgtgacattcttgtaatgactctcagagcagaagtcacttcctagcctgccccttgaatgccgccttctctttgcctcagtggctgggtttgcagtgggctgcttttggtgctgttccatgttccacctccagaggcagccttgtggagtgggtgctgtaaccagtttccctgggctcctcaaatcgtggtccctgattttactaggtgttcccgggcctcagtttcttacctctccagtgagaatagcaaacatgggtttatgatgagaattaagtgccgtgtaaagtgcttactccaaagcctttttatgtacacagcaagtgcataaatattagatgttatcattataatgaccttagttcctaaggctgcgcagtgaccttccacctcctacctgggaccttcttccctgggcttacgagctgtctctggactgatgaatgtggaaacagacaccatgcgcccttcagtggggtggcttttgagcagacaccaaggcacagagggagaagtgttagtaataacagtgatgatgaaacaccaatgttagccattgccattgagtgatggtaggtgaagccctctgtgtgtatactgtgtgtatactgtgctctccattcagccagacccagatttaatttctggaaagtgcaaatactgttgtcgttgttttttgttttttgtttttttttgagacaggatctcgcgttgttgcccagtctggagagcagtggtgtgatcctagctcactgcagcctcagcctccccaggtcaaacgatcctcccacctcagcctcctgagtagctgggactaaaggcacatgccaccatgcccagataacttttgtttttttttgtttttttgttttgtggagatggggtttcgccgtgttacccaagctggtctcgaactcctgggctcaaacaattcacccaccttggcctcgcaaagtgctgggattacaggcatgagccatcacacccagctggaaagtataaatacttaactgctaatgtgggttcatatggttggctggttgtgaagtcagggtctgaggattctggggcagaataggcttgcttatctccacataaggacattgacagtctgtctgtagataccagtttagcagttaggatggtttccagatgaatctctggacacctgtcacttctagtagcaggactctctgcccagccggatactcccccaggatatggtgtgtggagccagtggctaggaaagtagcagccttgcttctctgggttgtgtgtttgcagattcagagcattaatcgttgacttagctcccctggtcgctgctgcagggctttctttacaactcaaacttgtatccgatgtcagccgagtctcccgtgtgctgaatgcatcaggcaggatagcaccccttccggccaggattagagttcctgagtcttttagtgaccctgactgtactcatgatcccccagctaatcagtgctggttccaaggcgcgcacattcttcttcctgaaaatgctaataggcttctgggagaaggttgattgtgaatatcaaagggtaaagatagacttctataaattaagggccttaattgacccattgcagacattcccacaagggaattagagcttggtgtatattctcccttttggctttgccattgaggtctatcccctaatccctcactgcagttacggctctgaggtgccattcttgcccaccgaagtattgaatgtggcagctctggtctatgtttaagaggatttgatataatcaaaatccagagtgcaacatgaggtccggtactaaggagcgtatcgttgtctgagaaacagttgcgtctctctgtttcctggggcagaaggtgggctggacaactgaggagggtctcaatgtcccttagtacttgagaagggagcaggctttagccagggccgcgggtgactgtgaccaaaggcccggggttttggccttgggccagctagccagagaaggggcaggtgccttcattgctacatcctggagaagccaattggtaacaatggagtgggcacagtgggcagggatgggagcaggaggcagatggggaagaagccttgtgacttagaccctagctggcttttctatatctgtcctgcagtgtgtgacacagaatgggcttggggcagccacaaggctggaggcagctccatgtagaatggggaccttttctgattgcgttgggccattggtgacttcttctgggtttcaattaaaatcagaaaattgagggtgaggacagacaaatgaggtacatgccacttctggcctctgtcccctgtggcattgttagttttcatgagtgggccagcctcttcggatatttgtgatttttaacctgattttgagttacctgaagccaggtcagtattatttattcagatattcagcagataattattgggtatctgccgtatgccaggcactgttctaggccctggagatatatacccagtgagcaaaacaaaaaccttgacctccaggaacttgggtctcatgcagagagacagaggaacaataaagcaaatagtaacatcagggcacgttagatgtgagaagccctgggaaaacagtagtgaagcagaggatggacatgggcaatgctcggaggctggagtgttacagttctcagtaaggtggctggggttggccttgttgggaaggtgaggtggaagcacagactcaaaggaagcaagagagtgagtcatgttggtatctggaggaagagcattttggtcataaagaacatcgtgaacctgggaggcggagcttgcagtgagccgagatcatgccactacactccagcctgggcgacagagcaagactccgtctcaaaaaaaaaaaaaaaaaaaaaaaagaacagccagtgcaaaggccctgcggtgggatggtgcctagtgtgttggaggaacagcaaagggcaatgtggcaaggggatgggaagtaggagatgaggttggagagaacaagtgtccaagggacatggcacctatgtgccattggaggactcaggagttgctgtggaaggagactggaacctcttcgtctttgtgtccccatgtctagcatggttcctgcagtcaacgttgattgtcttgatgtgacaagtctcggtacgggaatcaaacacatatctctaatgagcggtggacatccggtcttggccagtgtcagagtccttgaaactggttttgctgcgggatgctttgcctgatgggagcctgagggctgcacttgagcaagaagggagcattttgctcacttctcagagacccctgccctttctgggcattccagcagagttcacaagagtggcttggtggtgtgagtcattcgtttcatgcctgagggcagtgcagctctcatccctggaggtgattaatgagtgggagtttccctagagagttctgaggccagttgagtagcagatcctggctggcctgaaattgattgcctgctgaccacttgctgggttgcttataacctggccccaggacagcttcctggtagcctccagatacgcacggggacaaatttgttagtttcatgggcaaagagaagaaaaaatacaataccttactgttaaccacagtcacccttctgtgcaatagaacaccagatctcactcctcctgtctaattggaactttgtacctgttgaccaccctctccccatcttccccatccgcatccctgcatcccctccctgcccagtctcctgtaaccactgttctcctctctacttctatgagatcaactttgtttagattccacaagtgagatcatgctggaagacagagttttgaatgttctcaccacaaagaaatgataaatacatgaggcgatggatatgctaagtaccctgatgtgatcattacatgacgtacacatatattaaaacatcaaattgtaccccataaccatgtacaattataatgcatccattaaaaaataaaaaagaaaaagataacattaaatggttttattcactcaaataatattgtgctgggtgacacttgagttctgggtgggtcattttctgacatgagcagaatgtgctccatctgtgaggcagaggctggctgccatacttacccttgtgcactccctgcctcgagtaattgttgagcccctacaagttgcaggcaggtgctgtgaatgaacaagacatctgtcccttccctgatgatctatttgtgggggatagacagtaagccagctcatcctcacaaatttaagatttggatatgggaaggaaatagaagcaactttgggaggtatgatgagggaagccctctaaggagggagcctaatattgagaactgaggtcagggagctaggcctgctgagagttgaggggttgggtcggggggcgtggccaaaacatgagaaatggtgagtcagaggcctctgtgggaaggagttgggtgtatatgggatcaggagagaggccagcattcaagaaatatcctgggttggtggaagagagggacggttttcgttttatagaagatgaacctggctgggcttggtggttcatgcctgtaatcccaccactttgggaggccggtgtgggcagatcacttgaggccagcctagacaacatggtaagaccctgtctcttcaaaaaaatacaaaaattaaccgggcgtgatgatgcgtacctgtgattccagctactcaggaggctgaggtgggaccatctcttgagcctgggaggcggaggttgcagtgagccatgatcacaccactgcactccagcctgggcaatagagtgagactgtctaaaaaagaaagaaaagaagtcaagcttacttgtttgtctcattgaacatctcatttcacgctcataatgaaagagagcgaggtggtgttattgtcacacgctccccataaggaagccaaggttccgtgattgttcctttgggattgcaggtgactagccccaaatctcacactgtttctattccaagtctttttatcaccacttgcaattatgttttccagtttggcatgagatgtcagggcagtgtagcattttgggctgttctgagtaacagaataaccagtgtttcacagttcatctttttcaaaatatagtaaaatactctttccaaagaaataccaaataagtgcttggtttgtcattgtttagtaagggagtgtgagatgcctcattttgtgtgattgaagaggcctgttcaatgctcgtgatgatcttgcaattaattcatcccacaagcattccctcttgattgaatgccagagacagtgccagacatgctgcttggcattgagagggacagagaaggtgacctgggatggggaaggcaagggagaggaggctggccccctacagacttagtgacacgccagaggtcactttccaagaggaaattgcagcaccatcttgacgttacctgctcctcatctcagcgtcaagtgctgagcacgcggctgcaagaggcctgtgagtgctgtgagtctgttccaattcctgagagatggacatttccttgctttacgcctctgcagctgcaacacttgataactggtaattcatggagaagaatgccgtgttctccttgttaatggaagcggcctgctacctttgcatgttccccactccatagcattcattttctcctttacatttcggcagtgccgtcaaatcgcctcactgatgttgcagctgtgcattcttcatgcatgttgggctttggttccacagctccacgcggctcctggattggcgagtaaggcatatgtctatacatcaccctggggtacatcacccatctggtgcttgcttgccaatcacctccttctggatgagaacaggttcactctgctgcactcatcacccggcttcctttttcagccagtggccaagccatgtgctacagtgctgttggttacagtgggtgtgacctcctgtgactttttgtctctgtgtttatcaggtaaaaatgtgaaaagatgtgtgtgtctgtggtcccagctacatgggaggctgaggctggagtatcacttgaacccaggagacggaggttgcagtgagctaagatcacaccactgcactccagcctgggtgacaaagtaagatcctgtctcaaaaaaaaaagtgaaaagagtcacattatagacaaccatataattgtcaggctagaggaccacctgttgagtgatgcataaactgtcactgcatttttgttgcaaagagctactgtttctctgattagtgtgacgtcggcatggcctagtctttacatcagtgctcccgggaggctggcccaacgttgggaggtgcagcaaatgcatatggaagggaatcgtgtttgagccatgtggcaggaaggttgtgcacctgggcactggggctagtttattcctgggttcaaatcctgcctctgcctctcactagtgggtgaccttgggcaagatcctcacctgtgtagttccttgccccatttggttatttgtaggataaagcaagacaatgtatataaagtgttcagagccatgctgggcacattttaagtgttcactgagtattcaggatggctgttattacctggaaagagtaacaagagtgtgccatctcttggcacctctcagcagcactgttggggagatgctaatatgatgcccattgatggctgtggcaactgagacctatagaggagaaggtaggaagcagtggagccaggactgaaaccacggtggatgggaccctgggcctctgaatcccaccctggctttgtaccttgctgtgtaccttgccagtcctggcgcctgaggccggagatggggaaggttagccaggggcccaggagcatgttggggaggctgagtctagcccactaacaaagcagaaggccagcgagcagtaagttgctgggagcttgggagtcaagtttaaagcatagaacatgactgttctttaaaagcccctcccctgccctctcttccatcctcgtgatctatttgccagggggttgaagggcaatgaaaatttctctggtgcccccttgtaccaggcattttgcctgttggatcccacactacccccatggtggcgtgtgatatggaactactcttgtctctgttttacagatgaggaactgaggctcctgtggtcagggtcgcttggctagtagaatgtgggtctcagacttggggccaggtctgcctgggcatgttttttgttagtcaccatggcctgtctcctttcttaaggggaaaacctttctcctacttctcaaatcgcttagcagagctgtttgaggaagcatcctcagagggtgagtaggctcggcctaggagagcctggaagggtcttcttagcttgattatcacaacagctttgatagattcagacagaatctcaggccctggaatctctccttcctttacctgatgcctctggccaccggtctctctttccttcgtgctcaaccaagattcttccctgggcaggctgcctggtgcccttacatcccctttcctggtcactcgccaacaactgctttctcccctccctgctgccccactgaatagatgctgagaaacccactcaacacgttgcatctatagggcattgagtcaaggtatctgatatctcttctgaggctgtgagcctgaagaacccctttgtgagcagcacgggctagtgcctgactgagaggctactggctggccggggaccactgccctgacttcctgcaaagtccagcggctgtgcatctgcccctacctggggagctggccgagcaccttgggtccaagggtaccaccactgtcaccaagcaccagccccaggtgacctaggccttagcagaagtaaaaggtgagtggcttctgggcacacctagagagctggctcctcctgggctctgagctggctttcctactattctttccttcctgagcatgctgctgaagtcctgttgacatccaagacttgtatcagtcatttcctcctctatcaagccgtcctaagctccccctatgcctcccagccctggcgcattttccctcccttcctctgcggccccatcactcttgtgtgaacctcttctcttccagcgtctgcatgggccatgtggcaataaatgcaggattcaccaggattcacctgtctggggtggactgtgggctctgagaggggtggactgtgggctctgagaggcgtggactgtgggctctgagaggcgtggcctgtggcttcctgcgcttacctgagtccccctcatttcatcagtgatcagtgaatccagctctcccacctgttcgctttgtcctaccttgtatttagggcattacagcaatccaacttcattgaaaatcctcttggtaaactttttggtgttttttgtttgtttgtttttgagacacggtcttgctgtgtcacccaggctggagtgcagtggcacgaccacagctcactgcagcctcaaccttctgggctcaagtgatcttcctgcctcagcctcccaagtagctgggactgcaggcatgcaccaccatacccagctaaattttgtattttttgtagagacaaggtctcaccatgcttcctgtgctcatcttgaacttctgggctcaagtgatcctcctgccttagcctccccagatcttgggattacaggcatgagccactgcgcccagcctgggaaagtttttaaattgaggaatcacataaatacaataaagtacataaaagtttagtaatcttagatgtactgcttgatgattttgtgcacatgattatattcatgtataattcgagtcaagatggaaaacatttctggtattcccataaagcccctcctcagtttgtaacccatacctccaccccacccaagagaatcaccatcctaacttataaacttgccttttcaaagttttttaaattgtgataaaataaacataaaattcactctcttaactattcttaagtgttcagttcagtggcattaatgcgttttgtaaagatgttctttacgtgtaaatagtgctggtaataaaagtttctagtgctggtaatatctaaatagtgctggtaataaaacaattgagtgatgtagacgcaggtagagcagaaagtgaaaggtcctccaacctcagtatcttcctcagagggaaccactgttctcagtttgtatattcttccagacctttcgctgtgtattttcatgtaagtatcaacccaggaatacatgatatgcacttatgtttcagccctatagttttggttttattttaaccataaactgaatcattaattgttgattgattgcaacttgctttttcttgtgcagcctgtgtccaggtctttgtaagctgctgtacccacacctggtggaacatgtttgtttgacatctgtcttctcagccatgtgtctcctctcgttcactcaggcacccagtctttggttgtttccatcctccctcccatcccattgctgccctttgcagtttctgcacacagattcctccattccatgaaagattgatccctggggattcacctttcccaaagtgtttgacttttgaaaaagcaaggaccaaagcctcaggtgaaggggttcaaggctgatggaagacgtcattaaccagcaggcaggtgcagacgcttagggagtagttaggccccggggcacctctaaaatgtagttgctgactgttagctggccctcaccccagaagccagcccaaatattcagctgcagagctcagggctcccttgtgtttcactgcagtcagcaaagaggctccttcccttcatgctcctcctgtagcccagcctcaggcacctgggagatgagcgcgtggtgaaacctaaacctgtggcatttgggacatgtagaccttctttgcagaatacttttccctggggcatgtgttgtgtactttctttatgagaaaatcaacccaaacgccttgtgatttcttactctgaagtgggcttttccacttctggttagtttgggtgagcttgctctttcattctgctacgtttagctcctgagaaagtttggctttttttccccttctttccctcccttctccttcttctccttttttcatcattctgtcttgccctttgggtacagcctggtacaaacattcattcctacagccatgagctcactcagcagcagcctgtccgcccctgctctggtccaggcaccgtggggtagagatgagagcacagtggcgagaggagggacaggggcccttctcctaggggcttcagactggagcatccttggaggctggcagccagaagcagggtgaccggagcaacagaaatggtcacaaatctctgcccacatttcccagccaaattctaccagcctctgcatgctaactgtgatgttttggtgttagctttaagaaaaaacaaaaaacaaaaaacaggtttttaaaatatagaataaaagggagcaaaaatagtccttagtcccaatgtccaaatgacccctgctgaatttgtattatgtatctatttatatgtatatgtttagagacagggtctcactgtgtggccccggctggtcttgaactactgggctcaaggaatcctcccatctcagcctcccaaagtgctgggattacagacatgagctccacacccagctgaatgtttaaaataaagttaatatatgttcatgattagaaatctcaaaccaaaaggtataaaataaaaaaagtgtgcttgtgtgggtgtgtacacagtgccactgctttttttaattcccccaagatgccaatacattcttaggcatctttccaggaaaagtcgcatttacaccatcacgtatagcctttgaaaagctttacttgaaagggaccctactgcctactcccttcctgcattttcatcctggtgctgagtctgcatcagtttatttaggaataaaaaggccccagtcttcttagattcccaccctttggacaaacagatcataattacctaacaactcccctatcaatggacatttaggttatttccagttgtttactggaaggtcgtgttataaaggtttgaaatttccccagtaagcatgccctcccacaccagacacctgatcactgagaaaagtagatccctttggaaagttttaaaattcattcttgcagctgattttttttttctttttttagatgtaagcaggaaaagaaggtaatgttttgtgttggatgttcaccgtttcggcactctctgaaggaactttattacttatttatttattttgagacggagtctcactctgttgtgcccaggctggagtgcggtggtttaatcttggtttacttcaacctccgcctcccaggttcgatcgattctcttgcctcagcctcccgagtagttgggactacaagcgcccgccaccacacctggctaattttttgtatttttagtagaagcggagtttcactatattggccaggctgctcttgaatacctgacctcaggtgatccacctgcctgggcctcccaaagtgctgggattacaggcgtgagccaccacgcccggcctctgaatgaactttatatccatgggttcctttggttctagggggccagaattactctccatgttttagaacaggaacctgaggcctaggacaggccagctgggttgggtttcagaccactctggccagccccaggcgctgagcactttatttcacttcgtcagttctgccagtttgttctgtatgtctgagtccacacagagcttagggaggggttctatatctgtctgtgtgaatttctgctcttaatttcaaactaggggacgttttgccctgcgcttggtctctattttctgtttctgaaagctttgattgctgtgtggccggctctgaaattcactaggagttggcagtgatgggaggaagctaacttcctgggtttggatgcttcaggagaagatgagagggcgactaggctgcattcgatcacccggcatcctaagtgggctctgatggatgctgtctgtcaagcagtgcattctcagaacgctcccatctgggggccctcggttattggcgtctgtaatacgctatctgggtttcctggacagtagaatcatgcagcaatttatgtgtcatttttttgtggttgaataatccacagtgggcaaataaaaattaatgtttatatttggatgctaattcacctttcaattaggttttgttttgagcgttattgaaattaatctgtgttccttgagcacatttccatttattggcaaggtacggtgttccccagcatataattggtggtcgtttggggtaaattcagatggataatctatatcaagataatggaaaagtttattttgaaactttttttaaattacaaaatgatatctgaacattatttcagactctgataagagaaaaacacttcaatcaaaatcccgccctaaacaaatcaattttcttctgtcttttgtgcctttctagtctgtttgcatgtctatacccttttttttttattttcttttttgagacatctcactctgtctcctgggctagagtgcagtggcgccatgttggcgctctgcctccttggctcgagcgatccttctacctcagcctctgaagtagctgggactacatgggcatgccaccatgcccagctaatttttctattttttgtagagatggggttttgccatgttgcccaggctggtcttcaaatccttggctcaagtgatcctcccagcttggtctcccaaattgctgggattacaggtgtgagccatgtgcctggccttcctctttaaagagcattaaatgtagaattaagttttagctcctggtgaaacactgttcttttaggaagagtgtgagctttggaattggcaagccccagtaagccccaattcaaattctgactccaactcagtagctgtgtgacattgggcaagttatttaacctttctgctcctctattttctcaatgataaaaatgggactgataattcctatatattatggttgttataaagactgagatatactaatatgaagcatgaaccacagttgacactagcctcattctgtcgcccaggctggatggagtgtagtggcacgatctcgctcactgaagccttgacctcccagcctcaagcaatccctcccacctcagccccgcaaagtgctgggattagagaggtgagccaccacacccggccatctctgactttttaaaggaagaactttgtcctctggggcgagctgatctttgacttattgctgatacttactaggctccctttctaatgagagccagaatttgacaacacccactacacctggctttttctttctggttatttatgtttaatataatagcaaggcacgctagtgttccattgcctgtagtgatagttttgtttaaaatgaacttatttgggttaaaattaataataatatcagtgggctgtagctaagacacagcttgtgtggctggtacgtggttttgaatcccggctctgccacctcctggctgtgtgacctcgggcagatccttttctgtctctgtgcttcagtttcttcacctgtaaaatgaggatgacacagtaatatctcatgcagttgctataaagttcaagtgagatcatatagtcagagcctgagaacagcatctgacacataagaaagtaccacagaagtgttcatcagaagttctccttacacaaacagctaatatttggggagtgtagagctgctgctggtaaagtgcaccatttctgacttagggcagtagacagtaaatggtagctggcactgttgttttgattatttgatgatgatgttaataatgggcataataatagatctggaggtggcatttgttttggagattaatttctctttattaaaatatgtttttattgtctgtgttcatggggtaaaatggcagtgttgccacattgatgtattgcattgtggtgaagtcaggaccttcattgcatccatcactggagtaatgcgcactggacccaccaaacaccctcccatcatccaccccctccaagtccaccacccctcccagtctcattgtccatcatcccacactctgctgccatgtgcacatgttatttagctcctgcttatgagaatatgcagtaagtgtctgagttatttcacttaagataatcgtccccatgttgctgcaaaatacatgatttccttcttttttagtgctgaatactatgccatcgtgtgtatacatgtcatcttctttatctagtcctctgttggtggacacttaggccgattccatgtctttgctattgtgaatagtcccgcagtaagcatgcgagtgcagctatcttatgatataatggtttcttttggagatgagtttcttaggacagaaacttttgggcaacttgatagcatccagcaggattctagtgttcaaattcacctgttgccttcgttggactttcctaggccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaaggtgagtgtccccatgaacgccgccctgtgcctgcgccgccagccagcccgccagcgaggctgccacctgtgccctctccacccagacttctgctccccacagtgtccagccagtgattcgattcctacctcacactggcgtacctcattctatacagccctgccactcggaggctgctgtaggtgtatgtcatatgcaggtccagggcaagtcccgccctcatgggatgggtgacctggggccagttttcctcacctattaaaggagggtaacaaatagtacctactttgtagtgttcatacaagaattaaatgagcgaatatgtgcaatgtgctccaaacagtgcctggcccattctaaatgctgcaaaggcttcgatgctgcagaagtgttcgtcattattatgacagtaggagcagcatggaattattattatctttatccttattactgatataattattcccaataacctggggttatgatttgcatcctgtgcactgcgggaagaaagaggatttgtgtttaatgaaatgatatgcttgtaggccgagtgcagtggctcacaccttaatcccagcactttgggaagccaaggtgggaggatcacttgagcccaggagcttgagaccagcctcaccaacatgacgagatcctgtctctacaaaaaaaaaaaaaaaaaaagtgtttagtatttttaaaatactgaaaaatcaaatataattctctcaattcttacgttaaggttttttaagtcctgtctgtttagaatgaggtgcactcgtgtgtagtacgtatgtgctctgtaagcaaaatcattcattcctccttttgccctttttgggaattctggtcaatttttcacctccctctcgttgagatgctaaaaccttcttgaattggagatcatttactcttgggattaagcagaatggaactgccctattgcttgtgtcatgggccaggctcacagccacacagctggggtctctgcccgtcgtcctgggcactggggctgggggcagcgggaagtgatggggagcttgatacttggtagaagtggagctggggctcttctcaggaaggtctggccacactttctggaatgaacttggcatctcctcagcagtctggttgcagtctctgtgggtgtggggaacacttcctgtgagccctcctcctgggccttgggctcacagtggctgctctgaaaccacctctccacagccctgtcagcaaggactgcgtgagcttcccagtccagggcatctgaagctgtaacacagagccactcgttcagtgactgggagctcatttgcttttgggagttgcctgagattctgcagccaaagaatgcctccgccaccaccttgcttgctccatcatgactttcttggcagttgtcagtgaataccatgatcacatttcaacaagcgtaaccaaaatgtctctctggtgccaccgagacctctttttatggttgagatctccagcctcctcttatttctgtttaaagtgtgcaataggtgttttggtttaggaattcatttttggcctgggaagcctttgccaataaatatcactgtggtggggaggggaaggccaaacccaaggtaagccatgctaatttgcttattggggtcattctgattattttgttgttaatgctgaagaaaaatgtctgcctaatccctaggtttagttgttctgttgccacactgggggagaaatggacatcttcacctcattttgtgcattgtgttctcatcgattttgttttggaaagatgctacctctttcattccagtccttttaaggatgctctctaaccaggcctcagctgtgactaacagtggtgtggatcagacaggcttagccccaaaatcacaatcaaattagtcagccagccagcccagtcctggcacacaggggcttcaggccagttctgcaggctgctgtttcagcttgaactgcttgaattagagtaggggctcctggaagctgtgcccagctgccctgggcagggtacaagggaacgaatttctgccacgtccaaaagcctgttttccaggtggttacttagccagatcgtgccacacaggacccaggaatctccccagaggctttgcttgaacagttggtgcttcagggctcagtcacacatggctctcaatgacctgtgcaattttgatgccctcctaatttcttgagcacattagtcatttcaaaatatgatggatctgtcattttgtcactcagctcaccataaatacatacaactttcatagaccggtcctgccaggcaacagcacttgtattctggagctttctgaattatatatttgctctcttgattatttgtaaatgtgaaggtgcagttggtgggtgttctctccttagacggtatctgtgtttggatgaaactgcacagctgttaattcctgtgagtcggaagggtgtcaggcacatttcttcattcacattgcataccagagaacagtgtagatgctgggcagtgcctagaagatgcgagatctgactcgcagtcatgtctcagcatctaggtttattgtgtgtcttggatggcctcttgaagctctggacctcattgttcctgtctggaaatttctgaatatagaaaatataattcacatgatgactttttttttttttaagtgaagatacgttgatatttgcgattgcaagatttagaaatccaactcagactggcttaagcaaagagggtgtttattgttcatgttcctgggaagcttggacagggctgggcccaggtgcgctcacatcgtcccagcttggccagcaagtggagagggggcttctccttcccagtggctgccactgaagtcctggggccaatgcttgtgggtactgtgggcctgacttgggtcctcttcccacccccagagatattctggaccgattggcctggcccgcatgacaaatctatgctacagtggctccctcagtaaaaaatgagatgcgtttatcagaagcaaggggcagggatgctgggccagcagaaatagcagatttccccctagaaagtcacactgtatttctgggtactccccttctctctcaaggccatcttctgccatcctattttgagatagacatgcggctcttttctcttccacattatttcttctctagaagctcctttcattgtccctagatccacggacttatcgacagatggacatggtgactcttaaggaaagagatgctgacactctgcctctgcataccctgccaatcccattttagtagtgaaattttgactttaaaagacggggaaaatacaggagtaaaaaaggcatgtggtcacgaggcacagttttgccatgacccaatttggatatggcattagtgtgtattgttttgttgttgttgttgttattttttataaatgcagcacccagaattcacacctcctccagatttaagctcagacaaggaagttgtgtgaaatgaatgtgcacccctaacccatccactcccttccccagtctacagaggaatttgctctgcctcaggtcccaagtaatgggtgactcattctgcaaccaagaaatcacagggcccctaaatttgcagaaattaaatactaaaaaaagaaggatatcatcgtccctgtaggcaaagaagcattcactctgcccaggaaggcagacttcctagggtacgtgcttgttttttagcttgcccttgagtctgaaaggacagttatctcttttggaatttacttagagcagtaacttaataagcatatcctagggactgaatccttcaaactcctcatgtaaaaatagggctggactactgtttttttgcctatggaaaaagtaattgcccggactcaccttcaaagcctactcatttgttgaaattccagcaagggcatgaagtaaagatgataggcctttgaacctgccaggttagctgggtttgagagggtacctgggagtttagagacccatcttgcctttttctttttcttttggaagtctctactgaaatgggatgaaacctggcctcatttccagctcctctttcaaaattagagccagccccaggcctggcagtgtcttggttggggcaagccagggactgactatcggagagttgagatctgaatcccagctctgcccctgaacagctgtgtggctctgggcaagtaattgccctctctgcacttctccacctatagaggggacttcctaatgcctgggcctcagattgtcataagtgagaacatcaacactgtagcgttcagcatgtgacacaggagctttctacgaaccctggccaaggtggagggcagagtgaggcgctcgaacagcaatttgagtgtggttgcatgacctccacttgggcaccaagcacgtttctgtgggacccgtttctctgttaatttctacagctagtaagtgagcttagtgagtgtgcaggtgagtatgtgtgtgagagtgagtgtgtttgtatgtatgtgtgtgtgtaatggtgggaagagagggagaagaaggatcagcaggcccaggcgctgcagtagagagatgttgtggggctgtcaggttttcagatgggcttaactgggataaggaggagaattagaggtgaattaggacaaagcctctgaagagcaacttcccgaaaacagttctcaactcaatctcctgctgggcagtagaagataataaaaaaacaaaggaagggctgcccccagtacttagagcacttagcgcacacactctcggtcgttgtcaggggctgtttgcttcttgaaattctgctaaaaagccagccaattacatgcaggctgtcccttatatcctaggtaaccagccaggcatctttccccttagccttcctttgaaggtcttattcccctcttgccatcttttttcagtctgtccttgctgtgatcgctggaatatggaacacagagggcaactgagaaaatccttgaatttgtgaagtcaaagactattgggaggccatgcctgccatttccctgaaaagcacttcatttaccaaatactaatcagattcgaatggacatcagcccgggcgagttgttaaattattgctgtaatttgaaaaatgagtgtgtcagagtatcagggaagctcaagaatctggccagagctgtcatttagagaggcagaagtggacgtccttgggtgctgagggccctcaggactctcctggcccacaccagtgcctccccacataggcactagttggacaacaagtggaaagatgtggccttccctgctccctttttttttcctttttttaaacttatggtaaaatacgtataacaaaatttaccatctgaatcatttctaagtgcacatttcagtagtgttaagtacattcggctgggtgcggtggttcacgcctgtaatcccagcactttgggaggccgaggtgggcagatcacaaggtcaggagatcgagaccctcctggccaacacagtgacaccccgtctctactaaaaaaaaaaaaaaaaaaaaaaactagccaggcgtggtggcgggcacctgtagtcccagctactcgggaggctgaggcaggagaatggcgtgaacccgggaggcggagcttgcagtgagccgagatcgcgccactgcactccagcctgggcagcagagcgagactctgtctcaaaaaaaataaaaaagtacattcacgttgtataaccatcaccaccatctgtcttcagaatgcttttcatttttcatcttgtaaaaccaaaactgtgcccatttaataactccccaccccaccctttgatgttctgtctttatgggtttgactgctctaggtcgtttattcaaatggaatcatacagtattgtcttttgtgcctggcttgcatcacttagcataaagtcttcaaggttcattcatgttgtagcatgtgctggggatttccttctctttcttttttttaggctgaataataattccgttatatggctggactacatttctttatccactcctctgttgatggacacttggattgcttccacttttggctattgggaataatgccgctataaacatgggtatacaaatccattcctgcctttgaggcttttgtagaattgatagaggctgcagagggtctgggtggtactggccaaagcaaaatgagttggagatttgagttcctgctcccagctttgcagcctcatgagctgtgggatggtaatcacattactcagctcctagaggcgggaaacttcagttgtgtgatggcgccgtaccacctacaaggctaggcgctggagtgttggacatgacgggccatgctgcctggcatgggaactgatactgtgcaggcactcatttccacaacttaagggggcagtgcaaagaaaagagcccacagtagcctggggcagagactaatgccttggtacttcagtttcccctgccttaacatgcagagttgagggtacataagtatttctaccactgcagaatatagagatggttttagatggtacagggagagccttaaagaatatggtggccaggcgcagtggctcacacctgtaatcccagcacttcgggaggccaacacaagaggatcacctgagcccagaagttcaagaccagccaggcaacatagggagacccctgtctgtacaaaaaataaaaaactagccagtcacagcggtgtgtgcctgtagtcccagctactctggaggctgaggtggaaggatcccttgagcccaggaggttgaagctacagtgaactgtgatcgtgccacacactccagccggggtgacagagtgagaccttgtttcttaaaaaaaaagaagatggtgcaagagctctaattctaaatgattatctccatggcaggggatagggtgggtgggggagcctgcatatttgctgtgacaggtatttagtacttgaatacctctttcataaacatgaatctccctttcatctccctttctcaatgcacacaacaggccctagcacctttttgtttattcatcatgtatatttttgtagttgctttctatttatactggttttatgcttatggtaattttcccaaactttttatttgaaaataatttcaaatttacaaaaggtgcaaagccaaaaatagtataaagaacacctgtttaccctttacccagtttacccctgtaacatttcataccatttactttcctattgtattttctctgtctgcacacccgccccacacaccccacgcacattcatcgtgcccctttcctcctgaagcatcatgagcatttgctaagattaaggtgttctcattcatgagcacagcacagctgtcaaattcatagtattctcctgctgtgttcttgttgtattggcctaataatgtctttctagcatattctctcctccagtgcaaggtccaatccagaggcgggtggtgccttccgttgtcacgcctccagcctcctttactccggaacatttccacgatctctttctcttttgcgacattgacttttttttgaggaatacagaacctcctcctttttttgttctaataaaacgtccttcattttgtctttgtgtgatgtgtccttgtgattagactgagattatgcgttcttggctggaacacggcatgggtgatgtcatgcacttctcagggtgtcacatctggaggcacatgatgtccttctgtccctcttgggtgatgttcgttttggtcacatgactaaggtgttgcccagtttctgtattgtgtaatgaccttccttttcttcccaactaataagcagtccacagggagacactttgggatcatacagatattcagccccttgttaaaattcccccttagatttgacatttgttgatgattcttgcctggttcagtcactatcgtaatgggcaggaaaagatgattttccacgttcaacattctctctgtgtttaaaagtcagcccttggcattctgttgtaagcaagacctttcccttcttctcatttatttatttatctcttattggtgtggactcatggattccaattttctaatggtttatagtgcattactgtatttaattattttggtgcttaaattgtcccagagttggcctgcaggaaccctttcaagctggctgtcatgtgcttgcctggtgattttttgagcagtcacttacactttctggcataacatggtgttctgtgttcatctagtacctcctctgcctgtccttggaattaaccatttctctggctcctgtccatgggcaggggtattagaggccaagatttgggcactggatgtgctcatcgctactgaggtatctttgcagtttggccctttcagtggagaaagctaggaaatctatgtatgtacatatacaaagtgtacatttatatgtgcctacatatacatacatataagcatgcgtacacacacgtattttagaaatcatatgttcataccagtacccccaattccagtgaatttacaggttttttttttcttgtcctctcccatcttagatttgtatgtttcttcttgtacactgagagccctgactcctaacaacgtctactcactgatttgcccaatcttataatgcacctaaaagcttcagaattgcttcacttagagttgtttattgcttaaaaaacagttcaggatgtttttgcaattttccctcccccatgcccaccccaatactttacttatccccatatagaggatatatagctgagcacattaattcctcacttaacatcaaggataggttcttagaaactgtgaccttaagggaaattatgtataaagaaaccaattttaccataggtgagttgatatcaacaggagttaagttcatgtggcatacttctggtcacgaaaacatatctaacttctacataaaggcccaaaatacttctagcattaaacattgaaataaatgtgagctgtacatacacttaagaaagatttatgggccgggcacggtggcttacgcctgtaatcccagcgctttgggaggccgaggtgggcggatcatgaggtcaggagatcgagacgatcctggctaatacggtgaaaccctgtctctactaaaactacaaaaaattaaccaggcggaatggcacgtgcctgtagtcccagctactcgggaggctgaggcaggagaatggcgtgaacccgggaggcggagcttgtggtgagccgagatcacgccactgcactccagcctgggcgatagagtgagactccgtctcaaaaaaaaaaaaaaaaaaaaaaaaaaagaaagatttatgaaaacatgtaagataattacttacccgatttttggtgaattaatgaatgaacagcagtcatggtggtggtgggttaaatcaaggaataaatgtttgcaaagtgaaaaatcataaggagcacctccttcctgcacgaggttcaaaaccaatcacaaatctggtaggcttgttgaatgctttcataccacatcatttattgtcatgcatttgtattatcgtctactttatgaattgttatttgacaatcatttgtattcatttattttccaactcgcatatttccagtttaggatcttgtatgaccagtgcctgggtacttcaggacgccaggtgggagccaactctggacagggcaccatcctgtcacaggacaaactcacacgcccccacactcactcagactgcgcctgtgtggacatgccagggaacttaacatgtacatctctgggatgagggaggaaaccagaatatgtggcaaaaacccatgcagacatggcgagaacatgcagactccacatagacggtggccgggactgggaatcagtttttttctttttatcctcatccatgttataatgcaacaatgttgaatgaaatgatgttattcaaagatctgctgtattgtgtttataagctacttggattaatctgagcatccttcctttccccattcagagtggatttggtattcatttaaaataaatttggattcaggctaggcatggtggctcacacctgtaatcccaccactttgggaggctgagatgggcggatcatttgaaatcaggagtttgagaccagcctggccaacatggtgaaaccccatctctgctaaaaatacaaaaatgaggccaggtgtgctggctcacacctgtaatcccagaactttgggaggccaaggcaggcagatcatttgaggtcaggagttcgagaccaacctgaccaacatggtggagccctgaaaatacaaaaaaattagccaggcatggtgatgtgtacctatagtcccagctattcggggaggctgaggctggagaatcccgttagactgggaggcagaggttgcagtgagccaagatcacgccaccgcactccagcctaggcgatggagtgagactctgtctcaaaaataaataaataaataaaaatacaaaaatgagccgggcatggtggcgtacacctgtaatcctagctactcgggaggctgaggcaggagaattgcttgaacttgggaggcagaagttgtagtgagctgagatcatgccactgcactccagcctgggcaacagagtgagactctgtctcaaaaaaaagaagaagaagaagaagaagaaatttggattcttttttaaaatttccagtttaggcttcttctttctcattctcattgatttaattttcattttaaaaatgcatggaatattagcaaactgaagtatccttcctcccttccacttaattcctgtcatctcttatagataaccaacttgattgtgtactgaagaagtctccttcctgtgtttctttctgtaaaaataagcagatttgtgtatgttttcttcttttcctttcttacatacagggtagcatatgtgttccttccacttagcaatgtctccggaaattactccatatcatttctcagatcttcttcattccttttcacagctgtgctgtgtgtatgtaccatagttgattccatcggtctgttatgcctgggcatttaggtagtttccagtattttgcaattacaaagaatactacagtaaatatccttgtgcatgtgcagttgcatacttccagaggtgtgtcttgcggagaaagacctacaagtgggctgctaggttgtagagtataacggtgatttaaactttccttttaagctgtatttaagtgaaaaaaaagtaatagttcaaataaaatgaaaaatagtacaggtaacacagagacgtgacagaaatcataaaagcaagcaaattaaactattgcttcagtcccttcaaactccaaatagtatcataactgaggttcagtcagagccccctggaaatccagcctcagtgcctcagtcccggccttggggaccataggtggaactctgtatccacatagcctactgagctgctttccttggtggcagcagtgtggcgcccgcaccttgggagggaggctggccagtgacaacagggacaattggagttggggcccggagtggcacagaaccgtgccaacttcaggtgtagcactatgaggaggttccctgtgaccctgatcatcaggggaggtcaagtcctctttgatgtcctcttctaaagatgatactcactttagagcagtgagaatctggggagccctttcccccaaaaacctgctaccaactggtcccatgcccacatagcactttgcatagagcttcagggaattggcagacctataagggttgtttcagtacctataagggttgtttggataaaactatcaaaaagaagagcaagaaacctttccttgacatttgaagatctgatccgcattcatctagaaaattaagtggagccactcactctacagctgtgctagctggatgaggactgtgaggtgcagctgtgcgcacaggtgtcacagccagggtgtggaaatcccattttgtgtggagaggcccatgtgggtctggttctgcgtcaagatgtgacacgggggttgggggtgaggaagggggagcggtcctggctttgctgctgcatttccagctgtgttaagaatcactgcacttgtgggtttctgtgcactcatactcaatatccagggttggaccagacggtggttttcaagcagttttgtgtgaagccgtagaattccagaaaggggcctcatggagtgcacgagggagcccacggcagtcagaggcatttgatgcccaccaccctttcctggagcagctctgcgctcatctgctgactgtggtgggatgccctggaaaattgtcctgcaaattagtattcagctgcttaaaaaaaaagttggatgagcttggtgctgaattgtcttcaccctcttctctgctccggaattctgctggtgtccaacgagattaagccagaaaggggacaactacgtcacaaagcttggcctccaggccagggtgctggggcttggccctgtaaccttaggaagtacttggagctgagttcccactgtgtcaaccaagcagggcagagctgagcctggggaaggagaacttgcagctgtaggggaggtgggcctatgccacgtcctctgcctcatggggcagaggccagaggctgggagacgaggaggaggctagcctcacaggcttgcttgggagtcttcagatgtctgatggcaagccttgttagtaaacacaagcaaacctatacatatgacatttaagcatacatctcccaaatatgtgtaaaaatttatgtattataaattatatataatatgatcatgctagtattatggacagtataaaacaaaatagattttaaaagatgagaagcgttaaaagacctactgcctagggaatcatcttgcatgcccactgaggtccatacccactttggagatggccaaggtagttggaggacactaggtgcctgaaggaggctggtgaaggtgaaaatggcagaagggaaagagaattatgtttccccgacagcagtctgcaccacgttcgaactcttttttttctttttttttcttttttttttttgaaacagagtctcactctgtcacccaggctggagtgcagtggcccaatcttggctcactgcaacccccaccccctgggttcaagcgattctcatgcctcagcctccccagtagttgggattacaggcgcccgccaccacacccagctaatgtttgtgataggtttcaccatgttggccaggctgatctcaaactcttgacctcaagggatcctcttgcctcagcctcccaaaatgctaggattacaggcatgagcctccacgcccagcccacattccagctcttggccatatctgtgtactgtttgctctgctgtttactggatagctttctttgaattgactcacttgtttttttcccaaaatttagccttattctaagcactaatatccacagaaggctttctgtgcagctagaattttcttccaatgcacaatgaaataagtacaaaactatgcaaacaaagcatttgtccacacaccacttagaaagcactgttggctcccacctgtgtgatggggcccgccctgtgggagactctgatctttgacatctgacttcagatcagatgggagggaagggggatggtgagagtgaacctcacatagggccggggcccatgtgaatatcggggcgggggggggggtgctcctccatgccaaggggtgcctgcaggtacagtcatgcctaacagtctggggagagtctcttggggcatgagatatctccccacgagaacactttgtgaccacattgatcacagactttgtcggggagtggcccaccccgcctcagatcacagctaccatgaatcattgccactcgggcccgctgccaaaacatctcgtgttgggctagaccagtcgctcatttatcacttcaagagatacttattgtgtgcctactctgtgccagacactggattagacagtggagaacaagacacataagacagctacaaaacccctgttctagtggaggaaggcagacagtaaagaagcagaacaatagagaatgtaagagccaagtcacaatgaatgctattattattaagtaaaatcaagataagggggaggaaggacaaatctcctctacagaagaatgccaaataatttatggagatacgcgaagacgtttcagaacctaatgtcccattctctaagtgtggcctgtgtttactgactttcttccacagagtatggtatggaaggaggaggaaaagtgacttcacagtggcgaaagctgatgaacattagcttggccaagtattggagattaacatcaacagttataagtcatattgatagtatgtgccctgataggatgtgatgagaagggtacttcccctctgtggtcctcctcctcaaaacctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacagaaaaaagacattgggaaaaactaatgaaatctgcccaaagtgtagagtttagtttagttaataacaatttttaaagaggtattaaaaaaaaaaaaaaaaaggcaggtgaaggccggtgtggtggctcacgcctataatcccagcactttgggaggccaaggtgggaggatcatttgagctcagaagtttgagaccagcctgggcaacatagtgagaccccatctctacaaatactaaaaaattagccgggtgtgctggcatgtacctgtgttcctagctactcgggagcccaggtggtcaaggctacagtgagccatgatcacaccactgcactctaggctgggtgtcagagcaagaccctgtctcaaaaaagaaaaaaaaaaaaaaaacaggtgaagagggcgtccaggaagatgtctccgtggaggcgacatgtgaactgagccttgaatgatgcaccccagtcacacctggctaggagagacctggtgtgagagccttccaggcagaggaaattactgtgtaaagatccttggatagaaacaagcttgggccaggcgcggtagctcacgcctgtaatcccagcactttgggaggccgagacaggcagatcatgaggtcaggagatggagaccatcctggccaacacggtgaaaccctgtctgtaataaaaatacaaaagattagctgggtgtggtggcgggtgcctgtagtcccagctactcaggaggctgaggcaggagaatggtgtgaacctgggaggcggagcttgcagtgagccgagatcatgctactgcactccagcctgggcgacagagcgagactccatctcaaaaaaaaaaaaaaaaatggagacaagcttgggatgttcaagagatagtgagaagcccagcacagctggagcagcatgagccagccaggcagggatggccaggaggtaaggtcagaggtggactggggccaggccgtgtgtttggatttcatcttgagagtgatgagtaggcactgggagttttgaacagaggagtgacatgagctaatttcattaaaatcacttgggtttgtgtggagaatacattagggtggcagaagaggtggcagacgtccctgcatgagccggggggagggagaccatggcagaggcggtgtctgagcccaaggtatgtgttcacatccctctggaaacagaagtgcaggttcacattttgtcatctcttttaaccccctgtatgtctcccgaaggtggggaaaaagatgtgaactctgagttccaaaggctgactgtttgaaagtccacgcccgcacagccaagaactctgatggggacaccataaagcccaaccctcatccatctttaattcaagatgttttctttggtggttcataactttttctgaaaaataaaaatgcacaccatgcttaagctgattgctacaggttacccttgtttaatggggagaaaaaatgaggttcctaatctctctctgccttctggaagttgtaagtaaaaaaggaaaacaaaaggcttcagtcacatcagagctttctattaaaaatgtaagcagctttaggccagacatggtggctgacgcctgtaatcccaacactttgggaggccgaggtgggtggatcacctgaggtcaggaattcgagaccagcctggccaacatggcgaaactctgtctctacgaaaaatacaaaaattagctgggtgtggtggcaagcgcctgtaatcccagctactcaggaggctgagacaggacaatcacttgaaccctggaggcggaggtagcagtgagctgagattgcgccactgccctccagcctgggtgacaagagcgagactctgtctcaaaaaaaaaaaaaaaaaaaatgtaaggagctttagaatgttgtcagtgaggttgattatgtttatcaaccacatgtcatatcttctcagctgcctgaaatcctttgggaaggaaatgtggtatcaataaagtaaaaaagacgattttaaactctcgaaatagaataaatgattgcaatttgtgttttgttgtcaaagacaggaacacgtttcttggtgttgctgtgatgaatggaaagagaggctctggcctctgtcttatttccaccccagtgtgtctctggtgttcaggtcgctgctgtcggacatgtgcttgatgtgtttggagtcatttatgcatatttattctccaacatgagcatgtgtataaatctagggctgaaaagctgtctggactcatcccagtctccattttggcttccagagatcgagatggtgatcatggagcgtagcaagctctcagagctggccgccagcacctccgtgcaggagcagaacaccacggacgaggagaaaagcgccgccgccacctgctctgagagcacgcaatggagcaggtagctgcccgagaggtcgatgctgagtgctctctcagggaagaggagagggctcagtggggaggttgagccctagggccagagcctcttctgtccctcagcccgaccatgctgcctccctttctttccctgcttctccagctctggccacccagaagcatggagacggagccatcactcaacactgtaatgctcactcctttgcaaagagattcgccaggatagcgcaactctctccctgccctgctcctggcactttggagcttggctctgtctaaaggacatgggttgcttcacattggctgctcctagaaatgctctgctgctccaaggaaggatcccctcagtagctgggcttggatctccctgcctggttcattccctgccctgcacacacaaacacataccccatctatagggcctgccctcttgacttggccacatgagttggtgctgccatccacctttgactttttgcctgattgttcatttcatcgatggccatctgtagctacatcttcttaaacctgggtgaccccacatttcctggaaccttgccatagcaccagcccctccacaatgggattggagggaaggctactcccagcgtatgctggtagctggtagcagggcttcatttcagagttatttccttacctcgcagccccactgcacagacccctgcaacagcctcctgattagcactaccttcctgttcataaatgcaccacaccaggatttctctgtcagcctgcgaggcattcacttcctcagcccctagggaggggtggtggaaatacacacggccccccatcctctttagtaatccaacttcaagtgaagatgtgaagtccactaatttttttcctccacatcttatttgtctctttgcttggcaaatgtttcaatgacttaacagatgggattaatttttatcagatgtgcaagggagccatttttagtttttgctaaataaaaaaacagtggagtacaaagaccttttagattttgcttcacagcaaaaaatgtaactcccaaagctctgaaaaataagtaattctaaacacagacggttggggacaaccttggcacagcattctttagactataaataattagaagagccccaaataaccagtagtgggatgttgcttaagcaaaggaagaggtatctgcttaatggaggattaggccaggcatggttgttcacacctgaaatcctagcgctttgggaggccaaggggggaggatcacttgaacccaggagtttgtgactggcctagtcacatagtgagaccccatctttacgaaaatattaaaaaattagccgggcatggtggcaggtgcctgtagtcccggctacttgagaggctgaggtgggagattgcttgagccagagaggtcaaggctgcaatgcactatgattgcaccactgcactccagcctgggcaacagaatgagactctcgctcagaatatctgctgctgcttttaggtgaatactgtcatgatgtgttcagttccttagggtttgataaatggaaacagagaacatacttttcgtagtatggtaatactgtggctttgctaatggaagagaaacacccatgtatttctcccgccaccaaaaaaagggttaaaaaaacagaccaaaatgttatgtttgaatattggggttgatgacttctttttttctgaattttggtggagagaagggttttcttagagttgattgagattgtttcttaactttgggcatcttgaagcacatggcttctaatggaagctgattcagttgccttgagttaggccgcatgcagtcctgggaacctccaggccagatttctgctagactgtgagactgaatgccgggttagagactggcccaggtggagagcagctttctcctttgtcaaggtatcgagttgcagcttgtaagaaactgccactgccctctgtccccccaacttgagcagttgggactacaggccagagtcaccatgtctggctaccttttttttttttttttttttttttgcaaagacaggatcctactatgttgctcaggctagtctggaactcctggcctcaagtgatcctccaatcctcctgcctcagccttcctgaggcagggagtgggaaggaaggtggctgtttgttctctaggctgtgaattggatcttggcgttggtccacttgccccaagaaacagcaaggtaaaaaacagactgtttttatattccccatatattatgggctctgtctgcactgggggttaaatataggcctaagaggccgggtgcagtggctcatgcctgtaatcgcagcactttgggaggccaaggtgggcagatcatgaggtcaggagatcgagaccatcctggctaacacggtgaaaccccgtctctactaaaaatacaaaaaattagctgggcgtggtggcgagcgcttgtggtcccagctactcaggaggctgaggcaggagaatggcgtgaacccgggaggcagagcttgcagtgagccgagatcacaccactgcactccagcctgggcaacagagcgagattccatctcaaaaatatatatatatatatatatatgtatatataggcctaagaaacttaaagctttcgaaacatcgtttcttttcttaaaaaaaaaagtttaaaattatgaaagtatgcaaaatcttaaaaagcataaagggggaaaaagtcttcactgctaacattcagaatcagggggactaccattttggttattttttttaccagtttttttttttttttttccgatgtgaactttctgggaatttcaccctcccttctcccagaagcttggaccgtattgtgtctataattttgtattctttttttccatctaatatcaactcccaagcaaacttttcaccttattctaccctgcgtaaacaaaacgcttaatggttttatgatacttcatctcataaaagatggtacccacccagctattggcatttggttattcatattattcccaaatgaaaatataatccaaatttcaagcagctgatttacaagaaaatgttatcctactcctaagtctggaagtgttattgctggaggctttcaaaacccaaatctacacatggcaaaactattaacacatctgaaaggtggtgccccatctggggctgtggagaaatggggatggaacataaatgtcccctttaagattttcattttttttttttagtttttgtgtgtcacgtgtgtgtttgaaatgttatgacaagtacatttttcctactttttttttttgcatttttcaatgaaatattttgtatcagagatacatgtatagagtcaaaaattcaaaactgtgtcaaaggttatatagtgaacactccctgtttctccccagtcccctttcactccccgtaggcatccaatgttcattggagcttgggtgtccttccagaaattaaatgtgcccttggtcactcatgaaggtgctctgttctcttggcctcagcctggcattcagagggggcagccacagacagtgggaggatcagagcctctggcctgtgggccagacctgtgcatattctattctcctggtgttgaagagtatttttctgtgaggcccttcacctggaaaggcagcatttgggatgtgccatttccgatttttgcagcctctctacagatctcacccacaaagcatcagaggtgagagacctcactatcgattcttcgcagtcagagaaagtcagcctgagaaattgctgggtcaggaccctgccaaagtgaaatcatgaagtagtgcccttggtatattaaaaatagaaatcaaatagcagctcccatgcattggcaccgtccacagtgcctgaccctgtgctaaatgcttttcagtcttcattgcgcttgaatcctcacaataatcctgcaaggttggactccaccccatacagatggggaaataggttttatgtgacttgcccaagggtttgctgaataaaaagctaagaagaggcagaatcagaatttgaacccagacagtctggcactagggctcatgttcttgaacttgtttggattgttgtttgtgccttgtgtgacatcacactgtcctgttttcttcattggcttgtgacacacatcactttgcattgatgtctgtttgttctgtgtctaccagctgacacgggagctttggtgtggggagtttgtataattgattccctgtgtctggaatacctggtgaatgattgttgtgtgactaagcaagcagtctgttccttggtcaggttcccctctggatagcggcttccgcaggcagagcctgtctctcatttgtctgtgtcctcagtgcgtggtgctggaccaggcacacagttgtggcctaaagagctgtgtcaaaggcagctagcaccccatgtgcaggttagagaggggaggtgttcacccttgtgcaccgtgaggctcatacatgcccctcctcttttccagacccttcctggatatggtgtaccacgcgctggacagcccggatgatgattaccatgccctgttcgtgctctgcctcctctatgccatgtctcataataaaggtaagcacccttgccttgcctgacttccttgctgggccctgcatacccatagcatccttcccctctgctgcatggaggacaaagaaaggtgctttctgtacagaatttcctttctggttttggtggtcctttttggttttgactcccgctcctctttagcttctttagaatttctcaggtgtttttctaccaactgaagccacaggaattggttactcaggcaatatggaggaaggtgacttgagtgcctaacccaggatgactatattcaccctgtggttttcttttgaccccttgatttacaactgacttagcgtctgacctctttcctaacatcagaactgaaatcagtcaaattgtaatcttggttttgctatttataacacttggtgttcttattctgtgttcagagctgaaatagaccctgggtggacttggtggaagcataggtttcctttctgaagaaaggtgtggttctctggcttcccctattaaggctacttggccaggatccaactcccatggggttgacaggttttgttgggattcattcattcaccgccttgctgccgacccctgggaatagttactgttgtttgccccacctggcttgacatgggcacgttctgaaacctccacatcagaatctcttcaaagaagaattcaggaatattccttctaacccctgccaagagctaggcttggcatagtaaaaaaaatcaagtgatattttagtaggttttttataagcttattggggagtagatagagttgggttttactaagacagcctatggctagaggcattagaacatacatgatataactaagtttatgtgttcttaaatcattaatcatgataaataagttgattagtggcagaagggtatatagggaaaaagtttcccacctttgaccccagctctcctcttcaaaggcagttcctgctaccggtttctcttgtgtctttttaaagatagccaaacaaacccaagtaggagtatatatggttttatttgtatgactgcccacttagctgtaaatggagatacccatattgtgctttctaccttgctctgctcacatcatcatatttcagcacatgggttcacatccatagagaactgccattcttttttatcaatgtgtgagcaaatcatagatattaaggatttttgcatctatgttcatgactgatactggtctgtagtcttcttgtaattctcttgtctggttttgctatcagggttatgctcacctaatagaatgaattgagaaatattatcttctccttgattttctggaggaatttttgtagtattatttcttccataaatattccttaaaccagtgaagccatctgaatatggagttgtctttggtggaaggtttttaaccactcaatttcttcagtaggcatagggctttttaaggttacgtatttcttcttgagtgagctttggtaacctgtgtcttttaaggaatttgtcatttcatctgaactgtcaaatttattggcataaactttatgtttttcctttattatctttttaatgtctgtaggatctgtagtgatgttccctctctgattgatggtattgataatttaggtcttcattttttttcctaatcattttggctagaggattattaattttattgctaccctctattgttctgctgtttttgattttgttgatttctgttcttatgtttgtttggggttttttttttttttttttgccttctgctgcttccaatttaatttactttttgttttataacttcttataaagaagctttaggcattgtgggaagcactttattgtccacagccaagctgcttgtgatgaaactgtaacttacaagaaaagggctgggttttaaaaatgacacaggctctaaaaaccctggaagcggtgcaacttttggcaggaatgggggttagcaggacctcaatggctcactatggctaagtgaacgctgactgggtcctccagcgtgagctagaacagacgtctctatggtcaagtaaacagcgcgcgtgctgtctttcccatgtggtggggttgcgcatgatcagtagctgcaccactagaaagatggcggaggaagagcaaagaaaaatccctttggttccagaaaatctcctgaaaaagaggaaggcttatcaggcactcaaagccacccaggcaaagcaggaacttttggcaaagaaggagcagaagaaaggaaaagggctcaggtttaagctactggaatcattcctacatgattactggcagcagaaacctgacaaggtgcatctcagacgactagaagtgaaacctcatgccgtggaattgccagataaacattccttggcctttgttgtacgcatcgaaaggattgatggcgtgagtttactggtgcagagaaccattgcaagactttgcctaaagaaaatttttagtggtgtctttgtaaaagtcaccccccagaatctacaaatgctgcgtatagtggaaacttatgtgacctggggatttccaaatctgaagtctgtccgagaactcattttgaaacgtggacaagccaaggtcaagagtaagaccatccctctgacagacaacacagtgattgaggagcacctggggaagtttggcatcatttgcttggaagacctcattcatgaaattgcattcccagggaagcatttccaggagatctcatggttcttgcgccctttccacctctcagtggcccatcatgctaccaaaaatagagtgggcttcctcaaggagatgggcacacttggctatcggggtgaacgcatcaatcagctcatccgccagctgaactagacccaggtgccaaactgcagtatatttttgatcaatgaagtggaagcatgtgttttgttgttttgggaatttttatcaagtgtcttcagagaagattatttcctgctctgtcttcaaaaactggaaaggaagggtcaaagaaaagacagtagctggctgggcgttgtggctcacgcccgtaatcccaacactttgggaggctgaggtgggcagatcacttgaggttgggagttcgagaccagcctgaccaacatggagaaatgccatctctactaaaaataaaaaattagccgggcatggtggcgcatgcctgtaatcccagctactcaggaggctgaggcaggagaatcgctcaaacgtgggaggcggaagttgcagtgagctgagatcacgccattgcactccagcctgggcaacgagcgaaactctgtctcaacaaaaagaaaagacagtagcttatgttcatgtcaagcacctctcatcagagtctagttccaaggaaaaattccagtgttttctacattgggtgctgcgtcgtctgaaatcggcacattccatggaggaaggagtcctgctttgttgcatctatcctagggtttaatgttggtaaatgagtcactctagcatttgtacaaggctccctaagactcctgcagcagtcgaccaagcccaaggacataattgaatctggagagtcctggagccttgttttgaaaaagacttgaaatacacataggaagaaaggcataaaaataaaggttcacttgtctctgctgtggaaaaaaaaaaaaaaagaagctctaattattgattttaatcatcgtaggaagctttgatcattgattttttaagcaaatcagcttatttttttaaactaacgtaccataaaattaactcatttttgtatttaattctgtgaattttgggacatgtatggataggtgtgaacaccacttaatcaggagatagtacagtttcattatcagaaaaatatccctcaggctattccctttccagtcattgatttttaaacctttcttctctatgactttaatgctataaatttccctgtaagcactgctttacctgcatccagtaaattttaacatatgaggttcattcagcttaaaattttacacagtttcccttttgatttcttgtgttttgtcatgtgtataatttctagctgtgtttctcttattgatttttctcctgcttttggattccttcccccattttttgcatgcctggtcatttttgattggttgacagttactgtggtttttcacagttggatgctggattcttcctgtaaatatttttgggctgatggttcagttaattggagttggtttgatccttttttgaggcttgcttttaagctctgtgagagctggtccagacagccttcagtttagggctaacttcgccctattactgagacattacccttctgagactctactgtgtcccatggtgaggtggtctctccacactggcccccccagtgtgagctccaggaattgttccacaggcttcattctggcaggtctttccctttcttcatgtgcatgcacagaccagaacacagcaaggttctaaaggaaccctctgcacatgtctgagctctctctctgcagctctctcttcatttatcttgtccatgaattttaaccccttgatctccctgaactccagactctgccttctctgagagaaccacagtctttgggttttctatccctttgctgaggcccggatactctcactggacagcaagctggagcaatcactgggccactgcctttgtgcttctccctctcagggatctctctcttatgctgcctgttcatccagagtctgataaccattgttttgtatatattgtcttgctttctaagttgcctgaattagtaggataaattcagtccatcttggccagaagcatagcacctttaaagaaaaagttggattgaagtctaattgatatgcaataaactgaacatatttaaggtgcacaatttaatattttgacatatgtaaatacccgtgaaatcatcaccatgatcaaggcagtgtataatccagcatcccaaacatttcctcattcccctcccttgcttcccacacccctctccccaagtaacaccagtctgcttcctgtcatgctagattagttttgcactttctaaaattttgtataaacagagtcatgcaacatgtactcctcttcatgtggcttctttcaatccacttaattattttgagatccatcatgatgttgtgtgtatctgtagttcatttcttcttgctgagtaacattccattatatgaacataccacagtttattcattcatctgttaatggaaatttgggttgtttccagttttggactattacaaacaaagctgctgtgagcatttgtgtggccccatacaatgtatgcccatacagagagttgtatgagcatatacattcttttctcttggataaatacctaggaatggaatggctgaatcatatttcccatataattatgggagatatgtgtatgtttgcttttattttaagatactgccaaactgttttccaagatgcctatataattttatatcccatcaccagtgtacaagagttctagttcctttacctcctttccaacatttggtgtggccacctttttagttttcaccattctaataggtttgcagtggtatcttatgatcttaatttgcatatccctaatgacattgaacatcttttcatgtgtttcttttgccatacatgtctttgttagtgaagagtcttttcgaatccttagcccgttttttaaattgaattgagtaaaaaaaatattgtgtttcgagacttttgggtttttttgttttgtttcttttaagacggagtctcactctgttgcccaggccagaatgcaatggtgcaatcttggctcgctgcaacctccgcctcccaggttcaagcaattctcctgcctcagcctccagagtagctgggactacaggtgtgcgccaccacgcccggctgatttttgtatttttagtagtgacagggtttcgccctgttggccaggctggtctcgaactcctgacctcaagtgatacacccgcctcagcctcgagagttctttatgtattttgaatgcaagtcctttatcagaggcatttagcaatgatttcccccaagtctgtggcatgtcttttcattttcataacaacatcttgggaagaccagatgttttttaatctccatgaggttcctgtggcactttttaataccgccttttctctgtattttttctctcccattctggactgctaggccttggaaggcagaaaccatgtgctccctgcagtacccagcctaccgcctggcactcagtcagtgctcagccagagtttgctgattggttgctgctcagctatgtggcacgtccccaaggccatctcttcctggcagcttgtagctcagggcttcagcaaagaaggtgctgtctgtgtggtgtagatgccaggctccatgggacagtgggcaagctcctcatcttggtgactggtgttctccatgggcttccttcctgcagccctgacctgtacggggagcagagacgtcatggcttactgggtgtgctgccatgcaccttcatccatcttatgcgctggagagaccactcacctgtgttcccgcctgggcatcctacctctttttcttgggaatttcttcttggaagagtagaactgtatattcaaggaaattgaattccttctcccattttctgctaatgctatgcatgtattgattcattcattcttccaacaaatattttggaagcccctgttagatgccaggcactgggatcagtattggggatgcagtggtgaagcaaacaaatgctttcatggaatctggattctcttagaggagacagacagtaaactagtaaccaagtaaaataatcccatgtagcgagaagtgcaacagtgaaaataaaactaggtaatgcggtggggcaggctgagggtagagggtactacatccgcctgagcaatcaggagaggcctcttggaggcttaagtgatcaggaggaatagcttgcagtttctgatgaatttcctcatgtaattagttattcagcaaatgcatgtggagcaccggccgtgtgccaggcagtgtgctcaacatggggactacaaactccaggcagaccaacccaggcccttgcccaagaaagcatcagtcattcttggacagaaaagtcctacgaggaggctgtcagcacaatagagggtcacttgcctggtggtgagcatggactctgcccgcaggagtgaggacccgtttcctgaggacacccgggctatggtagaggacagagcaagaaggggcatgagagcctgtggcatatccatcagatcactgcccgttccctagggtgagtggcagcatgtccgaggcagcgggtgccccaagaggcaggcatctggagccagtctgcagggggtggcacaggcagcgactgaactgtgttcctatgagccgtgtggggctgctggggggcagttggtcagttagtgagctgacccactctgcacctctcagaatgggtttgcagtaattcagccagcgggtgggagggatgagaggtgaaactgagaggctttcttatcattcagcagatacttgctgagcgcttgccagggcaaggccccgtcataggcactcaaacaagcccagatgagtctcactgaagtgaacaagaagattaattgtgactgtgacaaatggtagaaggaaatgaacagggtggagtgatgaggaagcctagtggttgtgctgcaggggttactaggtgctagtcagggtggtcggggagggctcctctgaggaaggaccagcagagccacagcccagagagtgagaaggagccagctctgcaaagacctggggcaagagtcctccaggtgaagggagcagcatgtacagaggccccggggtgggaaggagcagaaagtgggccaaggtgaggctggccaggcgggcaggggccaggtcatgaagggccttgaaggccctgaagaggaattgccattttttctccaagtgcaatgggaaacccctaccgaatttttaagtaggacagtgatgtggtcagatggaagtttttaaaagaaacgttggctaccagacagaaagtagatgactgggggtggggatgagttgcaggagggaacaccgagagacttgctaagaagctgttgcagtcatccaggcgagataatgtggattggattaggctgctggctggggagtagaggaaactggaaggacttgtgattatttcagcgctagagccaggacgtgctgatggattgaatgtaggggtcgagtgaaagggacgagtcagatgactcctgtgatttggcttgagcaatggtgggggtgcatttactaggatgaggagacaaggagagtcactaggctaggggtgaggggttctggttgatttgaaaggagggggcatgaagggaggagcctgggtaaggctcaggttcctgactcctttccctgtgtgaccaatagtgccatttccagaactaacaagcatgggccttggagtaggtttggagaagaaacggaaaagttcaagtccggtgccctgaggcccaggtgcctggggaagctgcctcgtgggggagctgccacctggtttatgctcagtcctggcctgtgagcacagagtctgcatttggtggggctttgctggtggaggttggttgagtgattggtttttggttatgcagcagctgatcaggctgcacttgaccttcagcctcacttttccagatccttaccccccaaatcaggtcccaagtgacctggtctctttctcatagattttttcctcatagtcaattttaacataaaagccacgttcataaaaaccaaatgtgagctcaggccttccagtaatcataatagattagatgctgcaccgaaatgaatatcccacagtggaaagggttgaccggttggcggaaggcgcttgttgtgattcagttgggccacataatgaattctggtttgtttctgtaatagaaaatgcagccttcgctcttctatcaagtccgctgagtcctgggccagaggtggagggatgggggtgagttttacagcttttgtatcttgaaggttccccagttcagtgaccaaccttctactcctgccactccatttgtcattgtttacccaggaagaaggagtcttgggctctttgtgttttgtgttttgttttgctgagaagttaatggaacatggatgagcgatatggaaaaggttgaaaggtaataggctaaagggaagcttttgccatgcggagaacttgcacaacgtcagtttggatcttggctgacacataaccagaattagaagtacattggaaatcggcccaacatctggttagctttcgaaatctttggtctatagtcttccaaagctggtaatacttgtgtgactgcagccaaggagactttgtgtggtcaacagacgtttttaaaaagtttgaactgtttacctggtgttctcgtggtgtctttatccagatctgtctaattattcttatgcatctttggtctgggtcttttacctctctaccctaaatgggggctactactaagggggaagaatccagatatcagaactgagagggaagcttagtaagagttactgacactgtggggccacacccttcccttctgttttggattctttgaatgagttagttgagagttccgccctccacccctgtccacgggtggacaggggacacccgttctgagtcggtgggcagctcaggctctgacccctaaggcagggctgtgggcggggcagggaacatgtggtctgctggaagccagaatgagctagtgctcccgtgaagtgcagcagggtttctttggaatttgtctgtcacaaagcacttaagagttgaagcaaataggataatatattatccacagtgtttatttctgtcagagggaaatgactggcaaagaagctattgggtttgcagcaaaacctgcctttctgtgaccaaaaaccacggggtatgcatgcgtgtgtgaatgagtgtctgtgtgtgtatgagtgtgtgtgtgtgtttgtgtgtatgtccttgcacacaggagccgtcttacctttcacatgcatgcccctgttacagggtgacattgaccttagccactcagaaccatcagccaccaggttgtttcaggcaggaggcttaaacctaaatctaatgttcgccacaaattaaatgccatcctaagtacagtgatggtcatgcaatgattgttatagaaaacaaaaatgagaataagttgctttttcacttgcctttgatagtaccaccttaaaataaccaactgctgacagtgtcgtatttctttctagcatgttttctgtgtgggtgatggttgggcttttttgcacagctgtcatatggtggcttctattttacgtatgtttccccttcattttgagatttgtctaatcttctgcccgaaatttgatcaaaactacttaactttttaaaaaattaattcagcaaaaatgtatggactgttgtgtttgtgccaagaacaccactagatcacatgacatacatagcttgggaaggtggagggaaagagcgttaaccagcggggatcatggtacacggcagagaggagggaggtaagagccacatggctgcattcagggctgggctttccactctccacatgaccccaggcaagctcatgtcttttttgagcctcagcttcctcgtctataaaatggaaatactattagccacttcatggaatgtcatgaggatgaaatgaagcattctacgtcatatgcctggctgatggtcaccatttcttcagagcttaccatgcgaaggcaatcttgtcatcttagcagaatcctctcctccttccttccaaagacactctgtccttccccagagagactggtgattttgttgttgtttgtttgttttgactgagtattttggtaaatgataaggcctccttcaaaacactggatagttggagtcaaagagaggattttaaaggccatggtgggaaaaagagctgggagagagaatggggcccctggcccagaaggagctttggggaaagaagggagatgttcagaggggtttctgttatatagttttgccgtgtgctgtgtggaatcacctctgctctctgcctcccagggctggtggtaaaatctacctcacatggactgcatggcactagcaggtcagtttggggtaaagggccggaagcatggagaccacttggaacagtcaggggaatggaaccaccccagtcagccagggcacaaccagattatgttacggcccgctagctgcctctcctgggcccctccactgcatcaccctccaggatcctggcacgaagccttgcctgtcccttcccccatcctccacctcatcaccccctccccggctctctcccacccagacctctctgggtctgctccactccctgcagtcccaccttggtttggcaagtcctggccctccctgtccagttcaaggcaaactcctgttcatcctttaggatccaacctgagcagctcgccccctgagaggggcccccagcagctcagcatgcctcttttgggctgtctgtagcttgatttagctcttgttaggttttatccttgtgttcttttgttctaattttccttttttttttttttttttttttgagacaagagtctcgctctgtcacccaggctggactgcagtggcgcagtctcagcccactgcaacctccgcctcctgggttcaagcaattctcatttctgagcctctcaagtagctggtactacaggcatgtgcactacacccagctaatttttgtatttttagtagagacggggtttcaccacattggccaggctgatctcaaactcctgacctcaggcgatctgcccaccttggcctcccaaagtgctggtattaaaaacatgagccaccgtgcccggcctaactttccttttataacacgaatgataaggaaacacatgaagtcatgctcaaactaaaaattctcatccatgcattaagcagtgctcaaactaaaaattcccatttgtgcataataatgagagataaagttgttggcctgtgacagtgctttttctctttcgatcctgacagcagtcgtggggcgggtagttaccataattattcccacttcacaggtgaggaaactgaggttcaaagaggtaaagtatcaaaacaaagttcctcccgcaccccaccgctaggcttctcattcctgctgtacccagctgtccccctaagagagggtgagcccagggacacagaggggtggcttttgtcagcccaagaggacgggccccctgtgtgctcctggtgggctggctgtgtgggtgctgccaccctttcccatttggaccccacccaccttcgggatcacctgaaagtggtttgagctgtgtctctgacttgctctgtgaccttggggaaacaacataacaactctgggccttaacttcctcatgaaaggaaaaggctggacttggaacctggtacagagagaagtgtttctatcctctgggaccttcccttcacggagagttgagaaaagtcgagatcatcttgggacgcttttcttcctgtcaagaaaagagcttgccccagatttcctcactgtccacaaattctaaggagacggaggggcaatgataggaaagaaacaaaatggacctctctctggaaattcaaggcctggtcctagtttgcctctttccatggttctgtggccactgccccattctagaaggagcgagcagccaggccctttctgctatcctctctgaagcggagtgactgctgatgggttataaagttgggcaatgcacctgggacacagaggagcttttattccccacccccacccccacccccacccccagaaccactgactggcagttctcaaagggccagaaattaacgagtagagagatgttaggacagtgttaacatctctggaaaaaacaaatgccagaaagattcagttgacattcttcttgccattcaataagccagaatccttcagagttacacatttagcattaacatgggatacagaagccacaaattaaattttcactgcaatgaaattttttgaggaaacccacatttgtggggcgttttggggcatgagagagactactaccctactcaagtctttaggccgtccctcacccaggtcatctccttggtatgacttagcctctttctgggagctggaaggaattcagaaaagcaagatatattgttacttcttattacatcaatgtgcatgtgcaggagttacttagaatccagacaatcatctcttcaatgctatcttccactattttgtcaaggttctaaatgaagcgtcatctggtactcaagggaccgtattttaagagttccgagaagtgccacctttcccccttttgtagagtaacaggaaaagacgtggtacaagcgcaaataatccattcagttctccaagcttggatcaagcaaaatatttgtttctgtaagtgtatttttgaagagccacgtcagttgagcagataaggagtttgaagacctcttactccaggcaggaactgttctagtagccctaacaggtcttctgtcactgcaggtcctgtgtgcttctttaggagaaatgacaacagggctcaaagtcacacacttgcctgttcttctttcctttcccacttaccttccccacccccatctaatattttatctttcaaatgctgttagttttggcaggaagaattgttgaattttcactggaggaaaaatgattcccttgcctcttaatgatagatctctgctgtattggtgtcattgtattaggttggcacaaaagtaattgcggtgttccaattgcttttaatggcaaaaactgcaattacttttgtgccaacctaatatgtgcacctttctgtaagaaaggcttagcttagtgtctttctgctaatgtcaccctcaggggcaggcgtggcctctgcctcacctggctcacaacttgattcctcctacatgtgttgagggtggggctcagcttttgagtttgtcattaaaagcttgagggcacaattgttggggatgactgtatttccttcgtgtctagtctctctttctctaggcctggatttcctcaagcgtagaaggtgcgtaatacgggagtggcctcaggtggccctcagacctggcacacagtggcagtgagttgtgctatgggatggtgtcccctttttctactcccttccctgtgtctaggagaatgccaccatttggggctagcttctctccaacactattaagtacctgccaacctccctttttaacaaagatcaggtcttgggccaccatgagtaggcagtcaaaagtcattggctagcatgcaaaaacattttttgatttttaaaatattattactggcaattattgcatcaatcctgatttcctatttataagaaatagaaaatgtatgttttaatacatttatgtaagttcagtttatggagagctctgcgataagttatggcaccaacagcaaccagtcatgacagcagttgccaagaggggacaggcgcagtggctcacaacagtaatcccagcaatttgggaggcccagcacttggggaagcccaggagttcaagtccagcctgggaaacatgacaaaatcctgtctctattaaaaactaaaaaaaagaaaagaaaaaggaaaagaaatcaccaagagggaacatatgtggctgaagttgaggaaaccccactctacaggacctttcggtatgaggaggtcaggtagtcaggaggcctccacttacatccttctcctctgttccaggcatggatcctgaaaaattagagcgaatccagctccccgtgccaaatgcggccgagaagaccacctacaaccacccgctagctgaaagactcatcaggatcatgaacaacgctgcccagccaggtgcccacttggggtgttgtctgtccacagggccacgcagttgtaggaagcagaccccactgggagcctgagccctgggtgctaggcctgagccttctgagaatccgggcccatcccaacctctccctctgcctctcaacccctgcatcctgggccagccctcctgcctgctgggactgtgtcttagctctgggtctccttttgccatcccatcccctgccacttggtaaccatctttcttcttccacaccccgcccttcttttgctgagattgtcaatgttttcgcccccaccccgctatgtctgggtggcccaaggtaatattatgagaaagaactaggctgacagtggagtgaggggagaacattcgaaggtttaacgggccagtagacgtaggagacagagttttgttaccagcaacagttgtgggtaggtatggaaacaggtaggagtgagaatgcgcttggagaaaaactcacttggactgggcagctgaagagaggttacgctagtgctggggctgagtggggtggggccaggagagccgatggagccgagaccacccagtccttggtcatccctggggcttgtattatgtttgggaagacctattttttgtgatagcgctttttcttttcttttttttttttttttgagatggagtctcgcactgtcacctgggctggagtgtaatggagtgatctctgctcacggcaacctccgcctcccaggttcatgcgattctcctgcctcagccttctgagtagctgggattacaggtgcacactaccacacccagctatttttttgtatttttagttgagacagggtttcactatgttggccagactggtctcgaactcctgacctcatgatccacccacctcggcctcccaaagtgctgggattacaaggttgggccactgcgcctggcctgctgtttcattttttaggcagatccccttttctcacttattttcacctgacttacaatgcattaacaaagggactggcagggaggtgggcagaggggtgtatctgcctttagttttttcccagtgacctatcgtggtctctgatgtttccaaggccttagaggcatagcctgaaggcctcctcctctccacagtgggacctttcaccagaaataaacttgaaagacccacagaggagtttgcataagagcagttgtccttcagtcagtcagttacagatgcttctaggagagatgccagatgcgggttttggctttctgagcacctgcagtctaccactacccagctatgagacctaggacaagtcacttcacttttctaagcctcaatctttccagcactcattgcaataggtttttatagagattccttcaggacctatataaagtgttcggcactgtgcctcgttcacagtggtaagtaagtaatagcatagtaagtaagctgtgttagagctctcttggtcttgacagaaacccgactcactctggcttaaacaatacaagcagacaaagctgtgttagcttataaagactgctgaggcctagcttcaggcaaagctggatccaggggctcaaacagtatttttctacctttggcctctgccaccttctgggttgacgagataaatgccagcccctccagctagccctttctgcactgagactctagacttactctacgggagacacttagatttgaacagtctagttggaagagagatctcgaagtgatatttgtagaatactttactaagattaaaaatgctggcaagggtgaggaggtggccgatatagattataatgcttgtgcccctcagggcgtcaccacggtcctctgctcagcccggcacaaggagaatttctcttaacccagcagttccagcagattgtgaggttgagccttactggctctgactggctcccttgcctggttcttacctagtcactgggaccaagggaatatggagcaccccaactggccaggtgatgtgcccaaccctggaacggggaaggaggatcagctccacccaaatcacatgacccagagtgggactggcggctctctaaaggaagtgggggtgcagggccactttccaggcctcaacagtgtttagtcaccctctttttcctgcaccctgtcagtaaagggacttcagggaagtatttggtataggtagttttgatggagaacattgaattctaactgatggggaatggtttgggcatggggggttcccactgtgtccccactggatgttgggagccatgagcagttggtctatcatgtgacctgctagcctcaacgtggataggcagcagtcttgggtttaagggcgccccaccctgggtgtgcaaggcttaccctggtgtgctctgcagatgggaagatccggctggcgacgctggagctgagctgcctgcttctgaagcagcaagtcctgatgagtgctggctgcatcatgaaggacgtgcacctggcctgcctggaggtaacgccctctccgctcctccttcctgtgggccaagggagagggacaggaggacaggagggaagctgctggcatccagataggagccctggcccgtggtgtcatcggtcaccagctagaagcagcaggggctgctctcttgagaccccactccaacctacttattcagcagggacttcctttcagccgagactcgctgaagagtccacttaattgagttttagtagtttctgttgcaattatttgattctgtatttgtcctcaggatttctgaattttttctttggtattacaaaagtttttttgcacatacaaacacatcaacacacatacacacattgattatggtttttgtgtttaaaatatatgttaaattttcagtggcttttatggtacctcttattttctatgtttattttagaaaatttaggaagtagaaaggtaaaagtaacaactatagttgacattttgtctgtgtctgtgcacacacacacacatattatatatgtaaataatatatttaagtattataagcaaataattatatatataaagaagtatatttacatatacaatatgtaaatattatacactacgtatatttacatatgtaatatgtaaatatgtacatgtgaatatatgtaaatgaaacatctatttacatatgtaaatgaaaattcatttataagtgtgtatatatgtttgtgtatatatatacacacacacacacacatgcttacaaatgaattttttgtcttatacaaatgtagttgggccaagtgcagtggctcatgcatgtaattccaacattttggaaagctgaggtgagaggatcacttgaggccaagaagttgagactagtctggacaacatagtgagaccctatctctaaaaaaacaaaaaagattagccaggacatgcctgtaaccccagctactcagaaggctgaggctggaagattgcctgaacccaggagtttgagactgcagtgagctatgattgtaccaccgcactccagcctgggccacagattgagactgtcttggaaaagtaaaataaaaaaggagtcatgatggccatattttataacccattttcccccaattaactgtatattaacagcttctcatgccattacaatcgaattacctatcctttccccattttcattttgagctctgtctcctttcctctctctctcattaagaactattttataggccaggcatggtggctcgtgcctgtaatcccagcactttgggaggccgaggcgggcagatcacctgaggtcaggagttcgagaccagcctggccaacatggtgaagccccatctctactaaaaatacaaaaattagccaggcatggtgatgggtgcctgtaataccagctactcgggaggttgagacaggagaatcacttgaacctgggaggcggaggttgcactgagccaagatcacaccactgcactccatgcactccagcctgggtgacagaacaagactccatctcaagaaaagggaaaaaaaaaaaacaccattttatacattaaggatattagtccagatctgttttatacacactcatgttttagaattcgtagtttgcccgacttgctcacctatatgagacctgcctccttcacaccttccttctcttttaacagggtgcgagagaagaaagtgttcaccttgtacgacatttttataaggtaattggcagagcacagatggacagcagcatggtgtgtattgtagaaacagaagtgtggtgtctggttctatgcagataaacgttatatgtcttcagttattttttatgcctataattactgaataaaaatgctcaatttcatagtccctagagtagcaatatctaaacttttctgtccaagctgtcttatcagtaaaatttttgaggactcagccccagtatatgataatttgtttctcagtaatacatggatttggttatttgggaataattatatgtaaattatgaactacgtacgtataaacacatataaataaattatatatgatgcacttatgttcataagttatatatgcttacacatataaaattacttatgaattacatatgaatttatgaaccatatacatgtatattatttatattgatatgtgctaagaaaccttatacagacttctaaacctctattaacgtttattgagattttgtaaagtgccaccatgactttcagtatctgaaaaatttgcagagctttgtcttcaggttccagatggttttataaatatctaattgccgccaggcatggtggctcatgcctgtaatcccagcactttgggaggccgaggcaggtggatcacctgaggtcgggagtttaagaccagcctgaccaacatggagaaaccccgtctctactaaaaatacaaaattaggcatggtggcgcatgcgtgtaattgcagctactcgggaggctgaggcaagagaatcacttgaactcaggaggcagagattgcggcgagccaagatagcgccattgccctccatcctaggcaacaagagcgaaaactccatctcaaaaaaaaaaaaaaaaaactaattgccgtggttttgttttagcttttaaggcatatgttttagtccatttgggatgctaaaacaaaacaccataaactgggtagcttataaacaatagacatttacttctgggccgggcatggtggctcatgcctataatcaatcccagcactttgggaggctgcggcggtcagatcacaagggtcaggagaccaagaccattctggctaacatggtgaaaccctgtctttactaagaaatacaaaaaaaattagcctggcatggtggcaggcgcctgtagtcccagctcctcgggaggctgaggtgggaggatggcatgaactggggaggcaaagcttgcagtgagctgagatcgcgccactgcactccagcctgggtgataggtgagactccatctcaaaaaaagaagaaaaagaaatttacttctgtcagttttggaggctgggaagtctaagatcaaggcagatttgatatcttgtgaaggctcactttctcatagatggcaccatcttactggatgacctcattacctcccaaaggccctacctactaatcccatcaccttgggaattaggatttcaacatatgaatttgggtggtggggggtggtggggagcagaaacactcaggccttgccagcctcatgtgtctttcagggaaggctcatcactcgtcagccatggtggattaatccataggtcaagtagtcattttctagtttgctggcctccggatcaggtctctgcagatcctgcgagtgatggtttcccctcttaacgtggctgatgaagatcctcctacatggggaaggtggcaacactgccatttccttgtcccctgtactttcattattcaagccctctttaagctgctgtttctttgcaggaatcgttttaagcgactgcattattgtcagtgtttgttgagataaaatgaggttatatgatttggagatcgaccttgccaggctcagatgaccccatccagctgcagcagtggacatacccagacaagggtggcaccgtggtgggcccctacacactgaggaggaaatcccactttccccttagaacatcccaaaccgcacttggcctccaagtgaggatacaccctcactagcaaagcccacgagaaagcagaaacctcagggttgcattagtcatctttgaacctctttccagtataactgccctaagtttatgtcctctagaaagcttttggattgcaaaaacagaaagacatataggtaggcattttcccagagggttattctttattattaacaaaaggagagctttatttaaattctggatcccttctcccaacccagatttttcttacttttatcccataacatttattataccctaagtataatttctcagcagcttttagatgttttcaggaattgtctttcctggtggtggtagttatgtcacacaagaatattcaaatttagttgtagttctgacaactgaaaaaacctaaaaaggatctattccctttcccaccccaagtgtggggtgtgtgtgtgtgtgtgtctcattcagaacttgtgagagagatgcagcagttctaagggtcattgtccagtagagattaccatgacagtgagtgctcacactgacccaaccctgaacgagtgacaggttctgtgcctcctcgcatttcatgtgcattaactcatttcatcttcacaataccctagacagacatgccattcatgcagtggaacaaggaggcgagaggtgtaaagctggatttggttatgtgtatcagaaccaagactatgcccaccgtgctgttctgaaggggccctcccaggcagtcatgaccctgaggaacaacataaccccgaaagcactcctcataaacaaatagaacaagccatgtaattgtaatgttaaacttatttaattatactcttccttccagaggtgtggagccttgtatctttaatgtggtaacttaaacaggattgtccatttctccagccgttctcgacaaaatagataatgttaaacacttgaaatattagccttttctatattttaatcctacatagtagttttttttttaattaactgctttgacagaagaattctaactccatatacttaaaaaggaaggagaaaattttgaatagtgcaatttgatatttggtctgtcatttgagcgtgtgtgtttgtgttcacgtgtgcattttacttcctggtgatttacgagaactcactaatgagaaacagatggcctctaaagccacaaactagagtttataatactctgttgtttatggaaaaaaatatgaataatctcctcttccctcccttcctttctttttagggagaagacatttttttggacatgtttgaagatgagtataggagcatgacagtaagtgaggggctgggacacacttgggctggtgtgcgcctgtgtccctgccaagctccccctgcccatcccagagggagttttttgacttagggctttgtgaccaaatagcacagattgatggggaagcagatttagaatggtgtcttgtgatccccaccactgttaaaatttcagactatattctctccctctaacatgggaggtgtccgatgaatcaggatgattctctgctatgaatagtaattttggggacagtatcattttattgaggacttactctgtgctggatgtatatagcatgctgtacagattatatctcttcatcctcacaccaaccaacggtaatagctactgccattgtccctttcttgctgaattagtctcttctcatactgctacgcagaaatacccaagactgggtaatttataaagaaaagaggtttaattgactcacagttccacattgccggagaggcctcaggaaacttacgatcatggtggaaggcacctcttcacagggtgacaggagagagaattagtgcaaggagaaaagatgccagatgcttagaaaaccatcagatttcatgagaacttactcactatcatgagaacagtataagggaaactgctcccatgattcagttaccggcacatggttctgcccttgacacgtggggattctcatgtgtctcaccattcaaggtgcgatttgggtgaggacacagagccaaaccatatcacttgctaatgaggaaactgagtcagagaggtctagtgatgtacccaagtctgcccggccggtgagtggcagagccacgcttctagaggaggacagcccagccccgcatcccccgtgcttctccatgtattatgtccctgcctccctgtttgctgctccactggaatgtttcagcatgcagctctccctccagtctgtagtgccagcacatgggcttccttcctcctcccgcaggcagaatcgcgggaagccataggttcagaagatcccagctttctctgctttgcgcgtttgtctctgttatcccagcacctgcccttggctaggtactccataagtacgtgataagtgatccttcttgtggatattacccaccaaagcatgtgtgatttgggaagtttataataaacctaagtgttttaagtgtcaaaaagaaaaaggcagcgtgcactaattggctccttggcttcgcagcccattccctaggaatcgggacagctgggccctcaccacgtcctttgtcactgcatgtctgaggctgccgtggagccttttcaggggaaaggtgtaaattggcataagtcatctccagaaacaccccagcagcaccctgtgccaggcccccgtgggctgctcatctacagcccctcatcattcctccagccccttcgagagaggctcagtcttccacccttcagaccattcattagagtggaagggattcagttgtcatttgttatttcctcttacccccgagacatccccctgcaatgtcatttcctacagtttggtttcctgtttggaaatgtcaggcttctatggcacttgaccatgtgggaaagcttgagctcttaaacccctgctcagtgtctgcttttgacaatgcaaccttgagtgcattgctgaaattctgagccttgatttttttctttttttttttcgaacagagttttgctctgtcgcccaggctggagtgcaagtagtgcgttctcggctcactgcaacctctgcctcttgggttcaagcaattctcctgcctcagcctcccgagtagctgggattacaggcgcccactactacgcccagctaatttttgtatttttagtagagacggggtttcaccatgctggccaggctggtctcaaacccctgacctcgtgatccgcccgccttggcctcccaaagtggtggaattacaggcgtgagccaccgcacctggcaatttttttttttaaatccgtaaggtgggggatccctacctcatagccacccaggctgtatatgaaatagccaacaagaggcctcatgggtccatacacaacaacaaatactcatgggtctatacacaacaaatacttcctccccctcccaccatggggagcttcccaggtttttttgtttgtttgtttgtttgtttgttttaatcaaacatgtattgtgtgtcctatacaatgcctggcattccagagaaatacaaaggtgccacgcccttgctctgtatctgaaaatcagtcctcagccttcaggaatgcagcttctgagtggaagggggtggggacaggccctccaaggccagctgctgtaccaaagtcagaccatgacttgtgacctttccttcatttcccttattgcctctggtttaatgcaaaaggttcagtgaggtgatggcctagctctgcccccagcaggcctgaggggttcactgggaaggttgtagggggcagcaggagtagaggggaagggagctgcaagtgaatgagtgaggcaggaactgccacccctgcggggttagaggatttggagtgggggacctcaggcttctggaggaaagtacttaaagtgtccaaaagaagaaggcaagcagcatgcaccaagtggctccttggccctctggcccattcaccgggtgtctcagtatgttttctgcagctataacagaataccacagacttaatttataaaaaaaagaaatttcttacagttctagaggctgggaagtccaatatcaggtgccagcatttggcgacggccttcttgccacatcatcccatggtagaatgcgaaagggcaagacagagcaagagggaacagaactcactcttataacaaagtcactctcaccatcattgagccacacctgcaataacaacattactccattcatgagacccaatcccgtcttgttaggccctacctctcagcactgtcacactggggattaagtttccaacacatgaactatgggggacacgttcaaaccatagcaccaggtatctgggccactgagccctcgctacatccctgccctatgtagtcagctttacctagcaggagggggaaagtggtatgtttgaagcccactttctgaaaagagaagacacaaggaaagcttgtgatgtttgaaagagtaaaatgaattctgcagaaagcttacccttcgtctgtgaagccagggaaatgaaatgttagtgttcaacaacacgtgtgcattgattactactactgatgcagcagagatctgggagaggtggcagggaggggatgtcaccctgtgtcttagtcctcaaagaaggcttcgcagaggtggtgtggaaagaggccgtcagctctggcccagtggccgtgggcatgcgcctttcctcctctgagctcagtgtcccttttatgatgggcccaccagcacctgccgtccagcaggaggtgatcccagcacgtgcctggcacttagtagatgctccaataatgattgtgttatattatcccaggtaagatgtgaaggggacaaggaaggaaggggaaacattggtcctagggtgggaatcacagaggccctggagcaagacaggcctgggctcatgtcttggctctgccacccaccagctgagcgaccttggatccatttttctgcttctctgagactgtgttccctcatcagcaaagtgggaagcagctcctcaaaagcccttaggtcacagcttgcagcggaatcagctctcgttaaacggaagctgccatcgccatagctgttatcatcactggaaggacagagaggaggaagcaggtggcagacgggcttgcacccacagggataaagcatacctggcctcctgctgagaatccctgtccctgctgaggtggagagagaatgcgaagaggagcaagcttttcacagcaaggatgcaacttctcaagagtctgagctgctgcttcaattaaaggaaaaatctgcaatttagaaaaccaaaaggcatattgctcccttatctggctgcctctgtgctttacttcaatctaaatccaggatttagatcactcatttacatttactaaatgcggttgaaggcgaggggcctgtgcaacctcccccggccccttcctccttccaagtaaggaatctgctttgaggtttcctgtaatgtctcttctagatgaagcccatgaacgtggaatatctcatgatggacgcctccatcctgctgcccccaacaggcacgccactgacgggcattgacttcgtgaagcggctgccgtgtggcgatgtggagaagacccggcgggtgagtgagcacaggacctgtcatctcctgggccactgttctccagaaccactcccagaccagggaggaaagggcttctttgtcaaagtcaagagcctgccctcaacacagcttagacagtggatagagagtacccatttgcccccaggcatgactttccaaggcatgtttttaccctttgggaagtagggtttggcattccgttgcatctggcacccagtgttggctgcagagaggtagccttcaccagtgcagacagacaagccctgagctcaggagtgtaaggcaatggggccagttttctgtgaaccatcgggggtgagcacggtacatccagtgcaggtgaggttggtgtgaaatcgtagcccagcggtctcaggacccccagagatagtgcgatgttaaggcatctacctgctcttgggacacagtcaaattaaatgtgaatctcaccagcctgcaggacagatatgtgtgaaaagattagttctcagaaccagctgcagtgtgtgcttccgttatcagccctttttttccgaagcaggtactctaggaagcagtgtcctcaggggtgttcatggtattttatctcccgggtaagatcagagtttctttcttagaaagcaccatcaccttttcctagaaaatcattcactggagacatgagtatttgtgtatagttcagaggaattcattgcacacagctccccttgtcagcctttatcatctgagttaattcgtgtgtgacagaggtgtttcacttttggattttgcaaaacaggaatgacctgtcatttgcacctcagacacgaggagtctgaaccttcctccctgcagctggtggttctacctcggaagcctgggggtgcagaggaagtgggacccatgtgtcttgagtcaatccacatttccaactgtctgaccaaacccacaagcctcaccgcaggacccaccctgtccggcccactgacgccttccttccatgtcctccctgccaggcacacgattctgtttgtgggtggcagtgtttgcactggacgtcctggcatcagctttcactggaggactggttctgacagatgtgtatgtgttgcttcatgatgctgacgtgctcacccccagccagggctacagcatcctgtgccaagaaggccccacctgggagatccccccgcacccctgagccagaaggtccagaggactgaacgctgagcactgctgctctggattccactttgcctttttgttgttgttgttgttgttgttgttttggaggctgcagtgagctgtgatccatcctggagtgcagtgttgcgatcatagctcactgcagcctcaaactcctgggctccagccatcctcccacctcagcgtcggtagctggaactacaggcacaagctaccacacctagctaatttttagatgttttatagagatgaagtcttgctaagttacccaagttagccttgaactcctggcctcaagccatcctcctgccttggcctcccaaagtgctgaaattacagacatgtaccaccacacccagcccacactctaccttcttttggttcacagttcatcagggtttttcttaccacttctatgaacacatagcctctgttatgaagtagatcaattcaaatcagttctttatgtgaatttcctcattaaattctataaccatcctaggagattggcactattattatccccattttacagaggaagaattttttttttttttagacagggtcctgctctgtcacccaggttggagtgcagtggtgccatcttggctcactgcaacacactctgccccctggggtcaagcaatcctcccacctcagcctcctgggtagctgggattacaggtgtgtgccaccacactcggctaatttttgtattttttgtagaaatggggttttgccatgttacccaggctggtcttgaactcctggacccaagcgatccgcccacctcggcctctcaaagtgctaggattacagatgtgaaccaccacgccctgtccacaggggaagaaattgatgcatggagaggtctggtgatttgctcaaggtcacccagctagtgagtagctgagccacaagtcagcccaggcaatgtggcccccagaacctagactcttaggcattctgatccactgcttcccacactgccttcttgagatctgctggctctgctcaggacactgggacagcaaaaacacagccccagtcctgaagaaatcagagccttagaggtcaaagtgggaagagacagtggcaggtcatgtggctcaggccattattcaagcagcattaggtcaggtcactaatcccacctggagcaggaagtgggacaggcatcagatagggaggcataggcccagagacaggtggcacattctggcaccaacacggcagtgattgcagctggagcccacaggaggatgtgatgaggctgggggtgctggcaggagccagatcacgggagccttggagccccttgagaaccttggctgtcacctcttaacacagtttcatgacctcatgccctgctgggctggggcagatggtcctgatccacaggcgagagatgggagaaatgcaggggccagtttgtcaggcatgtggcagaagggaggttgcttcttgtctactctgagctgctgtctccatctgtcaagtaaaatgtgcctgcctttccagagttatcgtgaggactcggcagcaagccaatggcaggtctcgatgatagtctttttgcccctcacatgtcacagagttgcaggttcccagggctgtgctgcccacctcccttgtcctggataggatgcacaacccgagtggctggctgaagcacagatagagaatatctcagcttctctagagtctctttgcctgtctgacaagtttccaaaagcaactctcaagtcctcccagggtccctgggtagcagaatgatataaaagaggccaggctacctcaaagccaaggcatccactttagaaaagcttcctttgtgactttaataatttctttctgaagggtggctttggccactcatctcactacggttcctgttgcaaggtagccatctagaatcatccagaagcttagctcttcaagcccacttcagaaatcagaacacaccaatgtgctttgaatctgagctaaaggaagttacatggtttagcaagcaattgagggcttatgtggttcgtttcaagttttttgcttgtatccaaagaacattccaagctacccctttggattcaaaggttttctttctttttttttttttttttccaccaagtagactttttaaaggaggctgatcctttttagaaactccatcctttattttccttaaggacttgtcaaagaggttcaaacaattctcctggcaaatcattcctaaatattcatagattcatcaaagagctgctagattcttgctatgtgccaaatactgtgttagccttgggggtgaagaaatgagtgagcacacatccctgccttctggaccgctctttttacctagtgaggtaaagtttattaacaagtaagagaatagcaggttgggtatcaactcacagtcagagctctggaggaaagaaacagcatgccatagccaggggctgaggagcgctcctcctgcagatagagtgatcggaagagcttctctgcagagttgacatctgagctgaaacctggagcatgaggaggagccaggaaggttaaagtgataaaggaggcactttccaaacagggaacagcacacatccagtccctgagatgccaccaagtgtggcatgttcaaggagcatagttaagtgagggaggggcaggagcgcagctacaggagaggatggtggtagcgctttgcaggccgtggggaggcatctcacgataacgccgttttccctcttgctttttttttttttttttttttttttttttttgagacgagtctcagtctgtcacccatgctggagtgcagtggcatgatctcggctcactgcaacctgctcctcctaggttcaagtgattctcctgcctcagcctctacagtagcatgagccaccacgtccagctgattttttaattttttttgtatttttagtagagactgggtttccccagtctgttggccaggctgctcccaaactcctgaactcaggtgatccacctgcctcggcctcccatggtgctgggattacaggcgtgagccaccatgcccagccctctcttgcattttaaaaaccacatcacttattctttctttcaacatagttgttgaacatattctaggtgtcaggctctgagtaagatgcaagacaagaatgatgagcaaataatataaaataagaccaaaacagcaaggggtccactgagccatgccagctgagaagggaaattcatgttgaaatgaaggtcactggagctgttggggtccagtgagaacattggagcagaactttgggcttaggctggatccatcccacatgtagggggacctgagagaagcagtgaagaaggaaaacagtggtgtcagtcagaccaaccacgggtcaaatcccaactccagctgcatgagcttgagcgagccactcaccctcccggaacctcaggtccctcgtgggtcttgcctctcagctgttgcccagagtagacgagtgtggctgtgaagtgacaagcccagggcctggcagacagtaagtgctcaggaagcattgtctgaacagagatggagcagtctagtatgtaaggtgggaaagaaatagggtctttcatgatctaaatctaccaaagcttaatgccagagaaaagagagttaggaataggattttttggtgaatatcaaaatccaagtttaagccactagccatctgtatatagtcatcttggaagcggttatgaaacacccatatttgcacgaggttttatttgtccccacattgtttccctgttcctttgtaaaaccacaagcagtttttgtgtttatcactattggccttgaggaaatagaatattttgctttattttttcgatgtgtattatacattaaagaaaatacaataacatctcatgcagtttcaaaagtaaagggaacagtctttcccatgatttcatcaccctaaacaaacaatacttagacatcttttgtgctcctcctatctttgtctgtaaaaagagtgtactgtggtcttgctttcatcccttctttttctttcttttcgtcgtagcacaagaagtttttcatgttgtcacagtttaaataagtctcatttcttatggcctcataaaggttcatctggcattttcttgcaagtagacattttcgttgcttccagtattacattattttcaactaaactataatgagcagcttcatgaatacagtgtttttctttcttttgaattatttctttaggataagttcccagaagcggaatttctggttcaaagggtatgaatgtgtttttttcatgaccctctgcatattgccaaattgctttcccgatgggttgtgcccacattaaactgcttcggccctcttttaagaatgactgactttcacagctacatggcctcagtgggcttctaacttgagtgactgtcgcctaaactaggcagcttgcacatgcagcaaggaagcaggagggtgaaaaccgagcctttgttccaggccagctcgtgggctcagcacatcaccggtgccatcccgttgtacctgcacggtgggtgccccatttccagaacacaagcctgggcttgggcacgtcacgtgattaccaagccccagcttgagccacagtgtgtctgactacagagccacccaccttcccctgctcattggactgattccccggtgacattgagtttgccagaatttgcttccagactcattgaagcaaagaaactggagcaatctctttatatttgagcttggtcagctgtcatccttttcaaaatctaacctgttcttcctgggtcagtccttcctgatattctatggaagaatctgaaagaataataatttatttttcctttttaataatacttttaaatttgcgtctttatttagcaaagaaaagcgctcaataaaaccctgggtcccaagccttaaatcttttggaggtcaaggagtgtggttggaagaacacagagcttggaatctagttattcactaactgaccttgggcaggctgcctgtcattgctcagctttggtttccccatctgtaaaataggaaccatgcagagtcattaaaagcttagatgagacaaccccgtacagctggcatagtatgcggcaggccatggggaatcaagagagtgcttattgttttgggtgtggtggggtgaattttatggctcttatgctcatattttagctttcttttgtgaatttacagagttgtggggctgcccaatgtgcctaccaggcccttataacccccctacccccatgggagcccaggttttgcctcgagtggagctccccgccctgtgggaatcggcccgcctcagattcatggacatggcttctcatgtgtccttccttctcttaggagttggggcaggaaccaggaaaaacattgagagattttattatacagtcatccctcggtatccatggggaattggttctagggctcccccaaggataccaaaatccacagatgctcaagtcccttatataaacggcgtagtgtttgcatataacctatgcacatcctcctgtagactttaaatcgtctctagattacttatgatactgagtacaatgtaaatgctatgtaaatagtttgttatactgtattgattagggaataataaggaaaaaagtctgtacaagttgagtacagatgcaaccctttttttttttaatatttttgatctacagttggttgaatccacagatatggaacccatggatacagagagctgactgtatgtgtattatattctattttatatttatgatgatgattgttattatccatgtgttgtttgcaaggcaaaagcagatattggcctatattgggagccaaattctgaacttttaaagtatttattgaaaggttacagtttttcagagtggtgggctgcagaaagccacacgtttctgttttcttacccacctgctctggtcctgcatgagttatttgccttcaaaaccccaagaggaacaggcgtttgggcacagaaatgagcgtctccttgacttggacctggctgtgatgggccgtttcctttctttctcatcctcatggtcatgactccttatttgagagctcaagctgccaaatatttcaagtgaccacccacgtcttgggctttctgtacttggactgccatggatgtttaagtttcctggtgcacttggttaagtgacacacatgtcatacattcctgagttcacacccagctcagccacttagcaggtgtgtgagctgaaataactctgcccctctcagctctgtttcttcctccataaaatcttcaagttacaataaggtgcccacagttcctgccaccccgtaagtgcttaaaaaatagaagttcttttgaattttttaatggaactacacttctttttctcccaattgttagagatgtctttatgaagactgtacttttaaaaactgttgacaatcagatacgaatgctaccaccaccatcatcatcattataacttaagagctgatctttctccagtgctttctggtttacagaggactgcactaccttagcatagggccaggagataggattgctcttccagttccaacattaggaagttgctccaaggtctcccactggttagggcgcaaggcagcactgggtgtaagcaggctgaccagctcctcattgcctggggtatgaggaggcagtgtgagtgcacctctttgcagacagtaatttggcccctttctagttttgggaggcacactgctgtatagagggcacctcccctcacctaggtccagactgcagccttcagagccataaacaagaagacccaaaggcgcactgggattcgcctttgcagctccctagtggtgacagtggtttgtccccccaaccccactgtgctggctgctttccctcctgcgttatctcagaacctcctagcaggcatgcgagctatcatgcccattttacagatgaggaaaaggaagctcacagaagtcaggggacttgcccagcctagtggaactgggaatctgatgtagacctcatgtgtctgactctggagctgtccccatggggcactgcaccctcagtcaggcccagcagctgtgcctcagggagagaggcctgcaggtggccttttctgtggactgcccctctgcttccttgctctggttggtgggcaagcctgtcctggggctggaggctgctttctgcacacacggctccgactgctgggactctgctttgtttctgctctctgaaagtacctggtggccacacaattctgaccagacaccacttctatgggccaggaatccctgtgctggtggatccacctgtgcccctggtctgctggcagggaaagcctgaggggcattcagggaaccaaggtcactgcccacctgctaggtgcgaggtctctgccccgtcagcagcacaccccctgtcgtaagaccaagggagcgggagttgaagagactcacccagggtaggattttcctcaggtctcaggccctgcagcccacaggcatttcatttcaccctcttctgtctgccccacccccgtattcagtaggtagtaccttgaaatgcttttggagtgattgggttttccagagcccatgctggtttggttgggacagacagactcagggtctagcccttgctggaagcatggcctgggcaggtcacttcaccttcttaggtctcagctgcccggtctgtgaaatggggctgactgctgggcagggattattatgaaggtcacctgatacttggggacaaggtcctggcagatgacgggtgctcagttcaggtaaagtaacccaaacctgaacctgtgaataactgaaaacaggctactccccctttgatttttttttttctgtcttgttataaaagcacgtaccagaatcaaaacacccgaagaggtgggctttattgcgtttctttcttttttaatagagagtcatggtgtcatttctgggtgtggggcatctcactgaaatgactctgcaatctcactcttctctgctctctgaactgttggtccaggccatccgggtgttcttcatgctgcgttccctgtcactgcaattgcgaggggagcctgagacacagttgccgctgactcgggaggaggacctgatcaagactgatgatgtcctggatctgagtgagttggctgctctgagtcacagcagggggctgggggacatgggacatgggacaccactctgctgattcacacgccactgggagggtcagtgtgcaacctacattttgtactattattgagctgtgaccttgagccagcggtgtgcatgtcccatgcaggttttgaagaaaaggcccctgggttctctgagatcagtttgagggttctgctttcacacagctggttctctaaaaagtctctgcagagcacctggaggctcaagcaagggtgaacaaactccagggttcctgtcctccctataaacatagtggcatcggtttggttggttttatatattaagcattttctatatgattctaatgataaaagggttctgctgctaaagaaagaaacttgtaaaaagcaaaacaccagtgtttaggtaaggatgaaggctttggaggctggagaaccacgtgctcagcccataaccttgagctacttgttccgctgtgtagtgcctcattgttctcatctgcagcatgaggctcagctttagagaagacaatgggcataaagcctgaccgtgttcctggaacccctctcgtatttgtatagctttctctttcctccatttgctacagggcacaggcacactaatgagcagcatggttttctgtttcttaacggcattgtggtatattaggagtctttggttataagagacagaaaactcaccttagaccagcttaaggaaaagaaagggaaattggctgatgtcactgggaagtccaggagtaggctaccttcaggcatggctggatccgggtgctcagacactgtcatcaggaagctgccttcctccgtctcccaactctgctttcctctgttcatcctcaggagggctctcaccaggtagtggcaagatggccttcagcagccccaagatttgttgagccagctacacagccctgatggaaagagaagcttctctttccctttaattctctaaagtctggggtagacgtgttattggcctagcttggggcacatgaccatccctgaaccagccagtggtcagaggaatgtgactcactgattgtctaagctggggtcgcatgcccagccttggagctgggagggagggagggccagttccttttgaaccccatcacctgagagagggaagaggcgaccctcaaaggaaagccaccaaagaagggatggtggctgggtgggcagaaacagcacagggccactctctgtagcactgttgttgctgttttaaatcagctttattaagatataatttatatacaaaaaaactccccaagggttagtgtataattcaatgagttttgacaaaactatagagttgtgatctagaccctgctttgtattcccttgaacaaatgacaggacccccacagcctccgtttcgtctcctgtaaaacgagatggtctttcttaaaatacagaattgttttcaggattgaatgaaatagaacatgaaatatcacgtgaccaagcatagtgcctaccgtgtaactgtactcagcaaactgtagtcagtattacaggaggtcatgcgtgtgaagagcatagcatgccgcctgacacgtagaggttctcagtgaatgagtattgtgtgttacctggttgtctggtttctttttctggccttatttatgttttatctttccctttcttggaagaataaagcagctgtgacgcctctctgcctgctgcccaactcctttggcccttttgcccttgagaaatggccacaggaatttctctaagggtttaaattgatcaagttggctgcaaagaatcataaaccagtctttctctgatttgattcaaggagagaaagagcttgctttgggggggtgggggagggcagtggggagggggcacttcatcagggcagcaagaatgtttgcatccgtgaaatggaattaaattttatgctgggaattcacattccttctctcctccccctaggaatggcctgctggaataaaggttcaaagtttttcacttatcaattttaattgattagattgctagttgagatcacttaactgagcctttttgggtagttggccattaagaaagtaatggctgtttgtctttgcccagcctgattgcaaattatgtcttttgctaaggagggcgactttcagaaaatagtagggattatggaagcacgtggtactaggataagatatgcctgtattgttggtttatttggtttttttcttctttccttttttttttttttttttttttgagggagggattgtaaatgctggagcttctcctcaccttccattgtgggggaaaatcaccctagtgtgcaatctgaccaaacgccttctgtatacaaaatacaggtgaaggacaggtgaagccattcttgcttgctgcatgactggaagctgggcatgtttttgtctccctgatgaacttgagaaagctgactccgggagaaatgttagggactgctcaccatttacctgactccatgtggtctgctaggcttaaaggagtgctgtctccaaacagcaggaagaggtggcgtaaagtgtattcactgccccttgtcacacttcagtaagaaacaacagcgtaaaggatattccccagaagccaccccaagtgcttgctgaccagcagcaggtctctcggctgggtgtgacagccgagctccggctgtcataaaaggtggcttctcatggggagcattaaagatgtggtcaccactcagcaaagaggcaaactggtcatgcttaaagtgaagcctgttttgtttttcactagagaggagagtggcagagggcagaggtcaggaactggcagccacgtgtgccacatctgctggagtgatggggggctggggtgggaaggaagagagagaggaagggagggagggaagtggaaggaagttgaagggaaggagggattggaggaagaaaggggaagggagggaagggaagaggggaggaactagataaaacagtggatttctagagaaaatagcatcatgaatctccatatacccagccctcagcttcaacagtttttaccatttagctaagttttattttatctgccctttcatctgtctatttaaaatacgccacccacccacacagtgtattaaagcaaatggaagacatcatattattacatctagaaatacctctctctaacagagaaggactttgtattgttccttttaatggaattgattgccaccatttgcaaaccgagtgcctccccagccccagctgctgctttggaatggaggccagggtgcaggggcctgtagacagggcctgtgctcacccatgtgctgccgcccgggtcttgttgacatttgattttgcagccactggcatcattggagtaatcatctttgtaatcttccccagagtcttcatgcctgtgaggctcagtagccttacctttgaaatggttctagggctggatgtggtgactcacacctgtaatctcagcactttgggagtctgaagtgggaagatcacttgagctcaggagttcaagaccagcctgagcaacgtagtgagaccttgtctctactaaaatccaaaaaaatagccggttgtggtggcagatacctgtagtcccagatacttgaggggctgaggtgggaggatctcttgaacccgggaagttgaggctgcagtgaaccctgatcatgccactgcactccagcctgggggacagagtgagaccctctttcaaaaaaataaaaacaaaaccaaaacagggttctaaaagactttccaaggagctcaaatgagatcacatgtaaagctcacagcaccatgcttggcacttagtaggtgcccagtgagtgggagttggctgcttccctgctgcagctgctgaatacgcaagctgaaactcatcctgctgggctccatggggctggcattttctgcttaagcaacactctgagaacagtgtcctgagacattcaggtcattgctcggatgatggcactgttttgaggggtaagaaagatatagctctggctgctttggccagaggaagggagctgtatcccgtctaggctgtgagactcactcactccagtgtgcctcctgaacagggacaagcaggctttgaggagaaaccacagattccttgggattgacctcagagcctccttaaaggattcttgcctgtttccaaatatcatgagcaaccacaataggggagaaatctgtccattatccatacaccccaaagagacacctggcaaccaggtgtgttcagtgtccagtttccttgcagcctgttcatgtgggcacctaacattcacatagttgcagccatagcatgtgctacatgtatctaacttgtattctgatttctaaaatcaattcgtgaagcccattcaatgaagacccattcatgcattcagctatttattgagcacctgctgtatgccaggcacagtgctaggagctgagatgtgagagtgagcaaaagccagacttcacttctgttcttgaggtgtttccagttgtggagggagcaaccactaacaggtaggttaagtaaatgcatgatcacagactgattgggatggctccatagaggtgatgagcagggtccatgctggagaataaccaggaggaaaatcctcatgggctggttagggaaggcctctctgaagaggtgctgtgccaggagggaccagaagcttctacgagaaagcacagaaatgaggactgccttttaaggatggcagaggtgaggctgaggtgggagagagggtgctgtgtcccagggtcctcacagaaacttgggtggctggcacacaagtagcaagagtgggtcagtggctgggaagagccagatctcaactacagggctttctcacagggacatctgtcccaaacggacacttctagagctggcactgcctggtcagacggtcccagaaggggccttcgagctgcactgggggctagaaaggcctgcagcagggcggcgaggagcatggactcaggggccagactgtgcctggatggaagtcccagctttgctgccttctgcttgccagctgtattaccttaagggaactgagtctcccggcacttcagtttccacagctgtgaaataggacttgctgggaggagtagatgagcattatctgtgctgtgcctagaacagtgcctgacagaattgcagagaggccatttaggaggctgtggcagggaccaggggtcagtgctagtgggcaaagagggacgggacagtctgggtacagcattttgtgacagtttgcagtggcgatgccagagagctcggttaactctggggttctgagcttggggcagtccagggggcaggggctgggaggatggtgattctgtcatcagcagggctgatcctggaggaggagctggttccaagcagaaggtgctgaagttggtcgggcggccaggtgagacgtgccatgagggagctcagccaggatgtccggtgggcgggggagcagtccggaagcctcctcgctacttcatagattcagaactcttgtgtttagtagcctgcatgatattctgttgtctgagacttctgacgtaaccatggtgcaattttgggtcatttttactcttgcctggcataacctagctggctgttcctcaaaagatcctcgcgacagtgtgttagatcatgtggtgtgtaagggaagtcctgaaacctgcagagaaacgtctgtgaataagcagacctctgtacactgggtgtgagtgctctcccaggcttgaacatacttcccagggtctgggggcctggaaaatactcatcaagtacagaacagtaggtcccagcccttaggatttcatagcccagaaaagcatcaaaacaaaaataaaaaacaaagcttttggggacggatcgccaacttttgtttgtttaccgagtagtcatttttaaaaaaagcatttatgaacaatcattccataaaagaaaagacattgttaatattgagtaggtagcacatcatttcagaacgagggtagtctttccaagaaacagtagtggcaactgtatacacacatactgtgctttaatggggagtgggtttgttgttgttgtgggggttttttttttggttttttttttgtttgtttttgtttttttttttttttttttttaaaaaaagcaagtgcagaccaattactctagcaaaagccagtgactctgtctttccaagcttatggggaaggcaaactccaatcacagcagcacagatcaaactcagatgaccaccgtgtttcctgttctaagagcaggtgacggggtttaacctggctggaggtcagggaggcttctgaaggaggggcccatttgagggctgcagggggggtgtgggtgccgagaagtggcgcagaagaagcaaaggccctggggccgatggggatttggggaagatgagagacggcagtgtggccacagagtcggggagtgggagggtgaaggtggttggcaagatgaggctgggtaggaagccatgcaggccctgtgggcatatcaagtgttcagggttctatcttaaaaacagtgagaaaagtttttacctagctgatgtgatcagatttgtatctcaaaaggccctctctggcctcagtggaagagatttatgggtcagggcagcattacagcagggagccccatggggaggccaggcctacaaggcatgaactaagaggtggtgtccacaagctggcatccacaccaggctcggacagtctggtttgccccagagacttgtcttgaatgctgctctgtccactctgtggcctaggtacaggggcttttattgcacagaggtccatccagttggatccggcgtgttctccaaaccgtcgtacctttgaagctaattattaacaacaacccaactatttgggttgtattcacctcctggcaaggcaggctgctgtggaccttccctttgctctccttctggctgtttccaggccaggacttgcctgtttaaaagtcaggctgcggttatggaggaagccttggatcctagacaaatgcagaccgaatctcagccatgcttcttcctagccatgtgactttggacaaatctattcccctctctgtgctttagttccctcattgatcaaatgagaacagcgatgcccaactttgcagggttattgtaaggcagaacaataaggtggatatagaggttgcaaacagctggtcctcaggcaggtgggcccacaaatgtagcttcatggctagtaaagcatttgcaagcgaattttatgttgctaatgttttaaaatcaggatattttatcgtaaaaacctagctatcaccttgaatatgagacagtgacagtctgtccacgcagagcctgcatccccacaggcagcagtcagttgctcctcttcatgggagtgaacccttctcccagctgctagagtctctgctgaactccagacctgtgtactcagctacctgcccaacatttcttggttaccacaaacacaagatgtgagctttcccacaaaacctgtctccctgcaggcttccagacagttgatggcagttccatgctggtggcaaaaaccacaggctcatccctgactcccctctttctctcaagctcaacttccagttggtcagcagacctattcagcctctgccgcaaaatacagtcagccctatgtgtcctcaggttctgcatctgaagattcaaccaaccacagattgaaaacatttctatttttatttaatttttaaaatttatttattttttgagacagagtctcgctctttcatctaggctggagtgcagaggcacaatctcggctcgctgcaagctccacctcccagattcaagcaattctcatgtgtcagcctcccgagtagctgggattacaggtgcatgccatcacgcctggctaattttcttttttttttttttttttgtatttttagtagacatggggttacaccatgttggccatgctggtctcaaactcctggcctcaaatagtccgcctgccttggtatcccaaagtgctgggattacaggcatgagccattgtgcctggccatttatttattttgagacagggtttcactctgttgcccaggatgaagtacagtggtataatcacggctcagtgcagccccaacttcccaggctagggtgattctcccacctcagcttcccaaataactgggactacaggcatgcaccaccacacccggctgagattttgtatattttgtagagacagggtttcactatgttgcccaggctggtctcaaactcctctgctcaagcaatccacccaccttggcctcccaaagtattgggattataggcatgagtcactgtgtctggcctattattattactatttttttttttatacaaggtctcgctctgtcgtccaagctggaatacaatggtgcaatcatagctcattgccgcctccaactcccaggctcaagcaatcctactgctgcctcagcctcctgagtaactgagatcacagtttcgtgccaccatgtccagctgattttttttttaatcttttgtagagacagggtctcactatgttgcccaggctggtctcaagttcctgagcttaagcgatcctcccgcctcagcttcccaaagtgccaggattataggcatgagccaccatacccagactgaaaatatttttaaaaaacaacaacaaaaaaatacaaccatgcaaaatgagcagattttaaaaacagtacagcataacaactatttacatagccatctcattgtatgagttattataagtaatctagagatggtttaaagtgtgtggtaggatgtgcataggttatatgcaaatacgacaccattttatatgaaggacttgagcatctgtggattctggtgtcctctgaggggttctggaaccagtccccatggatatggagggacgactgtattgtcaggatgttaccttctctcccagcttctcccagcaccttgtttgaactgccaccattttttttttttttgagacggagtctcaccctattgcccaggctggagtgcagtggcgcaatctccactcactgcaagctccgcctcccgggttcacaccattctcctgcctcagcctcccgagtagctgggactacaggcgcgtgccaccacgcccagctaatttttttgtatttttagtagagacagggtttcactgtgtagccaggatggtcacgatctcctgacctcgtgatccgcccgcctcggcctcccaaagtgttgagattacaggcgtgagccactgcacccggcctttttttttttttttaagctagagatgggatctcactatgttgcccaggctggtctcaaactcctgtgctcaagcattcctcttatcttggcctcccaaggtgctgggattacattcatgagccattgcacccagctgtgccattatcttttacctgaattattgcagtagtctcttgcccagtcacttgcttctgttttgtcccctagagtttattctcagcagcatgaactgtcttccttttaaacgagaagccagatcatgttcttcatttgttcaaagtgggctcccatgccagtctgaataaaaaacagagacctttacccctgaggcttattatgtgacaccacctccctgtctctgcctccttgctcttcttcaaacacacctggcatgtacccacctcagagtctttgctctgactgtgccttcttaccaaccccaacctgcaaaccatttgttccctagcacaagtacactggagggcaccacgaggcccatgaaagctcacacacgaaaaccgtaccccaaattcttgctccatgtttgaaatcctgaccacatcgccctgtttgtttattcttcatttgcggattaatgtgaatatcataaagattctgcaggatccaacttcctagcattctgcgtgcttcgccccagcttctttgcagacaagagcttttaggcagagtggaagtccctggctattttcatcggattgcctggagattcgtttccagcaaaagtattatgaagctccccaagcaagtatgtggtttgactgtcagtctgtgaaaatgtgagctcattgatttctttctcttgtaaaaccagtactagttttgtggtcctgtcagttctggaaaattctctgtgttggcttattttgctgatgacccaggcattgtcatgtgcctctcatcctagtgaaaatgagtggcataaatgagaaagacaatgaaaaacaaatccagaatacggaacattctagaagacagccgacctgagtttttcaagaatgtaaatgttgtggaagaccaaaaaagagggggacgaaggtagaggggtactgtttctagataattgaaacaaagtgacatgacagttgtcagcctggattgatcttagattgagggggaaaagtagccttaaaggacatttttctgcaaactgaagacatttgcatatggattgtgattgagtaatataattgaggtcaatattacgtttcttttttttttttttttttaagagatgggatcttgctgtgttacccaggctggagtgcagtattgcaacctgaaactcctgggctgaagtgatcatcccaccttagcctcttgactagctgggactacagatgtgcaccaccacacctggctgattttttttttttttttttttttttttaagatgaggtttcgctgtgttgcccaggctggtcttgaacccctgggctcaagcagtcctacttcagcctcctaagtagctgggactacaggcagaacccctggcctggctaatattatctttcttgagtgtgataatgccattgtggttctgtgggagtatgttcttgttcttaggaagtatgggctgaagtgtgtaggggtaaagtgtctgatgcctataatgttggactgattcagaagataaaactgtgtgtgtgtgcgggtataatgagagagcagacaaatgcagcccactgtcaacaagtgatgaatcaaggtgaagggtacatgtttgtctgttacactgttgtttctttttgagacgggatctcgttctgtcccccaggctagagtgcagtggcacagtcttggctcactgcagcctcgaactcctggcctcaagcgatcctcccacctcagcctgtagtatctgggactactggcacgtgccaccatgcctgcctatttttttattttttgtggagatggggtctctctatgttgcccaggctggtctccaactcctggcctcaagtgatcctcctgcttcggcttcccaatgtactgggattacaggtgtgagctaccacagctggcctattctattctttaaacttttatgagaatttgaaaatcttcaaaataaaaaggaagggacgagagagagagagataatccagtccttgaaaatccaacatttaatagatggggagtataatgtttaggaactggagccccagatttagaaaagcctgggttttaactcctgctgtgtgaccttggacaaattagttaacctctctgagcctttcttcctcatctgtaaagtgggtctaatagtgcctacctcaggactgttctgttgattaaaagagaaaagtccatcagaaatactcagcatcacactaagtgtacacaagtgtttgtgatagaaacagtcattacaattcttcctcttgactgcatattgggcactgaaatatgtctgttctctttggagggttctttgtcggaatcctaacaaagcacagcctcgtgactgcttctgtccaggggacacattgaaaagcagaggaggtaacacaggcttgttaactagataataaggttcttggaaagatgactttcaggaaagtgggtgccgtctgattgaagagctgaaaccacaggatggggtgggaacttgaatcagacccagatggctccttgggggcaatttagttcaagcatccaggcatgggccctggagaagcggtttgcttagtgctgactctgaagtggactaatgttaacatgaaacccaagaggcaagtatgtacatggcattcaaagagttggattgcaaggcgagtgtggttttgtggcactttggcctgttctctgcccccacccccggggtcccgtgtttttgtctttaaaggaagcacagtcctcagtcctcatggggtcgctccacaggtagacatttaatggagcagctgctcatcacccgacctgctgacttggaatcactcccaaccctcctccaacctcacgatcgggggatcatcagctccctggactccacagctctgccccatccctggtctggcctctccacacctctcccctgcccagtatctcccccattctaccccagcccatggccttgcgccacgctgcttcatccatcctgatgcccagtatgtaaaaggcgcctaacccgccatcatgtccctgcttgtaaactctcagatcctcgcagtgcagcggcccaagctacccacgacactcctcttctcccatatgtcttgctgcatctgcccacacagtgcccaggctgctcacaggctcctggacacagcctgcctgcccttgtcgcccctgcctggatggccctcccagcctccttcctcctgctccacgtgccttgtgcacatttcagatgtgcgcttaccgctctgtatatccctagggcctggcacagggcctggcacatagtagacactcaaggcttcttggattgaactgattaaagctttagcagtcactgtaattattcataaacactgaaggactttcattaacatagaaatagcatttccaaatctcatcttgagtaatttcaggcagttggattgtgagttagaaaaatgatgtttgttcatcattaacatacatttgaatagtcaggttcccactgcagacttttgtccccctctaatgacatataccaagtatcttaaacccatcttggcattttctaaaaatgtagattgttttgatttcaacgtttgagctaccccaaattatttaacctctctaagggctaaaatgcttcctcttttcttctcttttttttcttttttctttttccttaccccactttgaggcaggcaccctgaacttgacagattgggaaaaaaatcaagtttcagttaaaccaccaattctctaaggaaatggaaaacatggaattcacaatgtttcccctctctatgaattaaacttcttccctgtgtacttgatgaataatgttgctggccacttttcagaaatgaagtagaaatatggagaaatgaaatttgtatcctataaactgactggaaatgggattgtaatagagctgtcagttttgttcaagtggaaaatttttaagtaaatccaattgcagtattatttggttcttttaaaggagagggtgatgtagctgtttcctgtgtattgattatttgattggtacctgtctgctggacctatttttttttcctcagtggcattcattgatgtggtttaatgtatattcctgtaatctttccctgttttataaacttacaatcataattgagccacattagagagacatgttctgctgagatcacaaggtcacctaatgactgtgccctcttttgttgttgatgtattgaagtggctctaggacagttcttctgaaaaacacacacacacaaattattcttttttcctttacaaagcaggatttctagattcaattctatgcattagagaaatgaggcatttgagtagtggagactgtttgagctttttttgcctattaaaattattgtttttaagccaggcacagtggatcatgcctataatcccagcactttgggaggctgaggtgggaggattgcttgagcccaggagttggagaccagcctgggcagcatagtgagaccctgtctctacaaaaatttttttaaaaattagcagtgagtaatgattgcaccactgcactccggcctgggcaatcgagcaagaccctatctcaagaaaaaatatctatattgtttctgctgaaggcactctacagttgaaatactttttcaaaataccagtccttcccacacatttggaaatgggaccatggttttgatttctcacaaaggaagggacttagtggcttagatttgctcaaaaagcagtaacttccgaggcacatcaacccttgggatgtggacagcttctgggtgcagctgcaccagagggcttccagggaggggcaggggtcctgctggcggttgagtcccagcccagcactgtgaccttggatatgtctgtgtgtgtgtgtgtgtgtgtgtgtgtgtgtgtctgtgtgtgtgtgtgtatgtgtgtgtgtgtgtgtgtgtgttttgagacatggtgtcactttgttgctttggctggagtgcgtggcataatcatagctctctgcaaccttgaaccccgggggctcaagggctcctcccaccttagcctctagagtagctgggaccacaggcatgtgctaccatgtccagctaatttttaaatgttttatagagatggagtcttgctatgttgccctggctggtctcaaactcctgggctcaagcggtcctcttgcctcagcctcccaaagtgctgggattacaggtgtgagcccctgcgcctggccttggcatgttttttgaccagggggaggatgaggtgcttgggaggatgagatgtcaggaggatgagacgctgcctatcagtgtttagcactgtgcctggcgtcttgatagagcccagttgacgagggctggcaaagaagctggtttttgggtttctcatccaaaccccactactcctctgtcaagaaatgatcactctagttattcagccaaaccttggaatatccttgtttcttctcatccctgtgaccaagctcttagcaaatcctgccagcttaagcatcacatagatagagaacccagctccgtctcactgcctttagctcccctgcagctggtggggattctagaaaactgggactagggggtcagcttcctcctctgccctttccacaccaacagccagtagaatccttttaaatagacgtcagacccttcagtggtcctggcttcccattgtggtgtcagctcactgtgccatgtgtgccccccatctgctcctcactgtgctagcccagtcatacggagctcaagagatttcccccttgggccaccggcttcagggtgccccaaaacccccactctgccccacagggctgccaaagccagcctccttgacaacatctggctgacggggaggggagggcagtaagagccgccacagaaaacaggaattcatggggggagtggggttgaggattaacgttgagtttcaagacatccctcgctccagcccactctgtgagctgtctggggctccgcctacacacagctcctcaccctgaagctgctgggttcccctgcatcacacgcccaccttccccagtgaacccagccaccagatttgacacaggatccggtgattgctcaggcctcaggaggggagggttgccttctggccctgatatctgatcaaccacagaacacccaaaacaaatctctgaaccagtgacagacagcgcgacctttaaggaaggtgtaagtcaggagaaggccatctctcctatacatcacctctcccagcccaggaagctggcctgccaattgccccagagtctggcccagccactgaccaggtccaccctgccctcagccaatgcacactctccagcccaccccagggcctgctggggagatcaggaatcgaagaatggagcagcacttcctcccaccctcttgtaggagggagatgggttctattcagattaggcagaaacgctgaaaagtattgtgaccttgaatcctaaatccccgttaaagttgaggcttaggaagcacctgaaatcacaaggactgatcattagaatctatttaaaaacaaagagcagggccgggcacagtggcttaggcctgtaatcccaggactttgggaggctgaggcgggaggatcacttgagcctaggagttcaagaccagccgaggcaacatggagagaccttttctctactaaaaaggtcgggcgtggtggctcattcctgtaatcccagcactttgggaggctgaggcgagcggattgcctgaagtcaggagttggagaccaatctgattgacatggtgaaaccctgtctctcctaaaaatacaaaaaaattagccggatgtggtggcatgcgcctgtaatcccagttacaccggagactgaggcaggggaattgcttgaaccagggaggtggaggttacagtgagccaagattgtgccactgcactccagcctgggtgacagagtgagactctgtctcaaaaaaaaaaaaaaaaaagaaagaaaagaaaaaacattagccaggcgtagtggcgtgtgcctgtagtttcagctacttgggaggttgaggcgggaggatcacttgaaacctggggagattgaggctgtagtgagctgtgatcgagccactgcacttcagcctaggggacaacgtgagaccctgtcaaaaacaaaaagagcaaaatcctgatttaagacttaagaactctggtggagggtgtgaggggtctctgtattgctggtgaccagcacaatgcgtggtgctgcaggcggcctggacagatttttcaaatgaatgtcaaatgttgttcatacttctaaacttttaagaaatgtacagaatatggctaggcgcggtggctcatgccggtaatcccagcactttgggaggctgaggcaggcggatcacttgaggctaggagttatgactagcctggccaacatggtgaaactccatctctacaaaaaaaaacgtgtgtgtgtgtgtgtgtgtgtgtgtgtgtgtgtgtgtgtgtgtgtttagagaaatgtacagaatactgagcttgggacatgtaaaagcataaattttcatttttactttgacctgcctgaaaatagaagtgaaaatgtgtttgccacaggggaaccgctctaggggcatctgatttgctcctaggccaggccaggacagagctgtgaccaagcgtgagggtgggtggtgcgaaggccctgtggtttctggcccagcaggactttgaaaacaatctgtacccagacctcactccagaaggttctgagtcactggctccggggtggggccctgacatctatattttcaaatgctccctaaaggattccattgcatagccagtgttgagaaccatgggattagacagagtgaggaatgttctggaactcagcactcagtgtctgctttgctgctttccatgaattctagttccctctaggaactctccttgcccacctgctaatcagccagaggccatcaggaaggctggctttggtagcatggtacagcagtcacatctctctaagttccaaagtcagtttctcaggtggaaaccacctgccgtcccagtcaccctcacagatccctcatgggtgaatgacatttctcaatgaggagtgggtccggcacagccagtctgaactgcagggctgcagtagaccccgtcgttgagcaggttttagaggaagaggttggccatgtcagatgaaatcctggtttctttaccagggagaatcatgctgggcactttgaggggcgctcaagggataggcaggaagagccaagcccatgagggaggcagattcccatctgcccctaaggttccctcatgggtctggcagcccgagaggcctgtggtatttaagctgtttacgcttctctccctctcctctccactttcctgcatccgtgtagttgagtttgtggaagttaagcttgcatacagtgtgcctctacctgacttgaagacaaatcacttgccctctcgagccttgggcacctgtcttgagaggaagggcctgcgtaataggttgggcctcctggatgctccccagccctgcagccctgcagccccacacacagctacatgtgtgctcagaaggtagctgaacccattctgtgcttggccttgtgtataatcacttgcatgggctaggcaggagattcccttgcagaacttgaaactccctgcagcactgaaactccagccatccctatctcttgtggttgttctgaaccagtgccagtcttggaaatggcctgttttgtttcaggcagtcataaaaatgccttaggagtagagactgtccaggccagagtcagccagccagaccatggaggctcagaagttgttggggctgagctggcctcccccagtcctcacaactttttagtcatttgctaataattaagagccaaaagttctcatcccatcttccctccagcctttggactgactgggatgccaccattttttatacaaggttcaaggtgagatagactttctttccttttccttccaaattctcatgtagaaaagccgcatgcaacttcctggtttttcaacttggcacatccacattatctttttgcatttatcttttttttactacctataccctggcctttgaattttataatacactttgcatttttctaaatgcagttggggttttccagagctgtgcaaagccaggaaatatgcatgtcatttaaatgactccggttaacctttagcctttaactggtttctcataaaactcgactctctcccagctatggtttgcattcttcagagcagcaaaactgatgaacatctacagctttcactgttccctgctgggcccccttccctttgctgcctccagtctgatgagccatgctggcagactctgggaaatgtgagtcccaagcagtgtctagcagaaggttccagactagattgatgcagcccctgttgccacttcctgaggtctcccagggcccctggcttcagcggcttcccttcctatcatggcatcttgttcctatcatagcacagtaaccataatagatcccatctgtttcccaccagaaacacaagatccagactgcagattgcacacttgactgtagacagggactctgagtgtttcctcacccactcccgtgcgcgtccatccatcatttgctgaatggtaggcactgtgctagccaccagaaacacaaggacaggacagagccctcctcccttcaggcatctagcacagtgatgcacttcagcaggtgggtgcaggtgctctgctggaaactgcaggatcaagaagaatacagagtagttgggcccttgctgggggtgggtgggtaaacagggacaagaattgcttctgggcgtccgagcctttgagccaagggttgttctgagccagtgtgaagcagcagacaacctggggaagggccttccaggcagagggggcatctgcagtgaagacacacaggtatgtttggctaccaggtcagtagcccgtgtctggaacattgggcggtccattcgtttcatatggctgctgctacacatttctacaacacccagttattctcttacagctctggaggttagaagtctgccacgggtctcactgggctaaagtctaggtgttggtccttcccgaaatctctggggagaatctgttttcttgccttttctggattctaaaggtcgcctgtgctttggcttatggcccctccctccattctcaaagccagcagtggcaggatgagtccttctcacactgcatcactctcacctcctcgtctgcctcactctttcacttttagaaccccttctgattagattgggcctgtccaggtaatccaagataagctcccccagctcaggctctttgattcagtcacacccatgaaatcccttttgtaaggtagcatgttcacaggttccagggattaggtcgtgggcatctttgggggctattacagcccaccccaggtgggatgcagaaactggcagcagatggggctggaagggtaggcagaggctctgcgggacacgctgcaattgaggaagcctggagaactaagcagatgaacaggcaggcaggagacagctacccctcaaatgctcttcagttgtatggcctgggccccacctcctgccctgtccttggcagatccctctgaccttgcagccccggtgcagggtggaggcatgcccagtgggcccctgggtctcagaaacagcaaccttttgtccttttgtctggacaaaagagccccactttgttggtacaagttaaaattcttccctcagccccctctccactctactcccatctctagggtgcccctggtctgagcccgctgatgttcccaggttgcctcctctgtcctgggcacccagccacatcctgcccttcttgcccgtcttctccattcacccatgtccttgttgctgtggcgcctccaggtagggctcctccaggtagccctggctcacgtctccccaagctctcctttcctttttgcactaaaaggctcaaaaatcctcctccatggccatctgacccttccactcccctccccacctagtcacaaggtacccactccctggattcctcaagccatagggccctatcatttcttacaggacagcagttccaagccaggagagcataggggttctctccagccaatttgagccaggaggaattttaaccaaaagcccaagttggcttttgaaagaggcctttctccaggaaaggattagagagttccagtcattaaatggtccgctgcagaacgctagttcttgactaaagtggttggtttttaaatgaaatgaaataaatgtgcctttttgttttttcaataaatgagaacaaaagtagccaggtgtggtggcatgcacctgtagtcccagctacttgggaggttgaggtgggaggatcgcttgagcttgggaggcagaggttgcagtgagccaagatggcactactgcactccagcctgggcgacagagtgagaatccgtctaaaaaaaagaagaatattgtcgactgtgatgggaaaacattctgattcaggcctcaagtatatgtatgagaattgaagttctgtgaaggttcgtgcatgtctcccttgattttgatggctcttgttaaaaaacaaacccaaaataaccttagaaactgtgtgcacacgtgagtgtgtgcatgtgtgtatgtacacctgtacacgtgggaaatcgcgacggcgtgctctgtacaagtgcagatctgctcgtggacagtttctcacccctgcagggccagggccctagggctcccaggtggctgccacttccccattgaggctgttccttgccagaagacctagggtccggtctttcaattctcttcctgctgtgaggaaagtgtttctcttgaaaacaggagccagcccaccccaaatcttgatgctgggtgacaccaaagacaggaactcttttgggttaaaatttggggctacaggtaagacttgatgaggcttctatcccagtgggtttactggtgaattgggaatgagtggtgtgtaaaggcagccggagcggctgtgcattcgttcagcagccgtttatggaggccctgctgcatcctgggccagctcagccctggcgatcaagctaagctggtgctccctctcctccacctctctcttctggaaggaaaggaacgctttcttcctttaaggcctaagactcacagctggcttgaggtagaagtcctgcctgccctgaatataaaattttaaaacttccatatttggcaaatctgtaccctagttttgtttagttgtgtgtgggcgtggggttatattcagcactggaaattgtgggagcccagctgtgcatcaacagcttctccatccagttagggagagtgggagctccccatctaagtttaaggttgcagctcttcctcccatagatctgtggtttaccctcagccccagcccctgcaacaacactgacccctggagagcccagacaaaggctctgagaagtcctgcagacacacagccagccaaggaggtttgcttagtaagagctgcccctcatcagcagctcaccatgtagggggattgaggttttgtttgttttgttgttgttgttgttgtttgtttgtttgtttgtttgttgttgtttgaggcagggtcttgctctgttgcccaggctggagtgcagtggcacaaacgtggctcactacagcatcaaactcctgggctcaagcaatcctcccacctcagcttgccaagtagctgggcctataggtggacaccaccacgcctggataatttttttgattttttgtagagacagtattttgccattttgcccaggctagtcttaaactcctgggctcaagctatccttccacctggcctcccaaagtgctaggattactggagggagccactgtgcctggccaaggcagctcatcatgtgccaggcactgaggatttaagtgtggaggccccatgtgggaggggcccaggtagcacgtgaccccagggccactcagctccagagccctcggtctcctccgaagcttcacctcctctcactccatcctagcatcacccaaccatttttctttccttcctaagcccatgtaataatatctgccagtttcctccaacactgatttgggctaaaggagcccagaataaacaggtggccctggccctaagccccagtcctctcctgaactggggcaagccctccacttccagcctcctgctgcctgtggcgctcccctgtccgctgggaggcagggaggctggcccagggggacctgacatgaagagtctgtcttacagggctcaaggggatggctgtggtctccccttgcctgtgtgtgttctacccggaatggaaaccagcttttcaccttgtccaggaggttgggaacctgagggaacacagcactgcctctgtcccagccccccattgctggttttctctccaccagcagagtccaagcccaagccgtatgggccccagcaggaccacactgagccctctctccagccccgcggcctggctctgggatgtacccataccaccccttttagtcccctgcttgctgagtgtgtccccttcagctctgggccttcatacaggcccatccctctgcttgggatgcttattcctgccaccatggtcccctgtgtttggccaactccctgacaccttcaactctgcagacagcttacttcctagcaaaatcttccctgaccaccagatctctctctgttcatggcatttcccactgtgtgtgattttctatttttatgtggttctttggttcatgtgggtaccaagctgcttgggggcagaaaccccaattcttattcaaagttggatcccagggcccacagtgtagcaggtactcagtgaagacaggccagatatgaatgaatggaaatgcgagtgggttagggtccgagcccacaaatgaggacattggccttgttttccaaaaatagaccatgactccagggccctagaggaagcctgtaaacctcctggtctgacagacatctgacacactttgcgtgggtctctttctccacagagaagttggaataagatcaagacttaattcgcaggcccagcattagtcttctgaactcgccggctatatgagtcatctccactgtggagggaggcaattttaaactggaaaggtcaatcgacatgtcagaatatctagtaaatcattcgcgttccacctggtgccccttccattcccctgaaaaagcctgcccttgttcagcgcctctcgaagacactgtggagaaagaggtagccggggctgggtggtgatttacctcgaggaaaattaatatggtgccatcaattctgaaggcagaaagggcccatggccagaaggctgcacgcaggctggaataactcacggcccatgagggccctgagtttggggaggcctctccttggccctggatataaatcagcagcccttttgcagagagagagtcggagttttgtcaggcctgggggaagggagccagcaccagaagcccctcttccccaggagcctgtcgttgtctgaagggttgaaaggcacctctgtgccacccttctcggccagcaccaagcactggactcatttacagacgaggccatgaagcccccaccctgggttccaggaggatcacgggaagggggctttcagcctggctgtcagagaagaatgtgacaggcccattttcactccacaggccttaattggatggtcagagggcacatctgtggcttataagaaacagatggcgggatgggttagtgaaggagaaagcacgcttgcttcaggttgagtgcccgtggaggtgctggggcagcacgctggcaagcaggcagactcggccaagacccagctttgtcacgtgcgtgaggccttggctgtcctcttcatctttctgcgtgtctgtttcttcagctgtaaaatggagatgatgaggcccaacaacataacataggaggatttggtgagaaaatgcatttgaaatggctgaagacagtgccgtgtgttataagtgcttggtagttgttattgtcctgtggtagccttgggtctctagagccaagaacagcctcctgtctggatctgagtggcttcatcccactgtgtgggactctggtcccaagtgttgtatgtgagtagctgggaccacaggtgtgcgccaccacacccagctcatttttgtattttttgtagagaaagggtttcatcttgttgcccaggctagtctcaaacccctgggcttaagtgaccctcccacctcagccttccagagagctgggattacaggcgtgagccactgtgcctggccgggaatcccatttcaacctgagattgggcggggacaaacatccaaaccatatcagtacctgtgggaagtgacttggaggcctctcgggtcttcagctagtcctctgggcagtagggagaatcctaagtaatagccgcttcacagggagtcagtgaggatgaagtgtgtggagcgcagagccactgtttgttgaaagtgcattgttactgttattgcctttgttttggtagttaggcttgtttccagggaactttggcttccttggcttctggggtgtgcacacaagcactggaccaaggatgaggctcaaggagggccctgggctcatgccctgggctgacagtggaggccatggggctggtggggaggagcacaggcctgaggccaccccacctggctcaagatccccactcgctacctctgtgacctggacaaattcctccacctcatctgtaaagtggggctaggaactgtttcccccttactgtgggattattatgaggattcagtgatgcgatccatgttgttttaacagtgctttgctatatggtaaggcttcggatagtacctcactggtaggtaatttcctgttaaggacagccaaagtggaattcagatggggatggtgagagccgagacattattttgtttgtttgtttgtttgttttgagacggagttttgctcttgttgcccaggctggagtgcagtgtcgctatctctgctcactgcaacctccgcctcccaggttcaagcgattctcctgcctcagcctcccaagtggctgggaatacaggcgcctgccaccatgcctggctaatttttatatttttagtagagatggtgtttcaccatgttgtccaggctggtctcaaactcctgaccccaggtgattgagagccgagacatttatgcccagttcctgcctttccagagcctggtgtcatcttttaagtcagcgctaccccatctccttcaattcagttcatgtcacctcagctcgacagaggcagttctgtgtctgggcaccaggaatcctcagggggaggccctccagcaccacctgagatgtttgccgtgtcagagaaccaaccttgtgatcacttacttagtaattttctttgaatgtactcacaatttatccctgtcagggcaagatggagtaagttaagctagtccaaacctaaacccgtgaaatcaggagatccataaactaaatatgtattttctcacaacatctgaagctaaatagaggttgagataaaattagaaaccattcacgtaggtgccatctaaaaccatcttaggtccctgtccccacccccatcccccacctgctgccccctatagtctgcacacaaggtggacttgttaaggctcccctgggacccctgcctgcccacagagcctcacctggacccggtcccaagagccaggcccactctcacgtccaggaggaagccctgcctccccaggtgttaggctggacttttcgtcctacagcacagggagagtgaagcagttaacaaaccacatttaatatgcagtattgtaattttaaatttgtggaacaaacctaaactactacttgtttttttatgctacctatagatattaaatgtggacagattttgcttggcagaccattggtttagaaggctgggttaagccctgtgtttgagtaaaagtagtattcaagtaaaagtgggattcaaccccaggttctttttggcctcaggcaaggaagttctatatctgcctcaccaacacttcttccaggagggtggagaatcagatatgaattatttctcacaatcaccaggaatggctgcagctctgctggacagattctgcatctgttcccaagctcatcggtcagcttttacatgggtacaccgaggcccagagaggaggacggggcttgcccaggtcgctggccaggtcactgtgctgcttccacacaaggtggctgggaggggaggcctacccagtttgaggcaggaagtgtctgagaagctggtcagagctcccccgctgtgcagccgccctgggctcctccacctgggagctcttgggacaagtctgagagcctttgaagcctctgcagcctgagagtttcagagctcttgctaccttcagatcctctttccatacagaacaccctgttagagctttctctcagctgggggctctctgtctcgaaaggggcctctgtgctgacagccccagtccctcagtgcggatcacacatgtggccttgccctgtgccaggtgcttgactgggcccttgctgaatcagatgaaagaaatcctctggaatcctcctgcacttctgcagcagctaacaactttgtttcatgcttttgaggccagaggctctgagaggtcacatgaccagcccaagcatccacagctaggactccacagaaccagctcatccttgccaggtgggaggcagtctgtcccacaccagggtatctgaaatgtttctgcttcaggtgctgtggctgatgcttccgggccattatctgtgtaccatcttcagctgggtgtgggtgaaagcctcgttggggatgggcccagaaagaccttggtgtatttctcacacccaaagaaggccgccaaggaaggcccatggcgacccctgggtaggaagcttggtgctctcagggagtgggatttgtgccatctggtgcacagcctcgggcaggaagtgcaccaggcccccagccacgcgcggagagcttctccagagagggctgtgatgtgcggctagaggcagtgcttggcacccctgctcctttcacaggacccagaagtttgccagatcaaaaccttagcattggctggaaaattggcttacttattgccatctgtacccatcacttacccatggagtgggcgccgtcctgggctgagtcgggtgggggtcctgccgttgagttagtaatttcgggttttccttttgttgtttaaaggcatacttgttaggctaccaagtaatatagaaacatattcacattgtaaaaggctcaaacagtgcagtttgtagagtaaaaagtgaaagtgccctgccatttccccagccacccacagtaccccctttccccccaggccacctgcttctccagcaggaactcccagcctccgttcaggggagggggagggtgtccttctggaccaagctcttcgcacctgcacacatacgtattcctctgggtggatagcctcgggctgtcttgttcaccacggtcactccagcccagccacaggcctggcacttagtagacacccactaaatttttactaaatgaatgacagtagcagtagtttttacatgaatgggaccatggacatcttgttctgcacttggttttggcactttaaagtggggttttcctgcgtcgggacatcagggtatgagggtgggcttatctgccgtcattgcattaaatggaagcacccgagggaccatcccttgtgcatcacccttgttgatatgcattggctgtgtccaattgtccatgttacagaacgctgaggggtcagccttttagcaactcagttcacaaacacagcactttgtcaggaggcagtcctagctgtgaaattgctcaaattgccctccataaaagaagctgcccatcaaacctcctgccaacagcgcagggaaatgcctgttcctcccctctgtcccacactggcccctgttggtctttgtcatctgtgccagcatgacgagcagaagcttacccatctgctgagcatgtccacctggtcgcctggtcacctggtcagaagtggctatgggaattcttcccatatatcccaggtggccagggaagggcccgactcaggaaatggcatctgtaagaatgatagggcagcctactgaggggtgctgggcatgactcgcagcatgggctggcccacccagccaccgccaggcaccggtccaaaccagtcaaccctgtgctctgctccgttttttccatccctgcctttgctcatcaatgaggtgccagaaaaggcttccagcggttggaattcctgcctccttcatgtgtgtttggaggccacacagctgtgttctctcaaacctccaccatcctttacactcagaatatctgtttagacattcctaactctgcttggtcgttgtttattttaaaatagtcccagaaatacgcttgcttatttagttctccaccaaacactccattgcgtagaatcatgcgtcccctgcattctggttccctggaagaaccgcagaagggggacctgcctcatacgaccaggctgcgtcagtcatgggagtgagctgtcagacattcacttttttaaaaaatagaaacagggactcgctatgttgcccagtctggtctcgaactctggacctcaagtgtggtcagaatttcactttgaaattcttgggttgaagaagagcttaagaatgggctgttactttcctgtgtttgtggattcatggaatgattcttaggggccattgtcaggaaagggaccatggacaacccagctggagttcttccataccagatgtcctcaggcagcggagtgatgttgatggctgtctgcagcattgccggggagcctgtgtgtgaagccttcacagtggaccactttcctattacatttctccgcaactccccgcttacctaacatcctgcctggaggtccagagaatctacagtccagtgttttaggaggctctctggatttttgtttctattttattttatttagttagtttttgagagagagtctcgctctgttgttcaggctggagtgcagtggtgtgatcttggctcactgcaacctctccctccctggttcaagtgattctcctgcctcagcctcccaagtagctgggattacaggcatgcgctaccatacccagctaatttttttttttttttttttttttttttggtatttttagtagagagagggtttcttgccttgttggccaggctcgtcttgaactcctgacctcaagtaatccacccacctcagcctcccaaagtgctgggattacaggcatgagccacggtgcccagcctattttaattttttgagatgaggtctcactacgttgcccaggctagtcttaaacttctgggctcaagcaccccgcccaccttggcctcccaaggtgttgggattacaggcgtgagccaccaagcctagccaggattttgcctttaaagcgcctaatctcctttctccataaagacgtgaggtaagcagttttccctcctgtgtttatatctcccccaactcacaccatgagctgcttctattaaaagacacaggagatggataactggtgttgaaaatgatatcacttatttcaaagggtaaaagggaagttgtgtgtggctttcagtaaaagctcacaggcctattcagtatcggccacttgatgaagaagccttactttgtggtggatgcccccgggtctggccccagtggcgcctgagaggcagcaggtagaggcaagagcatgctctgaaggctgtgattcacctcgtagggcgggtggggctgtgtgccctggcagccttctgcacctactgagtctcaggcctcccccacctctgcagggctgtcctgaggggctggcactgcacagggaagggcgctggctcggagatgggtagagttagtgggtaaatgggtactccgcagagtctgaccgccagcattcaagctacctctgctgcttgccaaccaggtgacctcagcacatggcttaacctgagcctcaggtttccttcatctgaaaaatgaggaaaattgtcaggaaagctttgagcacgatgcctgaaacacagcaggcctctgataggtgtaagctcaagttccatgactcaggctgcagatgatctgctaggctttctggtaacccacgggtagctgaacttgatgcctgagctccccctcgtaagttaccccacttttctttgcaggaaaggtgtgcttaagtaacaggtactcagcaggggtgttctgacaccctgggactgccatgggtttgcttcctcagaaggcttccccgtcggctgccctctctcactgtagggtctgcttggactcagtgtgcagaagccctccattatcgacagaaaacaagctccttaaaaacacacttaggccaagcacagtggctcacgcctgtaatttatccagcactttgggaggcaggtggacagatcacttgaggtcaggagttcgagaccagcctgggcaacatggcaaaactccatctctacaaaaacgaaaaactagccacgtgtggtggtatgcacctgtagtccaagctgcttgggaagctgaggtgggaggatcgcttgagcccagcaggtcaagactgaagtgagccaagatcacaccactgcactccagtctgggcgatagagtaagacctgtctcaaaaaacaaacaaaaacaaacacacacacacacacacacacacacacacacacacacacatgccaggtgtggtggtgggagcctgtagtcccagctacttgggaggctgaggcgggaggatcacagcctcccgggaggttcccgtgagccaagatcataccactgcactccagcctggctctgtctcaaaaacaaaaacacacacaaacacaaaaaagcccatgcttaaaccaatccctggcttgcaggcatttccagcatttccttgaacgtttttgcaaatacagatttgaacataactgatttcagttcctgtccccaaaacttttggttccttccttccttttgttcgtggcacaatggtgagagtaggtgctctggagtcagaatctatcagggtttgaggactgggtctgtcgtctatgagctgtatgacttcggccgagcttctgaaactctgtgggcctcggtttcctcttctataaaacacggtggtcgtgacaattaaatatactaacaagcgtttgatccataatagaatccccaatgcatggtgactgtcgttatcctcatcatcatgactgtccccagtctagtgggagacaggccaggaggcaggaagctccccctaccccagtgtcgaggcccccatggagcagggaggagctgggatgaggagcatccttacctgggcaatctgtccagacccatctcagggatctcctcctcctgtaccccccaccacctccacttccctgctggctcctacagcctttgcacccccttctcatggtgcttttggggcatcacatggtgtgcaccctcatctcttatgaattcagctagacctgctcagcacagcagagtgagagagagaagggcagtaggcttcactggagtggcccttccctgccatccctcacagtgagcctgggccctggagttgggacatttggagaacaaagccacttttcctcagccagtgcggttaccgtggccatactcgtcccagtgagtatgagtctaggactcaaaaagtgcttcaaggcctcctaaaccctagctgacacttcctgtggcactcaggcaaaggaacaaacaggcttccagtgtacaggccgggagcatgccctgctggacacttcagtgattctgcccggactcaagggttggaaggtgggcagtgactggtcacctttctcttcatatctataccgcctggcactgaggagtcaccaaatgaatctgtcttaaagcaaagtgggcgtatttttgaagaagtaaatatcagccaggcgccgagggtgggcagatgcaccctgggcacagcacaggtggaagagggcagggcgtgtacaagactgagcaagaggaggtagaaggcgagccaggatatgagggtgtggcagtgcagagaaggggccctgctgaaggacaggaaagtgggctgggagcagctccaggaagcccacttccatggcacagttagcagggatgaggtagcaagaatggaggcggcagctggtgaaacatgcctctctcattcaccccaggtgagaggacagtgacccaagccacggtgcgttcagggatggggcaggcttggttagaagggaggacccacaggcttcctagcctgttggggtggaggggtgacgagggtctttggacgacaggcaggtcctatcatgtgcttgtagaagccatggtggttaatttctgccttcttttgtaactgtggcattaggaagcaggactgaccccattcctctaaatcatgccctggtctcaacctttcctccagagtacttcctcttttgtacagggccccttcccagcctgtggctgtcctaatgaaccaccttgctgtgtcaccttcaggtgaccaaagatgaaggctccaggggctcaaaggggaaactgaagggtaacatgagtcaggggttccagaggcttgactcagaagctctgcgcctgtcctgggcaggccgagcctgataagtttccagccctaaggtgtgattgcagtaaaccttctggaagccagagccggcttcatctacagatgtgaggtttgtgggaggaggcagaagtgctcttgtggcttaacgggccctcttggctccagctgctcagaggaggggcagctgagagccacacaaggccttgcctctgaagtttgaagcatttacaggcaccacctccccccctacaactttttccaggccacatcaggcaagctcctttcttaagaactgaccttgtgtgtctctttttgcatctgagttctttagaaaaatctctcccttttttcctgtggggccctgcatgcctgccttggccccactgcccgaatatgccttctctcatttccctcctgcctctgccgtgtagtttctaatgtagctcaaatgtgaaaaattaggtttgcatggttgccatgaattttacgtgaatcacatttaaatcaataaagcctgtagaatgaatcaagttatcgttattatgaggtagcagggggctatttaaaggggctgtgggcctttaagcacataatggaaaaagtttcctactactggatgatccccgataaagcacttaaccttttgcagctctgggctccctcagtacctgtgatgcgtttgaagtttctactttcttcttagcaggtgtgatcaagcagaactagaatgaaagtcacattttccatgacttgtttcttatttgaacagttgctaatctttttttttctttttttttttaagtgggtagtcttttaaatgacattctgtttcaaatgtgtgagcttgggatctttgatgtaaatagcaggaaaaagtgggcggtaatgttatggaacgtggaaagcctgccttttctaggtcgtgcttttagagcaagaaccagagagaagaaagaaaggaaagagaagatgaaaaagaaaaaaggctgtgcaggggtcacggctggaaaggccctcatagcagcctggcacatcatgttctgactctgggtgcagggctccccccacctccccattttcaccttgatcagtcctgacattctctccacgggccagctctggtctgtgtgttgggaatgaccactccaggaacagagtccaggcagtcagcatagctgagggtttgccacagtgctctggacagttgagtaagacaggagctacagccgggcacgatggctcacgcctgtaatcccaacactttgggaggccgaggcaggcagatcacctgagatcaggagttcgaaaccagcctggccaacatggtaaaaccccatctctactaaaaatacaaaaattagctgggcgtggtggcaggctcctgtaatcccagctacctgggagcctgaggcaagagaatcacttgaacccaggaggcagaggttgctatgagccgagatcgtaccgctgcactccaccctgggtgacatagcaaaactctgtctcaaaaagaaaaaaaaaaaaaaaaaaaagggagctagaagcgtagctgtagcgtaagattggcaccaaaggagaccttcactttggaagttaatggactcaaactcctgggttcaagcagtcttcccacttcagcctcccaagtagctaggactgcaggtgcacaccatcacacccagccattaccttttaattacacaaatactgtgcaaataccttgtctttgtaagaaaacaaaactaaggccagataccatggctcacgcatgtaatcccagttactttgggaggctgaggcgagggttgtgggggatcacttgagcccaggagttggagaccagactgggcaacatagcaagaccccatctctaaaaaaaaaaaattttatgtagctgggtgttgtggtattcatctatagtcccagctgctcaggaggctgaggtgggaggatcatttgagtccgggaagtcaagcctatagtgagctgtgatggcatcaccgcactccatcctgggtgacagagtgagaccctgtctcaaaaagtaaaataaaataaaaactaagtaatgtccaccctcctcatcccacttccctggataaccacagtcacagtgggtatgttttcttccagacctgtgtcccaagaagcacacagagacccacgggaggaatacagaccattgaaagttttctaaatttatttcctgattataaaagtattatctattcactgtagaaaattaagagaaacaagcatttaaaaaacacttgtaaccataccataccccaaagataaccacatgagttcattttacaaaaatgaggtcaccctgtgcacgctgttcgataaccttaatttttcactccaggccttatgggggtgccttgtccctgcatcaccaagctgtgtgtctcatcaagacttttccagaggtggtgcctgaggcaattcttggttggcaaatgtaggaatattttgtccatgtacgtaatcatgtcttctatgaaagatgatgctgattttgcgttgatgtaaatgaaattttccttataaatttcaatacaaagggagggacataatctaaagaaaacatcacataaacggtacaggtggtacaactaggaaaaaatccttaggatggtcaggaaatgactaaagtttaggaaccaccattttaacagcatttttaaaaaactgactgtataacatgccaccatgagggcctgccaagatttagtttcccagtatctgtgaatttttccctttttaagtcctccccaccccaagtttgaacttccctgtagctgaatctctacacccaaccatgagaacggcggtaacctaaaattctagaacaggttaaaggacatgcccagctgaaagacttctttgccaattgccaagttgccctccaggaaggctgtcccagtgtgagcagctgggtgagtaaccaggggctgttttcctgatgaaaattcacaactgtgagtaaatgcctcacatcccttaccaattttcttatctgaaagatttaatcagctccctcgcccttgacaggtttctttctctgtgttttgggggcctctgtaagtgccttttaatatttccattgtgtgtgttaatctttcattagaatttgatgcatcagaaatatttttaaaaagcttagttcaattaatttccttccctgccctattattttacttccttctttacctgaatcattaatggcaaggagcaccgacacagaactgagttcagggctgttctaattaactcccggggatgttatgagcaatccatcagtcctggggttgcattacagcctccgtatttactggtgttttttcagtgagctttccctgtgtgtgaaaaatccagcagctttttggccccattggtttacgtctgttttatgaatggcctgaaacgtcttgccccagtgtctgagagtgtgatgaggaaaaggattttgtgctttgctttgtttttcaattatccatgggctgtgagttccttgcattataatagcaggagcacaaacctatgatcagactccaccaacttcagtgttggctcagggtatgaccttgggcaggtttgtctcctcagctggcccacgggcgacaggtgtagggaggtctgcctcccacaagtgatgccacaaggccaagtggtatgtagacttggctgtgtggtagaatcacttggagagctttaaggcgcccggtgcccaggtcacaccccacaccaattaaatcagactgtctgggggcaggagccagcatctgttttcagtgatcccaggtgatcctacatgcagtagagtttgggagccaccgctctagggattaaccgaggcctctgcagcacgcactagcatggtggcaaacaatgagttctcagtgcccacccctcaacagaaaagccagaagatggagacacagaagtcagatcctgctcagccccatctccaaggaacggccatgtgagcctgtgtactgagaatgcgtgcctgtgcacgccgaggatgcagaaagggacaggggaccaagtggcaggtagccttttcttctaaactgctaccaggtatttgcatcccagcctgtttagtgttgctgctgagtcccctccaccttcaagaactgtcagcctcttcagtaaggagacgtggggtcccagctgtggcttcctaagagctgagcgtgagggcgttagtgtggccatccataatggtatttgggatctgacaagtctccaaaccacttgtccatagaccctccagggccctgcaccctgagaaccagcctggtggggctggagtcctaaaatctgcactttgtcccagtaccgggtgccccaggctgccaatgggcctcccttcgaggaaccctggatctctcccaagacgctgtgtgtgagcttcagcctttccagttgcctgcacattctcgcccaagtgctgtgtgtgggagtaacttttcaactccttcgttcaagagcctttcccacccctccactgggcccagtcctatgtgggggccaggacagagagatgcccaggcagtgagcaggtcagaccctgctcatcctcagaggccagggtggagggaggcaggtgacccatgaggaatcccttccagcagtgagacctgtggcaccccatgcccattgatcatacctacttgctctgtgacacggagagacagctgtgtgggaatgggctttctgtgtgctctgcagagagcgtggcggctaaggtgaggcatgggagtcataacccccaggctgagtgagccaagagtgcatgtggccagagcgccccattccttccaggtcagggagctccaaggccctgggccaggctgcttcatgccacccgggtttgccaggacaggtcattctcatgcacggctcatcggcagacgtggagcagagctgtttcccacggtcccacacagtggacagggtctcgttttcttccctctaacccttcgctgtccaacacggtagccacttgtggctgtctaaatctacattaatgaaaattaaggttaaataaaattaaacatttctgttccactgtcacaccacatttcaagtgctcagtcgtggatagcaagacaacggaaaaaggatatttaattgtatttaattttaattgaaatgcaaatagccacatgtgtggtggctctgtactagacagcatggtcgtaggacatttccatcaatgcagaaagtccttttgggcagcagcgctgtctagcaggtggggtaaaatcaggaaacaagaaaggcaagggtttggagtctttcaggatcccagctccgtcactttctagtgtgtggctgcatgctgtcaactctgctggggcccaggcgtcctcgtctggaactgaaagcccagatttgtgtggctacctcctcacccaggtgcgaggacggggcaaagtgaggatggtaacagtaacagaggtgtggactgggcacttgctctctgctttcattcttccctgcctgggacccacgtgctgttttcacccctgtttacagatgggaaagtagaggcccagagcctgtgctgtgtttaagtgtccagcatgtggcaggaagcagagacagtggggattgtgattcttacctatctagccagagttgcacctggggtttggaggcacggctgactgggtacacaggctctacacccctgccaactgtctgaccacggtggctctgcctatgacacacttatttactattggacagcctgactagctcttttcttaacttttgcctaaaaaaaattcaatccatggcttcctagctctgaacttgcctctgtgcatcaagctgaagaaggtgcaggagtttcagagccagtcattccttaacagggaggtaagactgcgggggactcagcaatttggagcctgggctttctcaccacctatcatgccctcctacggtcctgccaaaatctcctgtctctctttcacctttccctttctccgcctgctggtggatttcctctgccaagaaattagcaagagcagctgaaggcggtgatgcacacggcccggccaaagtgaagtcacccctgctcctgctgtgaaagctgctgatctctttcttagcacaggcagccaaatgtggtttacccttctggtccagatttcactaacttagtgtggcccagagaatctttttacaagattggggtttggtttcaagcacatggagggacttggacctgactcacttgggcatttcctgcttggggtcctgggaattgacctcccggaagataacattagcagcacaacctcaagtcagttactgaccctctcagggtctcagctttctcatgtgtaatgtgcagataatggtactgcctgggctgggtggttttgagtgcttagctcagtgtcagatgcttattaaatattacactgtaactgttagtatctgaaattagcatgggtatatgtttgcaagtggctggaacttttgaagagtttatttgcagggtttgcagatgaacttttaaacaaagtctgtaacgggttgaatatacctttccattgtgctggtacagtttatactcacagatttctttcagttactgctttatggtctgtctgttgagactgtggctgcgtgagggccagaccttcattttcagccctgcagccctagtacctgggactgtgcttggcccatagtagatacacagtaactgtttgatgaattaataaataaaggaacaaatgtcatgttattttttcttaatatgcttagtaaactctttgttcgtgttatattttaagttccagtccaggtcttcattataagcttccaattaagggcctgagttacatttcactgaataatgataggcaaaaaccttcagttctcgcagtgatcttcctagtgtccccagttcctgggcaactatttatagtcctaggtgtggctttaataagccacccttgttgatgggtccccaccctccgcagcctcacccccaacagtcctcactgccctcttcctcatatcccagccccaacaaaggacaggagtttcccaaactcaccatgttccctcctgcctctggcccatggtacatgccccttccctgcatgtccttgactgtcgcactctgcgtgtcacactctgcgtgtcttgttcattctgttttctccctactgggctgtgaggtcctacagagcagggactgagccttttatcttgtctctccaacaccttggatgtccaaggtaggcatccctcctctccacagacgtctagtgagcacataccgtgtgcctggccatgagcagtgaacaaaaatgacaaaaatccttgccctcatagaactaatgttctagaagatactccataaaagtttcttgaatgaatggagctcccttttttattttgcccttcatgaatttcataagtagttcgtgtacaagttcatttttttcttttcttttcttttcttttttttttgaaacagggtatccttctgttgcccaagttggagtgcagtgatgcaattatggtcactgtagctttgacctccctaggctcaagtgatcctcccacctcagccccccgagtagctgggaccacaggtgcacaccaccacatccagataatttttgctttttttttttttttttgtagggacacggtcttgccatgttgcctaggctggtctcaaactcttgggcttgagcaatctgcctacctcagcctcccaaagtgttgggattataggtgtgagccaccgcacctagttcatttttaaaagaattaaaaactcagagggaaaaatagtttgagattctccatttttaccatggctgaaacgtagtttaaataaggccatctgattgggggtgtggtattgtattacacacagctgtgctgataagattgcgtttcacttaaatcacatgcttccagaatgttgctctgctgcccaaagtttattagtaatcagtttgaacacaaaagattaaaaacgtaaagcagggaatttggtttgtgaggtatacgcttttgtttaagtccaaaggtacagcttgtctccaccagaggtctcctatattttactgttaatgtttgaagtatattgaattcccacaagctaattaaaaatcagactgctgtgccggtaagcattcactctgtgaactaatttctgccaaacggctataaatgtgtcccctggtatgaaatttagacattctttcccatcagaaaagaggcatgtggtttagtcccaaccgcttcatttgagtgacaaggaagctgaggtccacctggaaaggtcggttgccctgactgaggccacacagcctagtaagtggccccactgggcatcagacccaggccccttctccatctcagctcagtgttctccccaccaaatcctgctggttcttgctgggtggaactcagagagctgctgttactcctaagtgccaggcactatcctagcaccttacaaacatcattgagttttcatagtaacactatagggacagtattgttaatatcacctctatttgctgatgaggtacctgagggccagaggggagacggcaacaagccgaggtcccacactggtaaggggcagagctcagtctaaagcagcaggcggcctggtcctcactgtgccttcaccacaaggctgaactgtccctggaggctgaaactcagggacagacacagagggagggcctgagagatgggcaagcgaatgctccccggaccttctggcggaaatgaggtgaagagcctcaaaccccagaggtttggtggaaaatgggaggctagtgctgggcccacaagggtcagatccaagaatatgctggggaggagccagcagtccccccagagaggcccagtggcgctgctctccacctctgcttggcccattgctgggcttctttcaagatcaatttaaaacattacctcctgactgggcacagggctcactcctgtaatcccagcactttgggaggctgaggtgggcggatcacctgagatcaggggtttgagaccagcctggccaacatggtgaaaccctgtctctactgaaaatacaaaaattagccaggcgtggtggcgcatgcctgttgtcctagctactcaggtggctgacacaggggaatcacttgaacctggcaggtggaggttgcaataagccaggaatgcgccattgcactccagcctgggcaacacaacaaaactccgtctcaaaaaaataaaaataaatcacctcctgcaagaagccttctctgacccttgggctgtgtcatggcctgtcttccagcagtctacatcctcctggtcttcccctgctgtggctcttgtcccatggcatgtaattgtcacttctttgggctcccatgctagacaggaacccctgagggacaagtcttacccatctctgtggtcctctttgccaagcagagtccagcacccccagaaatgtttgaatgaaaagtctgaggcagtgatgaatgggtgtaccggttccatctatgaagccttttcttccccacaactggcctatgtcggaggagaatctgggttggatgttagcaggagagaatgcctccttgcttagaagagccttgaatgccaggctcagatccatttgaccagaagagctccttgaggtctggccagcatctgtgggtaccaggatcccccacagatgtgtgtggcacccacagatgccttctctagcagtgttagtaatatagatcccagaggtgagttttgttttggggggtttttttgagacaaggtctcactctgtcgcccaggctggagtacagtggtacaatctcagcttactgcaacctctgcctcctgggctcaagcagtcctcctgcctcagccttccaagtacctgggactacagccatgtgccaccatacccagctaattttttttttattaaaattatctccctaggagtcatagagatggggtctcactatattgcccaggctgttttcaaactctgagctcaagcaatcctcccacctcagcctcccaaaggatgggattacaggtatatgccaccacacccagcatatcccagaggttttaacatattctctagactatgtcctctgcctggggacctcaccccctaaggaaggagaataccctgggccaggatctgctctctggaatacccttgtgtacttttctgatgaggtgccttacagaggaaatccaagggaaagagaagatgtagccccatcttcaagaacttctctccagagggaggaaggagaggtgggcccataccacgaaggtggagaaaaatcacaagccctctctgcaccccagcttacttgttcccaacagcattcctacaaagtaggggtgtcctcatttttcagataaggaaacagcctctgaagggtcacccagtgtaaggatgcatctgccttcttcatccctgtagcccagtacccgacacacagtagccccatagccctaggcacaaatggggtagagagaccctgaccacatcctgtggaaggtccagagcagagccatcacagagggcttccgaagaccaggatacccttgttcctgggctgctgggctgctgaacagcggggaagaggagctgtgtgaacctagattccatgtgactttatctggctgcataatgagcttaagtattcagatcttttcttggaaatctcaagtattccatttggctgcctcacagagttaggcaattttatttactcatgctaaacagggccattttcagagaggaaattatgcaatgtactatgcaaatgtggcattccgagagcagagataagtgtggtcaccgatgcattgtaagatgagatcgtgtctctggcagctgggtgtcacttgataaggggatatgccagactgtacttggaactgctgctcccttggactcggtttctggtaattgtgttttcaccaagttgtcaagctgtgaactgcacgtattgaagaagaggaacaaggagtgaagcttttgcaagttgctcatccttaagtagacttcagcagtcagagaggctgcccccatacatgttctggacacatgggaacaaggagggtaaaattctcatcctccattctcccaagaagagtcttaaaatttgacacgggggaaagatgaagacacacaactggttttcctggccactgtgaaaaccagtcacctcattttactagacatggcatgtgcctttcatactgagagaaaggaagtagctgtggaaaaccccacctttggaagcagacagagctgagcccaaagctagcacttcccccagcctgtgggtacctgagattgaggcacccagcctccccaagccttcagctccctgcctgaaaatggcactttcagttagttattgctcctgggccgtgtaccagtcacaaagacagccaacccttcacacagccactgctcagatagttgctgagtgagccagtgacagatttatccacctctatctgtaaagtgagcattgatacagtgtcctcagtggccctgagtgtgctgggagacatgaagattctgcagagttaagagattctggaaagagtcctacagagggctccatccaaactctttccattcaaatccttgctattcaacttgggaacaaaatggatcttcacaatgataggatcctgtagtcatcacacaaaagtgatataaaggaggccagaaaactaataatttgagtgcagattctgcatactgaccagtcaccttgtgtcaaatctgttgtaatttgcctgaacttcacaacaatgctaggaagtccatttttccccaaaaaattttattttgaaaccttccaagcatacaaccaagttgaaagaattgtatagtgaacaccctcatacttgtctacttgtcttatcacgtatctactttatccaccaaacttttttgtgggggagagttagagtctctctcacccaggctggagtgcagtgttttgatcatagctcactgcagcctcgaactcctgggcccgagtgagcttcccacttcggcctccgaagcagctaggattacaggtgtgagccaccacacccagcccaatttttttttttttttttttttagatggggtattgctatgtttcccaggcgagaatagctctggctatgttaaccaagctggagtttacaggcttagtcttagtgctgtagcctcaaactcctggcctcaagcaatcctcctgcctcagcctcctgagttgtgggactatagttgcatgccaccacacctggcttctcttctttttttttttaagatacttttccttagaggtgaggaagtgaatctttttaaaaatttatttcaaagtaaattgcaggcctcagtacccttctccccaaatactccagcttgcatatcatgaagtagagctataaaattattttattaccccccgcctatagatgagacaactgaagcaaagtcacatgcccagggtcaccacagctggaaggtggcagagttaccactcaactccaggcacttggcccaggcccggcttgggactgttgccctgcacagcttcccctgcattcagacctgtgcttcttggtggggaagtggagctggaatgtgttaggagaacacaagagttttcttaacagtgctctgccggttactcttggtggtgtgggcagaggggtgtggagaggcggcagaggcccggacatcagtgtggcacctgtagtgggacgcccagtgaacagctcaaaccttaaaaccaagcagtaggtcccagtttccccgggtaactgaatttcaacaaataccccattatctacatacctcattgctggtttcctttacaaatcccagaaatgccaccagtacatttttttttttcctcttcatgttagagggtgcggcttataggcctggcagtagaaaggtgccaagacccactctctgtccaggaaatatcacacttcacaactgcccccttttcatgctgggaaggaatgctttagggagccacaaagaagaaaaagtaattgattgctacttgcagcaaataacccataagctgttgctgggttgatggagaaatggttacttaattttcttcaaaggattgatttgactgtcaggagaagcagccaacctaattgagtgtgctagttcacaccctcggtgggaacagtctcagcccttcttttgtcttgaaagtgtcctggattatgaagtcccccaccggagtgagtcgaggctcaggaaggtccaggtgtcctaccatgctgttctgcctctttcaggtgatctgtagaatttaccagggcccagttccttgtcactccagctctgctgggcttacactggaatcagcactggcttccttttcaaagcactcaagttagctcccaaggaaacgtgatttgtttatgccccagaatggctgctgttttcagttttcagtggattctgacagggtggtgacctgggagagatgcattgcactgtcctcctgggctgttgattgacccctcggaccacttaggcttcctctcccctccaccccgcactgagccgtgactcaccaggtactccccagcagtgcagtatggtggccaaggcccctcctgcagctgcattctgtcatcagggaggcatgcgaggctgattttccctcaagtcaccaatgtaattctgtgccacaaagaaccgtctccatcccacagaggctgattccccaagtgtccagcagcttggaagggtagccatccttctgctggtctgaagcaccatgagggcaggctgctgactggtcttgctaactgatggattctagcatctgaaaagagcccaaggggcggacacccagcttcagtctctcctgcatgccaggaagagaaactctcaagggtagaagagagacagcatttcctaagccaaagaaggaactaggtctcctgctcgaaggggccaccaagtgccctgtgaaagggggaccttgccaaggcagtccaggagcatggaggtggcttcagatccttggccaccagggagttaaaccctcagggcttgcctgttgagagctcacatcatttgactgtctccttgccagaaccagccaacatctcccacccaccctctgcagctagcccaggtagagggggcaccaggctgtgaggcagatgagtgctctctctggcctcagccaggggactggaatgccaggttttgatcagcttgttcaggagagtgtgaagttcacatggccatctggctgcatccctcagccacatatgtcactcatcagtttgtgtcattggggaagtcacttgtcctgctgcagtttgtggccacctcataggatctgggaccatgtcaagtggaaagttggggcttggcatataaaagcactttataaaggttggtcttggtgccagcagccattgtcattgatgaaactactgggccgggcgcggtggctcatgcctgtaatcccagcactttgggaggccgaggcgggcggatcacgaggtcaggagatcgagaccatcctggctaacatggtgaaaccccatctctactaaaaatacaaacaaattagccaggcgtggtggcgggcgcctgtagtcccagttactcgggaggctgaggcaggagaatggcatgaacccgggaggcggagcttgcagtgagctgagatcgcgccactgcactccagcctgggcgacagagtgagactgtctcaaaaaaaaaaaaaaaaaaaaaaaaactgggagcaggggccttgattcaaaacagccctgacttttttttttttattagatggagtctcactctgtcacccaggcagtggtgcagtggtgcgatcatgacccagtgcaacctggaactccaggctcaagctatcctcccacctcagcctgggaccacaggtgtgcaccaccacacccagctaatttttttattatttgtaaagacgaggtcttgctatgttgcccagtctggtcttgagctcctgggctcaagtaatcctcccgccttggcctcccaaagtaatgggattacaggtatgagccacctcactcagccctgataatctttcagtacatggctttagagaaccaaagcctggaatggtgctgcatccccaactccggtgaaagccagcaatgctcagtgttttttgccctccctgcaccacccacaggccactgcagttccccctcactaatccctggtaccagcgcagactcgggaatagaaacaagtcaggctggatgggtgtgtggaggggccaagaccacagcccctccctcacacgtgcagccacgggccctccaggtgtcctatcagctgtgggccctgctcttggaattccagggtgagcctgcctttccctcaagggatcagtgttccctgttcctcagcccctcctgacctctgattaaccacacgtgcttgaaagatttgctaatgtttactgaactgctaatttaaactccagccgtagcctaaaacaggctgttggatttcaaagccttggaattctgctggcctggatatccccctgtaaggaaaaagacttgcattctaaatgcagctggagccaccaatgctaagaattaaattatggattggcatccgtattttattgtgaagggattattaaaatacagcaaaagtcagtcagccccatttatcgctcagtaatgggctacagcctgtcagagggggctgtaggggaaggcttcagcccaggagctaaaagaacagttgattgagcagtccctggcctccaagtgggagcaccaaaagacattagcttccttccatcccatccacaaatacttcttcagcaccagccattgcccagaccccctccagagggtacagcagctagtgatactggtcaggaccccttgttttgggagcttacagtctggacagggatgcttcaacacagtcaagaatgacaggcactgggatggggctggggattagggaaatgtagagagggactgggggagcagccagggatgaggggtcaggggaggcctcactgcagagcccggggggcctgtgtatcttgcatattccatgaccttacgggaattctgaaaaacaaccgaaaaccatgattcattttctccctctgaagagactcatttagtcaagagtttgcattcagaaaacatgagtaccttaggcagaagggttccaacgagagagtcatggctccagaaatgtcatggcacttccgagcaatttgacttgtgctgggagaacactaggaccacttctgacaatgaccaccatagcttgcctctgtgatgcatgctgggcacagccccatgcccctcccagataccctgggcagtcctgcaggtggttaagtgttcttcttataaggcagaaacctgagactcagaaaagggaggtgatcggcccagggtcacacagtttaataactggcagagctgggctttaaacccagtctgcacagtgctaaagctcaagttgccgtgatactgctcttcatggtaacagcatgctttttctttcatgctttttccttttctcctcttccttcccagcatcttaaagttgtgttgggaaatggttgtgctagtttcccttcattctgctaaatacttgcaggatcttccaaggtccccaaaacagccaatcctgagttgtttctctaggccagtcttctgagatgcagcatgtagcttcttggtggtactgaaagaattttagaattttagatgtgcctggatgtagcactaaattaaattaccatcacaattatctattgctgagtaaccaaccacatatattaacttcatggcttaaaacaactatgggaattcattttgctagcaaatgtataatttgcccagggctcaatgggaataactctgctccacatggcatcagctggcgtgtatagactgggagctggctgtgggcctggaccttggtttctctctgtgggtgtctccatggctacttgggcttcctcacaacatggtggataggttccaagagcatttttatgactttgcctcagaaatcacaaagcatcacttccattggtactcttttggtctagacaatcactgaggcccactcaggttcaaggagaagggtagaccccaccacttgatgggaggagagtcaaagtcacactatgagaagaacatgtaggtaagaaatattgctgtggccatctttggaaagtatagtccgtaagaaaatccatttcagtgcccctctagtctgtgctgttacaccaaggagaaggtctcagattcagactagtttgtcgtagaaactctgtaactcagatttcctctttttatcaaaagagcaggcattaggctgtaatttaataaatggtcttttctcctctaatcagttttcatgtttaccttaatgattgtaagtaattctgtttttccattcatggtaatgatatgaagtttccttctgaaatttattttaatagaatacaaatgttttagaaaaattaagcataagctctcctttgctgctataaatttactctcgcatgtgcgtatgaataagaatgttcctttgaatgttgtagcaaaagcttctaaacactccgaatgtctgccagttggagagctgttaaatggtgtagagttctccctaccgtgggagagaacgcagctatgaaaaatcacaaggagtgtctcagtgccgatgtgccatcaggaagtgtcaaaagtacaatgtaggcagtgtgggtggcatgccaccatttaagaaaggaaatggagaggagaacatagccccatgagtgcttgaaaatgcacagtggacaggcaacaagagcccgtgcagtggttgcctctgcagaggggcacaggagacacttattatccactgtaaaaaggttttatacctgttaaaatgggaacctaggaatgtgttatctagtgaaagtggttgataagtttaatattttcaaataaaatagaatgggtcaggtgtggtggctcacacctataatcccagcactttgggaggccaaggcaggaggaccacttgatccaggagtttgagaccaggctggacaacatagcaagatcctatctctacaaaaaaaaaaaaaaaaaaaagattacccaggaatgatggcacacctgtagtcctagctacttagaaggctgaggcaggaggatcgcttgggtgcaagagtttgaggctgcggtaagcaatgattgcaccattgcagtccagcctgggtgacagacctatctcagtcaatacatacatacatacatacacacacacatacatatgacatgcagcaaattttctcccctccccaaagaaaaataaaaggtagtgcctgggagtaggagggctatgtcacctttccttggaacaaggttccgctaggaggcatgccataccttcagggtcctgggtaagatggagacatctgccatcctaccttttgcctgtggggcctggttcctccccagaatggaggcttggtctgcacagcctttcatggtccttagccttccacctgggccctgaactcctcttggtgggggccaagcctcattctcagtataggtacttagtgcctagtacagagcctggccccagtaggcaccagactgtgcacgtgcacatgtgagctgaactggacaccagagctcttgaactcacaggtgtgactgtgagaagaactcacacttggaaacatccacagctatgtcccaagggtgctgtcagagagctcttggcttcacgccatcacctggttctcagtgattgtctatcatctgcatgatcaggcagagcccggctggccagcagcttggcctagtgctgctccccaaccctggctgggcctcataaagacctgagtccctttgtgtaaagctgtggaaagagactcacttatttctttattcaattttaagtgtgcaaataacatacctattttccctttagaaaatcagagcagtgtgtagaaactaaaatcggcctgtaattccagcactttgggaggctgaggtgggaggatcccttgagccagcagttcgagtccagcctgggcaacatggcacaaccccatctctacaaaaaataaagaattagctgggcatggatggtgcatgcctttagtcccagtaacttgggagcctgaggtgagaggatcactcgagcctgtgaggccgaggctgcagtaagccatgatcgctcccctgtactccagcctgggtgacagagtgagaccctgtctcaaagaaaaaaaacagaaagaaaaagaaactaaaatcaccttggagcttctttttctactcatcgtatgttcttgagacttggctctcttgaactctctggaaggcgaattcattccatgtcattgctccttggtgttacacagaaggaataaacacattttagttaggctttcccttcttgctggaaaattgactcttcacagtcttttagcccacgcgtgtgagtgtttttcttgggaacataccaattgctaggtcatagaatgtgaaactttcggttttaataaataatgctaatttgtccttcaaaacggctatgctaatttattctcccactagcagcttttgagaaatgccagtttctctgcatcctcattatacctgatgttatcagacatgtttattcttgccaatcctatgggcagaagatggtattttgagttgtttcctgatttcccatgaggatggccgtgtgtgtgtgtgtgtgtgtgtgtgtgtgtgtgtgtgtgtgtgtgtgtgtttattggcaatccccattcctggctgcccccttcccctcatctgtgaatggcctatgcaaatccttcacgtttactactgtatctttggcctcttaaatcatagggataattgatctgatcattgtcttctgataattttcttaatagaatcctaagccccacccctgtagaattggagattcgatgggcagtgagatctggggatggtggatggatgaccaggcagtctcatgtcacctgtcagctgcactggcctctccttgccatggccactcctgagtgtcaggcagggaggctgccacataccacgacagagccgtctgccaccaagtccttcccatggtaccttagcactcagcatactcctgctggctcccaaatgcatgcatgaagcctgcaggcagaggctttagagggtgggccgagttggattccattcagcatttctctcctggatttctcctcaacccaagaccccatggcagtcccaaggtgactagcctgtgtcccccagggctccacagccagggtgtggagcagccgaggactggggcagggtacaggagttccctaaaatgatactggcgggacccacaaaggagtcacccaaaacccgcaattccttgatctcccttgcggatagcatttgcttgtaatctgtagaagccgcttcatttctccttaactgccccacagcctctgaaaagcgagagctccctccctgggatccttcctgtctcactggtgtggccgcattttagttttcttatgaaatctctcactgtgttctcacagggctttgatgtctcaattacatttctgaaagctgttccgttctggggttttatccttccttttttgttctttgtggtggaggtggcaggtctttcttccgctgaagcccctcaggcagccaggctctatgagggagtcgcactgcctgggacaaaccccattgacactgacgtgtatgactgtgtccgttttcccagatcaaactctcagatgaacttcttttgtgaatgtgaaaacagaaggtagtcaagttgtcctgtgtagagtgaggaaagggaaaggagaggagggggaaggaggatagaaagagaaagaaaggaaagaacatgtttattgtttttgttctatttttaaagagtattttttaaaagattcccactgagaaaatgctttaagttttgtttgtttgttttgagacagggctcatcactctgtcacccagaccggagttcagtggtgtgatcacggctctctatagcctcaacctccctgggctcaagtgatcctcctgcctcagcctcctgagtagctgggactacaggcacatgccactacagccagttgatttttctacttttagtagaggtgaggttttgccatgttgcacaggccggtgtggaactcctgggctcaagcgatccacccatctcagtcttcaaaagtgttgggattataggcatgagccaccacgcccggcctgttttaagtattgagtaaagaaaacaaaccctacctaccacaaagaaaatgtttataagaatgaatatgatgacttccttttttaataatgtagaagactagtcatctagagaatcatccagtatggaactaaaaattcatcataagataaacatactattgtacattttatgttaatataatatatttcataatatattaaaacatatatattataaatttttttaaagacaaggtctcactatgttgcccaggatgaactcttgggctcaagcaatcctcccaccttggcctcccatagtgctgagattacaggcatgagccaccgtgcccagccctaaaatatgttttttaaaaaatattttcaaatacccggctggactgttgggaaaggaaagaaggttcttgctgtagataataagaaagcacaactgggccagatgtggtagctcatgcctctaatcccagcactttgggaggtcaaggcaggcggatcacttgaggccaggagtttgagaccagcctggccaacatggtgaaaccctgtctctactaaaaataaaaaaaaaaaaatagccaggcgtggtggtgtttgcctataatcctagctattagggaggctgaggcaggaggatcacttgaacccaggaggcagaggttgcagtgagctgagattgtgccactgtactccagcctgtgcaacagagcaagactgtctaaaagaaaaagaaaagaaaaaaaaaggtacaaattcagtaaagcctatctggagctgggatttgctgtgggggtacctggctgacttcgggggtcatgtgctggagagaatagagggaaacacgaggcctgtaaagaccgagaggaccaactgggtgacatccacatgaaaccagaatctcagacaggttacactgtcggaggattgaaccgaggcatatgttgctgggggttacccgagaaaggaaagagaaatttacctgtgcttttagatcaggatgaaaactgaaaaaggagaggggggaaatccttggagaatgcatgagcccagtttgttatcgtgtgctttggccaaaattgataccacccatgttacccttctcctcccctaataaagttgagccaaatatctggttaatgtgctcccaacagaacctattggggtgatggaagtattccacaactgggatgtggtaatacatagccataaatatactaaaactcagcactattcaaaatagtagactcatggagtcaacccaggtgcccatcaatggtggactgaatgaagaaaatgtagtacgtatacactatggaatactgtgtacagccataaaaaagaactaagtcgtgtcctttgaagcaacatggatgcagctggcagcctaagtgaattgatgtgggaacagaaaaccaaataccgcatgttcttacttataagtgggagctcaacattggatactcatggacataaagatggcagcgatagacactgtgtactgccaaaggcaggggggtgacaggggttgaaaaactgttgggtactatgctcaaaaaaagaaaaaaattactaaaactcaaaccgtatacttaaaataggtaaactgtatacttaaaataggtgaactttatggcgtgtaaattatactttaataaaactatgaagaaacaacaaaacatctcacctaccctcttctaatcagaggcttctgttaatgttttggcacattttctctgtactagtatttctttgtagggatagttttttttaaaacatacaaaactcttggtaataacatttttatcatctttcatttaaaattataatgttttccacagtcattgcaattatttgtaaaacatgatttttaacttgggcttattatatgtgttcgaaagtatgtcttgaatacttttctcattttaaaataatgtcccagtagagtgggacatagaataaaaatgaaagttctccccttaatacttctcccacacacacacactcctacccccaattctcacttcactcctcatgggtaaccactgtccacagttcggttaaacaatttttaaatgggtatataattttgcatctggtgggaaaaaattgcactcaaatagttctcctgtttggggacatttaggttgtttccggactgagctctcttgtttaaaacataagtggcagaggattgcatacagcggtagaccatagatctaatggtcctatgttaccctggtgatttccaagtcaagggtagacattaaattagacattgaatttggggataactttctttttcttttcttttctttttttttagacagggtctcgcttttgtcacctaggctacagtgcagtggtacactcatggctcactgcagcctctacctcctgggctcaagcagtcctcccgcatcagcctcctaagtagctgtgaggctaattttttttctgctttttgtagagacagggtctcactatgttgcccaggctggtcttgaactcctgggctcaagcattccacccaccttggcctcccaaactgttgggattacaggcacaaaccactgcacccagctggggacaactttcaagtaagagaaggaacctagcatatgcagaggactcctatgcacaagaccccatgcttttcccgccttttctcatttaacgcaccaaacaattcaagataagggacgttaattctcattttacaaatgggaaaactggttctgaagggccaagtgctgtacacatccaatgcccatccatgtacaacatccactgcagggcttggctttaaattgtcataccctgagttgagggcttggtgattctgtcatggctcaggggactcttgctttactgtctttacttaattaggtgaactcagtttaaccatcacaactgtaaactgccattagtctttaaagaagcactgaaatgttactgaggttcttggtttaagtaagttccatttgtctatttttggctttgttgcctgtgcttttgaggtcttagtcatacattctttgcatagaccaatgtccagagagttttccccagattttcttctaggatttttatagttctgggtcttacatttaagtctttaatctatcttgagttggtttttgtatacagtgagaaagaggggtccagtttcattcttctgcgtatggctgtccggttttctcagcaccatttattgaagatggtgttctttccccagcgtatgttcttatcagtttcattgaagatcacttgactgtaaatatgtggctttatttctgggctctctattctgttctgttggtccatgtgtttttctttttgttattttttgagacaaggtcttattctgtcacccaggctgaagtgctgtggtgcgatcttggctcactgcaacttcgcctctcaggttcaagcgattctccacctcagcctcccgagtagctgggactacaggcacacaccaccacgctcagctaattttttttattttttggtagagacagtgtttcaccatgttggccaagttggccttgtaagtcgtgacgtcaagtgatctgcccacctcggcctcccagagtgctggaattacaggcatgagccacagcacccagcctatatgtctatttttataccagtaccatgctgtgttggttattacagccttgtaatttgaagtcaggtagtgtgatgcttccagctttgctctttttttgtttgttttgagaccaggtctctgtcatccaggctggagtgcagtggcatgatcatggctcattgcagccttgaaccaccctgggctcaagccatcctcccacctgagcctcctgagtggctgagactacaggtgtgggccaccacactcaactaattttttgcattttttgtagagatggggttttgccgtgttgcccaggctagtctccaactcctgagctgaagcgatcctccctcctcggactcccaaagtgctggaattacaggtgtgagccatcacacctggcctagctttgctctttttgctcaggtgtgctctggctctttgggctcttttttggtgccatatgaattttaggattttttttctaatactgtgaaaaatgatgttggtattttgataggaattgcattgaatgtgtagctcgccttgggtagcatggtcactttaacgatatcatttcttctgatccatgagcgttggatgtttctccatttgtttgtgtcatcttcagtttctttcttggattgctgattgttttgttgttttgttttgtgttgtgttgttttgttttgttttgtttgagacggagttttgctcttattgcccaggttggagtgcagagcgcgatcttggctcactgcaacctccacctcccagatacaagcaattctcctgcctcagcctcccaagtagctgggattacaggtgcccaccaccacacccagctaatcttttgtagttttagtagagacaggatttcaccatgttggccagtctggtctcgaactcttcaccccaggtgatccacctgccttggcctcccaaagtgctgggattgcaggcgtgagccacggcacccagccatgctggttgtttttaagctacggcttgagcacctaacatgcagtaaacattggacagatgctttatgtactttatatgctttatatcagtcctaactagtagcagtttgagggagtgtgcattctctttattatccagatgagggatctgaggtccagagaggaaaagaaactttcccggcataactgtcagagaagggactcagacctaggtctgtgtgactctaggcctgggctctaaccactgagctctgctcctgatagaatgagagtcagctttggtgtctccatcaccctgggcagccagactgtgcctcattctcttctcaccttcctcctcccagataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggtaagatggccaggagctctgggatctgttctcagttggctacaaacacacacacacacacacacacacacaccacacacaattgtcatctttatcattaatttgtagtgatattatacaaggtatatgtgaacaaattgtcacccaaaaaaaagctaaaataccacataaatgcacagataagagcaaagtcctctttgaccaaaacgctcgattcttacacctcccctccaccagagataatcttcattatcagtgtgacctttccagatctgtttttctgccaaaggcatatataaatgtaactacatgtactatttttaaaaattatatacatatacttgagagtgtatgtgtgtgttttttatgatatcacattgaatatgttctaaactttgcttttgtcattcaatatcaatagtgtgtcttggagagccagccacattagtacacgcagacttcctggtattctttttcactgctttgtgactatagcaaggcatacttaacccatgccgtgtcggctatttccagttttctgctatttcagcagacggtgctgccatgaacagaatcactcttacttctttatgcacttgggcaaggtttccctaggcagataccaagaagctggggtgtactaattttaagtgttagtagacactgccaaataccactctaaaatgattgttgccactggcatttttgtgaattcccttccgctcaacgtcaccccagcagagctaggctctaacttgccaagtaccaagctggggcttgggttttggggattttttgggtttttttttgtttttaatgtttgccaacgtgggccagacgtggtggctcgtgtctgtaatcccagcactttgaggggccaagtcaggtggatcacttgaggtcaggagttcgagaccagcctggccaacatggtgaaaccccgtctctactaaaaatacaaaaattagccgggcatgatagcaggcacctgtaatcccagctacccaggaggctgaggcacgagaatcgcttgaacccaggaggcagaggatgcagtgagctgagatcgtgccactgcactccagcctgggcggcagagtgagaccctgtctcaaaaaaaaaaaaaaaaaaaaaaaaaaaagtttgtcaacgtgatagataactagtaccagctctttgagtgaataaagcaaagaatcagaagggttgaaagcagcctcccaggtcgcccctctgccataccccttgtccctggatgtccagctgacacttcaggcctgaactttgccctacttcaaggcagtccatttctttgccagccagccctggtttctggaagggccttggctcaggccgccccacctctgccttgccgcagcctgacctgctgtctgtgtcctgctctctgcgagaaccacccacatacttgaagctactgttacagcctcttccccagcctcctcttcttcaggatctttctattgtaaaagtgtcttttacaaagtgtggtgtgagaaacaactatagaagaatctttcatttaaaagaaacactccatgtaagacattatccattaagtgacttatgcttatctatctaggctttatctaggcttatgattaatttcctttagaatttagtgtcaggcaagtgtttttctcccctgaagaattaatatgtgtcttccatcagacaatgaaagccacataaacctttttttttggccgtcttccaatgggtgctatttgtcaggtctttactataccagactccctgctttaaatgcagaatgcctcatctgatcttactgccgcgttttgatgggggtgttatctccaaagagcctgtgccaaatgtagtgcctgagaaccacaaccatcttcctctgtgagccttttccaatgttgtccccacctcctttaacatttctgacttttgtgttcattccctctcaggcttttatatcagatcacctcaaaccttcatgggagtagattgtctatgcagagtccgttctgaggttttagactggtttgtctttattatattttgctacatgttcatttattctccacctttgaaacacagtttccttcaaatctctgctcaatgaccttccctatccctttctttttttttttttttttttttttttgagatggagtctcattctgttgcccgggctggagtgcagtggttcgatctcggctcactgcaacctctgccttccgggttcaagcgattctcctgccttagcctcctgagtagctggaactacaagcgcacgccaccatgcttggctaatttttgtgtttttagtacagactgggtttcaccctcttggccaggctggtctcgaactcctgacctcgtgttccacccacttcggcctcccaaagtgctggaattataggcgtgagccaccgtgcccagcccctgtccctttctcaggattagcttttccctttggggaccagaagtttgtcaaagacatacaaatggttgccaacgatgtccccttcttagaagaaataaggaagaaattgatgagtagatgagcaactatatctgagatcatgccagatggtaatagtaattttggttcattatctctggcttctcagaagtaagagtttgcctgtggtgttacctgtggccccttgaagaggcttgtgggggtacgctgttattcatgagctgaccccagtcctcatggaaaacaggcaccagccaccaccaccagcatccgctcctttggggtactctgtgcctcctcccacactgtcctctcccactgggcctggtctgccttgtgcccatccatgactctgttggacttgggaggctgtcgatcttagatcaaaagcagagatgaatttggagacctctttctagatgcctcatgatgccacagctcctagccaccctcctcccaaacccaacgaatgccttttcctttgcttctcactgtgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctggtgagtggctggaccctggcagggcatcctctgagcacttggtgggtcagggctgtttgtagttctcacactgaccttgagaacccccatagcatagaagaagacacgtatgattcaggaattgttttatatacgaatacgaggaagttccatttcctgggtgtttggtttctggtgagtttctagggctgcatggaagagaagaggagctctccctagcaggcaggaggccagcaataagtagacgtcagtgtgggaccactcttctcagcccttcacactgaaattctcaagcatatgttaacaaagtgctttgacgttactctaccacctccgatccttaaaacaactctggagttctgtagggcctgctctgcccattttacggagaaggaaacaggctcagggacttgcccaaagtcacacaggcagaacccacaggcagaacttcctactgtaaacttaccccttcctccttccccttcccagttcttataagaggcagccctgcttggtgaaaggctggaacccttggaaggaagtcattttacatttcacggggattgcggtgaatttctgaggaagcccaacactgcccagtattaggaaggccaggatttattacaaggaaagtcacagaaatgagggagatgcgttcattgggcaggaaggcaaggccttctcctcggcgtggggggaaggcatgctgtcaactcctaaaatgacagtctttctcaagatacccagtgccattcagttcaggcaccagtgctcatcctggtggctgctgagaggattttaagcctacctggggatgtgggggtgctttctcaagggataactttaaaataagcccttgaccaggcacggtggttcatgtctgtaatctcagcacttcgggaggccaaggcgggtaactcacttgcgcccaggaattcgaggccagcctgggaaacatggcaagaccctgtctctacaaagaaattacaaaaatgagccaggcgtggtggcatacgcctgtagtcccagctattcgggaggctgaggcgggaggatcacttgagcctgggaggtggaggttacagtgagccatgattgcaccactgcactccatcttaggagacggggtgagaccctgtctcaaaataaaccctcagagggccagtttctgggcgttaccgatgcgatgatttactgtgctgatttgcacaggcccgcgtcccacgttgtcgtccccgtctcatttctcacttagctgaaacttggcctacaaaatcattactgaagcattctgtaatgtgcaaagtgacttaaatcattcagccctttcttttaagatttattttcagagagttttttttttttcttcatgtaaagcaatttctcacagctggcatgaaggccaaatacttcatttgaaaattgagaattatgctgtaaagtggctgttagaactaaagccttgggtatttcttaaattgattttaaaaagcccctccgtatggatatattgggaggtttatttatggaagggaggttagtggctgagacagataaacacccactcagagttacacatgtacatgcacatccatattttcgcatgctcctgcacatgtgcggatatacatacacacgtatacgtgtgaactctctgggcagactcggccccactcgcttggggtctgaaacagcctttgtcagggtcctttacacatggaagctgagaatccaaagtggaaattgacccagcttccattccactcgaggagcccaggctcaaacccctttctccttggtctcaaccttggcccgaagccctcacttggcttccgcttgtgcgttgagcctcagtgggaactttgatgttccactggtctctgcagcttgaggctgcctgccgcccacttggcgtctcccaagtgatgtgcctggcagggccacagccactacgatgtccccccccccaaattctcaccacccccctctatcccacatgctcagagtgaaccatgctattgtttgaccgtagccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggtgagccagccccccgccctgcgccacagctcgttcatcatggtgggcgttcaaggtctttctctctgtggagcctgtgtgagctgcccttcctctctcagaagccccgtcggctggcagcaccagcttcttagaatttgtcaaagcacagcgcaagattaaacacagcccccaaaataaattttggctttccctttagtgtttggtttggttttccagagatttgttgggtatgtggaagaacttctcagaattgactaagaattttcttggaaatttcttggaaacatttaaatgattagtgctgaagttgtgggagagtaatttccttctccatgtaagatgactagaaagagagagtgtgtttggttccggttacaaccccctgaagaagtgagacttcaaaagaaggccgtgctgcccacaggtcagctgtccactccttccatatgagggcgtctcctcccacttttgccacagctcatctctaaccctgctcctccgctcctcccaaaacagaaacttgaatggaaagtccattgctgatttgtcagagtggaaaggaccacttctccagaagaccgagttctccccttcctgttctgacatgtctgctttaagtaaatccgtatgcaccccgatccctcgaaagagagcctttcttttggttgcaaaagtttagagcgctggccaagctctccctcacaacttaacccctccccatatagggcttcaaacttaagttgcaagtgttgtgaaatgttttcaaaagcagttattgatttaagaacaaaacgcagccataggaacctgctcaaaacccgagtcctggttcccccatgtgatttattttagtttcattgtttgataattcattatttatatgtatataccgtaggcatatgattttttaaaatccagacaggagatgatcaaatgaaaaataagtctactttgcttcagaagtaactattgttaacagtttcttgcctgtctttccagaaatatttctttgtatgtcatgcatatgtttgttttttacacatggggtataccgtatgtctgatgctgcaccttgctacttcttccttaatagaaagtgtcacacattaacacgtataaatcaacctaattctccttaactgttacatggtattttgtcatatggatgggcaaaaaaatcttttttgctgtttcgtatttgggtcatttccagtgttttgctcttacagtgtcacagtgagcatccttagggtgtctttgtgtaattgtgcaaatttctcatgtctgtgtgataaattcctagcagtgaatttgccaaaggggaaggtttttaatcttgatatatgtagtcccaacgtgaactctagaaaacagtacaccaattcactctgccacccacagcttgtgattggtttctttcttaaatccagtctcagggctgggcatggcggctcatgccagtaatcctagcactttgggaggctaagacaaggcggattgcttgagcccaggagtttgagaccagcctgggcaacacagtgagacatcgtgtctagtataaataaaaaattagccaggcatggtggtgggcacctgtggtctcagctacactcaggaggctgaggtgggagggtcacttgagcccaggaggttgacgctgcagtgagctatgattgtaccattgccctccagcctgggcaacagagtgagaccctgtctcaaaaagaaaagaaaaaaataatcttaggctgagagactgattgtggcaccgcctgttttcagtgatgaaatgtgagatgattctgcctgtttcagggtcaggaggattctttgcttaaaaaattctgcaggttgcttcgtgttctgtggctatgattgctaagtaaatataaagtgtgactgagtctaagttaactaagtacaaattgacctggtaagaaatgacttctttagggtcattgaggcgtctttcagtttcggaacttactggttaaagagaaaagcccaggccttatttctgttctgagcccttttggaacaaggtagaatgtaaataaatacatggagccaagcggcccattcttcagcatctacatgatcatttctctgtttgcagaatgctttaggatgacttattgcttacctcttctaccctgcctggccttccaccggtgggtgagaacatcaaatgccaggagtgtggcccggctccagaacctgggcctgcctgccggggtggttggcacagctgggatgccccatgtcctgttgctggtcccagggtcagcaagtgtgaggctgtgccaactgggacaacagcaagtcagaggtggctgctgaaggcagcatccaccccttggctgtgtctcccctgactgcccctggaagtgccactcagctatgaggagtgagatggagacattcttatttatcacaccacccccgcaaagagggaggcctcgctgccctcccaccttggcttggcaccagagctgtgtcctgaagagcaagttgaaatccctgagccttggcatggtgggagcataggctgcccccacccccatctcagtagtcagggtcccccacagcagcagccactcagcactttggaatcattcttaaaacttttcaccctgcttccacacccaccagcctgcttggcctccagaaaatactgagatccgagatctcctctcccagatctcccaagattgcaacagaagccttctcaggatccctagcttccattcagccagtgggatcattctagtacttaaatcagattacgtcatacccctgcctccagctttttggtagtttcctgttgcacttagaacaaaatccacatctctccttctgatcttgggtggtggctgtgagatccggccccaactggcctctcagatgaagttcccccaaccccaagctcactctagccccaaccccagccttgccagcccctgctgctcctctaagctagcatttctcagagttttagcctcagcacccacgtgtttatctgcttaaaaagtattacagaacttaaagagctttcatttagatagattatatttatagatatttatgacattagaaattaaaactaagaaatgctttcaatatatacttcttgaataaacccattgcatatatgcataactaacatagttttctatgaacaataactctgttttccaaaacatagaaaaaaattgatcttgcacatttctgcaagtctctttaatgcctggcttaatagaagacatctggattctcctctttgcttctgttttctgtctgttgtgatagcatgcattctgtggcctctggaaaactcctcagtacacccctgggaatatgaacataaaagaaaaatgtcttactatttttatgaaaacaaggatttccagaccacactttgagacccactcctgtaaatcactgtggccttccctgccccagggccttgcactggatgtctgtacccagatgttggtgtagctgcctcccgctaacggctcaggcttagtttgtgtgccgcctcttcagtggccttttcagatcagctcctggctagggttgtcccctcccgccactgcattggcctggttccttttttttttttttttttgagatggagtctctctctgtcgcccaggctggggtgcagtggcacagtcttggctcactgcaagctccgcctcccgggttcacaccattctcctgcctcagcctccctagtagctggtactacaggcgcccaccaccacgcccggttaattttttgtatttttagtagagatggggtttcaccgtgttagccaggatggtctcgatctcctgacattgtgatccgcctgtctcggcctcccaaagtgctgggattacaggcgtgagccaccgcacccagcctagcctggttccgtttatccacagcactgaggttccttacctggctgatgcctttgtgtgcctggtcatagtctttctcccctgcagagagggttgcctgcgtgggaaccttctgtgctgtttaccctgcatctcagcgcctagctctgtgcccccacttagtatcgttgagtgaagaatgagcctgcatttgttatctgctcagccttggaacagagcccatcaaaggccttctcccttctctgaacacgggaagacaaggaaagtccctctggggccctagatacttggtggtttagtccatggaactttgacaagggaacacaaaggaactgagaaccgagaagaccttaagcagcatccctcggctaaatttctgtcaccaagcgagcaagatgtgtgtccaaggaccatgtacccaggtgacagatttaggttggttgcatatcaactgaatttcaccaccctcctcctactcagagttttacagaagccacagagtagtgacacggggagccgggcagtggagggagattcggtcatcagaaacctggcccaggttggcctctgatactgtgacatgtcaccattgccatcaagggcccgtgggtgctggggcgtgaccacttcccaccctccacaatggtgcccctccccataggccgcacagcgcatggagtccttgcttctgcctagataataattcacaaggaagaaaacaactctggctgctgcctcggggtggctgccagacaagggtgttttattaggacacatcttccgattttatctgcgggcccaggtaattgtcatagagcagtttgtctcccctttagaagctataaacgattgtatttgatgaaaatatgcctttcatttccttggatgagatattaaagtagtgtataaatcagggctaataggtgactagccactttggtgtatttttcttcttccatttggctcagaaaaaaaaaatcacaagttctatttattggctggttttatgttgatggctctcaccctcacagaatgttcagcttcacgagggattgtgcgtgcgcctggccaaggaggggggtcagtggcggccagtatgtgggggtgggcaggcatggccaggcctagactctagcctgagcactctgtggctttgagtgccatgttgctgtggttagtgcctcatggacctggcccatggcaacagctgcttctagagatagaatctgtcatgatgggcagggtgtccaaaactcgcctgcaaggccaccctttccataaactccaagtggaccagcagaccccagagcagaagctgttccccagaaatgacccaggggtgtcaggggctacggcctcccagaacagccttgctcctcactctgggctcctactggcccagaggctgcttcaggaggccgcagggaaccagagctgcttacaggtgttaccctggtgggttggtgggtgtgggaagggctggcagagcacacagctcagaggagcagccaggcaggttgacatctcctggcccttgcagatgagggcttagtgacatgacaaaaaagtgacctgttcccacctggtttaccatcaaccgctccccaccagcctgttaactccgggacagggacttctctgcctcttctgctgctctctccttaaaacccaccagcccctcctgtcaccagcccctctctgtggcccatggtcccatgcagtctggcccctgccctcttctgggatcagctcccagccctctctcccctcggctctctgcagatgacacaatccagcccttcagccgcactggctggctggctgtgcctcaccagggccaagtgcgtcccatttcagggcctctgttttcgtgcttccctccgcctggagccctctgcatggctggttccttctcagcactcagggctctgctccgatacctcaaaaaggggccttccctgagtgcccaggtcaccctagttctctgcacggcagcttgtttttaattgaggtgaaatttaacacaacataaaactaaccacttgaaagtgaacaattcagtggcatttagaaccttcccaagattgtgccatcatcctctcctctagttccaaaacatttccatcccctcaaaagaaaaccccatagccattaagtagtcatcgcccacccaccccccccgcccccgcccccatccagcccctggcatccactaatctgctttctgtctctatagatttacgtagtctgggtatttcatatcaatcatacaatccatggcctttcatgcctggcttctttcagtttgcatcatgttttcaaggtgcatctatccttcttttagctgaataatatgcattatatggatagacgttgttttgcttccaccttcatccatcaatgcacatttgggctgtgtctgccttttggctattgttgaatgggttgctgcgaacattcgtgcacaagcttttgtttgaacgcctgttttgttttcagttatttctggtatatacctaggagtaaaaagtaggtcatgtgacaatctaactttctgaggaattgccagaccgttttcccatggtcttcatagtccttagctttagctgaaattgcctcttgtattccttgttctctgacactatcctgcactagaatggaaggcacttggccagggggtgggtacagggttgtggggaacctcgtttgtcttgtccttgacagtgctcatggatgcctatgaagtagttgctcagtgaataccgatgtgtgggcggatggatgcattggtggatgggaggctgggggacagaggatggggctggaggaattgttcagtcttgttttcccaacagactgtaaacccctaaggccagggtatttctgtcttattcaggtctggtaccctgtgccagttggtggtggtttgggtgtgagctggcaagttggacttcatcccttaagggctaagctggactttattcacttcctgtcccagcttcctactgggtttggggctccagctgtcttgtggtagatatttaactcccctgtatcacctgaggtcaggagttcgagaccagcctggccgacatggcgaaacctcgtctctactaaaagtacaaaaattatcccagtgtggtggcgggcacctgtagtcccagctactcgggaggctgaggcaggagaatcacttgaacccgggaggtggaggttgcagtgagctgagatcttgccattgcactctagcctgggtgacagagtgagactctgtctcaaaaaaaaaaaaaaattttttttttgactctcctgagtatctgggccatgccttgcttttcaccggtgttatctttatcaaaggcacctaaaccggcagggtcagtcacgtgacccagagcacttaatagttccgtggaaaagcctcgccggttccagaggcagcccttggcagctgagtaacttaggaagaatgcagaaatgacagtgtgctatgagccagctgagctgaccgcaaagcctctgaccgccatccaaaaaggcaaaaagaaaattgatgtttcattcatagacatcagttcagacctcccctgagaataacgtcctaggtgctaatgtcatctcatggtggcattttccaggaactaattttttagtcctcttatttttcttgtttctgattataaaactggagccagttctctccttgtagctccccaaggcaaaaaataccctttctggagtcacacaggaagaaggacctggggcttcctccagcttctccagcccggtcttaaccctttcccagccttcagctcactgcttagagacttgggccagcaggttagtgaggcgggtccgtgagttatggaaatttgattcctaccctcaggccttttataaagcaaaatttattgagctgctaagcactttatgcattattcttgttcgagcttcccaatagccctcagaaggaagatgttaccattttccctttcagcaggtcagaaagtggcctacccaaggtcacaccagataccctccctccagcgtcagaccctgagtcccaccaccatgctgaaccaacttttaattcatagctaatgtgaattccccttttctgattttttttttttttttttttttgaaagaagggcctaacagcagccacctaaggcctcactggtaccaggcaaaactacgttgtcggctccaactctaagcatattttagacagaaaaatttgtatctatttctggaagtgtgagctataatttggaagaattaaccatgttgggcactttatatgcacaaattctatcctcccgaccaccctggaagctggtatcacttgctctgcctcacagataggaaactgaggctcaaagcaagactgcagagctcacatgagataggctgagatctgtacctccccttcctgcctctaaatcccatttgcttcaaggctggcattggtgcaggttgaatattccttatccaagatgcttgggaccatgagtgttttgaattttggatttgggggaattttggaatatttgcattatacttacttactggtttagcttcactaatctaaaaatccgaaatctgaaatgctccgatgtgtgtttcctttgagtgtcatgtcgacactcaaaaagttttggattttggattttcagatttggattgctcaacctgcaatgactgagctacttcgcatggcagctctgcctgtctcagaatgtcagagatcagtaggataggccctccttagagaggggcctcaagggatgcccctggtctagacagaatgttccctactcccctcttccgtcatccaccctggcataggcccacatcctcgtgccccaagacccacttccagtgtttcaaggacaaacctgcaaagcagcaatccagaaagatgctccgtcctgagaccaccacttccaaaccaggctagcggtgcagggctcgttcctgcacaggtttgtccctggtgtgcatgaacaaaaagcagaaggatgacttcaaaatcctgcctgaacaaaagcagcaggatttgagcccctttcaaagctttctggcaattgcctctaagagatcagccttcaagtggtggggcaggggtgtggggaacagatcctactcaaaaatcagccctgagctgagtccaaggggtctcctgtttgccaagcctcttttcagggctccagagcagctgtggagagagagagcctcagggaatctggagctgggctcacacagccagagaaggaaccgcgttcccggatccgggcctgcaaggtttccccactcacaacatgccccccaaagacactttcccaatagacacagtagcacttgtcatggggagccctctctcgctaaatatggacacagtaggcagggccagccatcttgcccagatgcttttctgggaggtggagggaggggaagaagagagttccaaagaactgagtgttgcttcactctttggggtcattacctaactcatactgccaaagcgactgtatgcccgggagccttctggtcataagagtgtgtcagatggcagggaacactccctggttgctaatagagaagcccgtgcagtaggtggggggagagaacaaaccccatatgcaatctgccatttgacctgggccatgccttagaatgttctgtaggctcgggtgggcccgcagcagggcagccatgccggcagcacagcacaggccagtgtcagtggcagagcgggtggcttggccacacaccccgtgtgctcaccagcacgggcctggccccacacgtaggatagagctctccagcctcatcctccagcctcctagtcaagcacatctagtgcataacagaaaagactggaagacaccaagaaaagatcgaacttaccaaatcttcccaccccagggtgtccatgatcaatcccagcatcctttttttcattgtttttcctgttcattcacaatggggtttcttttcccagcagcagagtatttgcccaggtgagaagcagcagaatgaaagcacccagcacaagccaaagagtatgggcccaagtcccagccttccacctccacgggaaaattgttaggtggccttgacccatttggttcaccttgttggatctcagtttattcatataagaaacagggatgatgctcgacaatgtgagtggacttaagaactgaactgtactcttactaatggctcagatggtagattctgttatgtgtaccacaaccgaaaaacaaaaaatgggatacaagtgtcacctcattaggctcttgtgacataaaatgagttcattcacctaagtgcccagaacaatgcctgacccatataaaacgtgcagcaaaggttaactgctcttgccattttgttgttgttgttgttgttgttgttgttagttaagggctgagccttgggaccccagaaaataggttccttttctacacattaatcaattagcacgaacaaaattacgaatgcagtagtccttctgctgtcaattacaaagacatgctgcagtggcacagagttgctctttcacaaagactttccctgggcgttggtaaaacaccggggtgtaatagagcaggcagaattttcctcctcacacagaagagatcctgtaatctgcctgaggccccacagctctcagaggctgagccagggctggagaagagcacaaattgggcctccagcccagcacacatcctgtcccctggggtgctgactgccatcattggcactgcgcccatctgagccaggcagtcccccggagcctcacaacagctctgggaagctagtgtcattcctcagtgcccagtgttaccagctcacaagtggccagccagggctccctggtttccactccgtgaaccgccatgccctccgttctgaagcatattcagaggcagaacacctggaaatcaggtgagctttgggaaccccacatattcttgctgtattctactccatcgtgtgaaccaagagtacagaagtcatcagagagcatgacttgcatctgtgtctcaagtctgtatctaaaggaaaagtccataaaatcacccaaggaaacatcctaagccttttctgttggtgttttttttctttgcttctgaatcatttgttttatcaaccgcaagttctcattaacagacaagtgataggagatgccaaggtgtgaaggcccctttatggcagaaaaccgagaaacgaaaaattcctagcccttaattctgtatgtaagttgataaaagtccatcttgatttgatttttgccttaaaatctctctgactagctcaaagacaatcccctggaacaaggtttgggaaccacttcccaagaattagagtgcctttgggatccaagaaaatgaaatgccagctgggcgtggtggctcacacctttaatcccagcactttgggaggccgaggcgagtggatcacctgaggtcaggagttccagactagctgggtgacagagcgagactccatctaaaaaaaaaaaaaaaaaaaaaaaagtgaaatgccaacatggtgaaatcccatctctactaaaaatacaaaaagtagccgggcgtggtggtgtgtgcctgtagtcccagctactcaggaggctgaggcaggagaattgcttggacctggcaggtggaggttgcagtgaaccaaggtcgcaccactgcactccagcctgggtaacagagcgagactccctctcaaaaaaaagggaaatgcaaataagcagtattgccgagtgcacagttggtgggaaggagagttagttcgtgaggacccactaagaatgggaaaaaccaactgaatcaaaaggcagagatgcagcaataatggtgcctcagagacaggcagaagccatttgattttccacgtggccgtttccttcatgctgctgatggcctcttcaaagcacggcagctcctgggggccagggtacgggaccgcctggtggagaagaattggggtagggaaagaattggcattttttaaaggaacttttacaattccaaggaagtgacatgacaaacatgttgacgagggtcaggaaaaggaaggttggctgagcaagcgtttactaaggcccttgatgaatcaaataaacactgcacagggcttacagagaagcctggggtcagggggagggactgtgagcaagtcttgccagctagtgggctctgtggtgcttctggcttggcacatgcaaaggtgtggctgcagggtagggatgaacagagagctgggaagctcagcagggcccgatagcaaagcgctttgtgagcttgccccatggttcgaattttatcctagaagcagcaggaagccattgaaggttctaagacagatcaggggacatgggtggcaaaatggacttgggttttaactgactggagttgggaagggcagaggagaagggtggagtgggaaggccacaagacacattctggccccttcactgcatgctcacagctgtgcgtcaggtgatgcccgtgggcggatgagaaaagtcccacaggctggggtgcggccttccttacctttctctggccatttgccacttacttgtactataggattatattgcttgtttcaaaaaacctaaatgaccactgttttcactcaacagcgtatcctggagtgtttttcattttagttcgcaggcgcaccctcattcgattttgactgctgcgatcatctggtcaaaccactgttcattgagccagtcccctactgatggatgtttaggtggtggccaattttttgtcctttaacaaataggcatctccaagtgcccttgcgcaagggtttcctcagggtaaataaccatgaagtgaaaacagaaatagctacgctgagaaactaacaggatttggtgaccaatttgactgagggagtgggaagccacagagctagcttaaggcaaaatcttaagaaggcttggtttccctccccgaatgttctctgtgcatttagctagcaagggcatctcgatgatcccaacttctgacccaacagtccttgtgtgtcttgtgggtcttgttctgtccagaaggccttcgggagttgtggtgactagaagggtccccaggaactggtgggggtctccggggtggcccactcatagcttggcttgtcatctcagacagaacctccaagcttggcatgatggagacaccagtgggttctgttcccacctcctggcacctctgctgaggttacagctttctacacttcttttctctctataaccagaatcccatgactaaaatacagttttctttatttgcagctgtccagccatggcatttagtataaatatgcttttctccaaaaacacacacagtattattttttttaacatctcaaattcccaaagggccaaaagtcaatattatcccagtgtgataggaatggctgttttgcaacatctcttcacacttacacagcctgcttgctgaagcctcagagtaatcacaaaaacacattccaaaacccatcagcctggctgctggattgttttactgtctctgtcactccctgctgtgagctcagtccttgaaagtcgccgcctcagtttccatgttgagggtgagaaattcacagcgtgatttggggagcagatgcttcaactgtatgaactgcaaagtttggactgtgaagtgcagtgactcctctgaaaatatttgctagctggtaaaattcaggctcatggcatatgtggtctacttctagccttacagacttatttaaggtcccaggataaaaatcctatttattgaatgccaactatgtgctaggcactgggctaggtgctttacacaaaataaggagataagtatgtaaatactgtataaagttattagtcctacttttatagctggggcaagcaagagtcagaaagcaaggtcccctgcccggagtctcaaagttcatccctggagagggtgcctgcttcttctacctcttctaccggcttcctgagaacaaaagttatctcttgtcctttgttctttctcttcctgctaagttgatttgaaggctctgcagagcttctggggtaacctacgtgcccctttgttgtggctttctgagcacgatgacctcaccggcccacagctgggtctccggtgctgggttccaggcacactccagcctcctggctcacggatgtcctgttgaacctcacggatggctgggtggcaggaagagtcagtgtggatggaatgagccttcctcaaaaacccccaccaccgctcttagtaacccggaaaatgctctgaaatagttgacatttacaaagtcttgggcatttggggagaaaaacgttctttttttggccagatttccagcatgaagcccaagggaaatgtccacgggctcagcacagtggtctagcatctcaaagcagtgcttggcctggtggaggccatggctttcccatcctgccctctctccacatccagcaaagaacaaatgcagaatctggcctgtcctcctgtccccaccatgtcccacagagtggccctttgtgctgacccaacacgaagcacctgaaaggcttgctcaagctgccggacttgagcagcttgaaagccaccatcatcagtgcacctgctgtgcccaggtgtaagccattgtgttgtttaaactgtgccacagccctgccgaggaagccattgcaatcaagaggctagggccacacaccctggagccagaccccccaggttcaaatccacacctacccctagacaactatgtgatgtcaggaagttctgtgaagctcctgagcctctgtgtccccttctttcaaatggggctgatgataggacctgcctcacacagcaggagcttagctgggccagcattttacatgtgagtgcttcacgttatcgtagtgtcataatggccactgctgttgaggagggagccagggctcagacggatagagctgcctgcccaaggtcgcaagctcaggggtggcaagccagcactcccagcttcatggccctggctggagtcacttgcagagcagttggcctggctcctccaggcttttccgtagggtcctcccaagtattctagccagtgcttttgggctctgccagccatatggacagcaccaggcaggtagagttctgagcacctgccctgttggagccaccatggaagtcaccatctctggcatggttccttcttccagccagtgcacaccaagtgcctcctgcaacccgtcctaggcccccgtgcagaggacagctcactcacaggaggcagacatggaaaaggatgaccatggggccagggggatacctgaagtggtgggggcctcaacagggcaagtcacccagagggttcatgccgccagagcacggggtgtggggggcactgggttgtcggggaccgtgggggatctggaggggtgcaaggagacatgtgagtttcattctgcgtgctctgggtggcctcggggccgcgaagcagggaagtggctggacctgacgcatgtctgtccaagctccttgcacgtaccgtgtgggaagtggattggagacagcagtgcggggccactggggtcccaccagaaaccagggcagctgggtgagggacggtctgggatgtgggaggtgcccttggctagcatggtcagtgatggcggtggggacagcgtgcctggttatgacagatctgctcctgagaacggcgctgcctctgcacatcgtgtagcagcttgggacaggcaaagcatttcccatttgtgatctcagtaaccgcagagcgtagtgaggtgggagaggcttgagaggtgagctgaccagcgcaggtcacacaacaggaagcagtagtgtgctttgcacttggcccccacactgtcctgaggttgaaaggtttaaatgactcgggcactggggatgtctgacagagcattctgtgagactcatcgagctgccagcactgggctaagtatctccacagcccaggttcacagcagggaggcaggtatggttactctccctacttaccgggggaggaggctgaggcccagagaggtgaggtaacttgcccgaagtcactcagtggtaggtggtgttgctgaaacccactgctaggccatcggacccccacagtctgctcagtccagtgtccagggatcctcctcagggcccgggaacctgacaaaattcttggccttgccctgggggagctgtagttggaagctgggggcactgtgatcatacttgcagcctcacatgcgtggctcctgggcacgcctgtcagagcgctgtgatcaagcaggcctggaggtgcctgtgcttggcccttggcactaagcagctgtctaggcttcatgagccgagtggcatttgcccgataggtgtgatgtgtcaacagctttttctcctgcttttcacagccccggctggctctgagctagaactcttttaaaaatcataataaggcactgacctgcagtggtacacactggtgcagcccaggcacaggagcctctgcagtggagatttaaggtctgctggtcaggagcaaatttagaatctttctggaaggttctgggtctggccaagagtgtagttaagcccttcagtgatgtgagtttgggacttctttagcttattgtcttcatggatctacagaggtaggcttctgaggaaagcagtggcttgtctttttattcattcctttttccagtaaacttttttatttttttggagacagagtcttgctctatcacccaggctggagtgcagtggcacaatctcagctcactgcaacctccgcccccctggttcaagtgattctcctgcctcagccttccaagtagctgagattacaggcgcctgccaccacgcctagctaatttttgtatttttagtagaaatggagtttcaccatgttggccaggctggtctcgaacttctgacttcaggtgatccacccggccttggcctcccaaagtgcagggattacaggcatgacccactgtgcccggcctatccagtaaacatttattgagcacctactgtgtgccacgccctgtgcttggggttggtgacctggtgagcttgcagtcttgtgagagtgacagacagcattcaactaataacacccattactaatgcatttataatacagagcctggctggtctagtagggatggggaagacatctttgagcaggtgagtgggcagatatcatgccagtcctcgtttgacctcagtagggatggcaccaggttccagaggctgaagaagagacctggtgccagcaaatgagacatagggttcatcaaggacttaatgtacagggtcagtccagtggcagcaggctgggtgggaaagccacagccgcttgtaaaaaccatgccacttatatagcagtttcccttagcaccctccccctagcaacctctacctggcaaccttcatttaacctaaaacaaagggcttaagtgaagctactgctgtcagctgcatctgccgtccagcagatcgtgggagtgttcctcagagcagacaggatagggaatagcatgtgcaggggcgcccagggtgagagcagagtaggctcccctgggtccccatcgatgtgacaccttctgcacttgaagctgttaaaggcatcttccattcatgcattagctcatcgtcagaacctccctggggaaaggtaggcatatgttcattttgcagttgaggttttctgaggctcagggtggttaagtaacttacctggagttgcacagctagtgcacagcaaagccagtgtcctatcctggcttggcctgaccctggcctcctgctctgtgttctcattttttattcttattccctatcctgtgttgttactgataaggctcagaggcctgccagaaggatcagaaccccataattatcaagcccattggaggataattctaagtcattgaccttaaatctgcaaacccagaaccttgccttgagagtgcctcctagccctgtcgctcggcactttctcagaatactactaggctggtcatctcccaagctaccttatccaccttagagtgaatacatctctgaaacttggtagggaactgcacccaaatgagcaaatcatgctatcccaggagagcaaggagctgagtgaacatccatcctcttggggcgtccctgcagcctgcagctggacagcggcctcagtctcctgttgccaggggtgacgaggcctgctcagctcagcatagcccttgggtcagctctttgctcctccaggcagacagctgtgttcattctccgtcctgtacctccacaacttctgtgggacagccaactagatgatcaggaagccactcaactggaacctcacaatggcaaagaaaagccaccctcccctcagctgagagggacctacaggcagccctaacagtgcctaggtgcccagaggcatggttcttttggaagtacggagccctcatgcctgtaggatcttccccagcttgaggcccacgcctgagccaggccagccctgtggtcctcggccctagctgtgcatttttaaaatcaccttgaaagcttttagaaaagcccaacatccaggcctaacccagttaagtcacagtgaagagagggccgttggtgacattctcttctgtaggagcagtggctctagcgtgcttggggtaggagggattctgggtataggagtgggatgttttgtgcgctggggccagtttcaggagaggccaattccacaaagcttgtcatgccttgggggacggctgtgctaagaactgggaaatgggttctggatggccctgccctcatggagttcatggtgtcctggggctaactcacttttgtaccagacctagagcagggaaggctctggaaggaagtcttaaaggatgagctaggtttcacgtggtgcatcccggcagggggaatgagcgggctgtgaaaaccaccatgtgcacatgggtcctgcaggcagcctgaggataggggtcagcaggagataaagccacgtgggaatggcccctgctcccgattacctgtcctggacttggttggagggcccagggaatagctgatgggcttcaagcagagggcgaaggtcccactctactccgaccacacacagcccttggagcgggaaaacagtcactgatggggccggccttagggcgggctacccgtggggcccgatgacccacacttagctggaaggaagaggcagccaacaacacttccttgagtcacacagctggagcccaaatccacccattagtccaggaccaaagccaatgtcatccgcggcctctcccactcctgcatccagtccctccccaagcctgtcagctctacctgggagatgcagtcatgacaaggacctctcaccaccacacctgtctcctgggcaaagggctgggtaacttctttaagcagcagagagtcaggcttttagggccatatggtctctgtcgcaacaagcctctcccattgcagccaaagcagctgtagagcatacgttaccaagtgggtggggctgtgcccccatcagtcttccctggcaggacagcaggtggctggatttggcccgcagggcattgtgtgctgactcctgaccttggccaagcctgggccggtggctttaaactcagccccactgttgctctccttgccctctatggtccattcttagcaccaaagatcctttcagggtgtgagtcgggtcaagtgtctcctctacttagattcttcgctggctcccatcactcagatgaaagccaaagtcctcacggtagccccacgttttacacagtttggtccctctgcacttcctgacactaacctcacccccgccatggtccccttggcccacttcaaggcaacttaaggggcctctccgcagccttgaccttgctaggtatgctcctatttggagggccctgacctgggtggcctctgtttggagaagtcgccctgggtacctatgtggctctgtccttgcttccttcagatcattcttcagacctcaccatctcagaaggtcttgccagatattctatatagtggcaaccctgtccccactcccagcactccaggggtctctaccttgctcattccttcagagcactcaacctctcctgacattttctactccttgactggccctgccctgtcccatcccattatcaaactgtaagctccaggaaaacaggcactgtgttttgtttacagctgaatttccaagtcctgggctataccagacatataggtagtgcttggtaagtactggataaatggatcgatggatggatatttggatatagagggatgaatgaataaatagatgaatatagaggatggataaatgggtaaaggggtagatggatgaatggatgtagagggagggagggagggatgggtgtagaaggatggatgggtatagaaggatggaggtggagggagaggggatggatggatgtagagggattgatggatgggtagagagggatggatgggtaggtggattgattggtgtacagggatagatagaagcctggatagatagatggactggcagatgggtaaatgggtaggtggctgctgggtggatagatggatagaggtgcaggaatggatgggtggatggccggatgggagggagggagggagagagggatggatggatggtggagccaacagatctttaatccccccttctgtgtgctaaacattgttcactggggactcaggggttagtcaaacaaaacacatcagcccctttggagctcatgggcactgtggacaccttagatagtctagaacttcccaccatgtttggtgccctcagggaactggcagatgctgagttaatgtccagtaaggggatctgacccagaccaggtgtctgggaaggcttctctgaggaaaggatgttgacctgggaggaggaggtagaggaagagcgccgagaaccttgtgtcccagacaggggctgccatagacaggagagcattgatgtctcagcccacaggctgcccaatccccaaggaatgaatatgttgctgcccgtttgacacctggcaacagtttggctaggcacagaattcccctttgtcatcaatttccgccctggccagataaggggagctgagaccccagtcctgtatcccaggtagatattcagcccagcatgccctgccgtggccctgactactcgcatcattagtacaaaaggaggaatttgacctgggatattttcctgtaatgaattctttggaaagggaaagttcttggacttgggcctgatttgaagatgaaatgttttgagccacgtgcaagagaatggccgacagaacctggagggcaaggttctctgaaggcgaggttccaggttgttctgcagagcagggttaggagtaaagtgtttgtaatcccctgctgcaagctctactcagaacttcttaggtaggggatgaaaatgttctaaattgattgtggaggtggttgcacaactctatgaatacacttaaagtccatgaattgtacactttaaatggattcattgtacagtatgtgaattctatctcaatgaaactgttgtattaaaaaatacagctctcaacttgtcagactgtcacaaagctgtcatccgacagcacataaagaccagattatctcatttgtgtcccattttgatcataaaatagttcaatgtatgtaacattttccttaaagcagtccaaatgtaaaaaaagaagttggaacctgcaacacattccggaataatttggaaaccttgatgcaatccagactcacctggcaccctttctcttccctaaaacgtgccttttttccatttctttttgactttgagaaaaaaactctgttcttactggtaaaatagcctcctgtttccttttctttcctgtaaattatgagataagtttgcatttcatacctttccagaaatctctgttgattgtggtctgacctcagattcatgatttctgggaaagaaagaattagaatcactgctgtgaacattagaagtgcggtgagtagttcgtgttgtggatttgagatggaaaacaggtgaccagtacctgtttgttgttccggaacttatttcctggtgctgctagatggtatgccggcaaccacgtccaactcatgccaatgacttttaaaaatgtcatctcaaatgccacatgttatgtcttggatgtagttagggctagttgtggcctttttgtatggtagaaacctccacctcctggtggaggaggtctggaggcactagaacttgacaatacaggtactgtttattgagcaattactgcatatcagacactgtgccaagcaaggttgtgtgtactcttctcacttaatcctcacaatgatgtatgacatagggattatttcccccatattatgccagggaaatggaggctcaaggctacaatttccattacacagccagtcagcatcagggctgtggcttgaacccatgtctgtctgccaccaaagcccaccatcttagcttatattatgcgcctccgtttccctgtccatactccagcctttagactcccaggccagtgctccatcccctgtatggccaggaaagcacagccatcttgtaggaccaggagcagttcaaataatgagccaacggctggcaccctttctccgagcacagcgatgcaccagaatgctctccctcctgtgacaggtgatgtgcgcttcagctcaggcccagaagagccacaaaagagaagctccagcagttctgtgtaggaggcaggatgtacttctatccatagaagggctctcatgattatttattaattgtgaaagggaagaaaaaactaatagagtttcccggaaagggatacaagttcaatatgataaactcccaaaaagcaatcaaaggccaaagagggcagaaaaataaaggacagggagaaagagagatggtgaatcaaagtggccagtatgttagcagaggccaggggaggggccaggcttcacagccagggaggtgtggggctgtcggagcacaagtcaccagtggtggtgagtcaggcaggcagcgggacttgaccccatggggtcactgaggccctggggatgagctgataacaggaatggatggaaccggtcagctgttttgctattactgcagacccgttgtattaatttttgtgcattaatacatgaacgtagaatattataaatgaaaactgagaagctacaggaagaagaaatcacaatcctatcaacccagaagaaagcattgttaatatttctgtttattttccacttctgtcttccctgttttgtctctttctctcatttaaaaaaaaaaatacatgagttgattgttgatttttgaaaaaatcaggctgggcacagtggctcatgcctgtaatctcaacactttgggaggctgaggcaggcagattgcctgagctcaagagttcaagaccagcctgagcaacatggcaaaaccccatctccactaaaaatataaatagctgggcatgatggtgcccaccggtaatcccagctacttgggaagctgagacatgagaatggcttgaacctgggaggcagaggttgcagtgagccaagatcacaccagttcactccagcctgggtgacaaagtgagactgtcttaaaaaaaaaaaaaaaattgcaacattgcaggtgcgacttaagaccccatcagttaccacccttcctcagtcatcatttgccttatttttatttttccagacccttctctgtgcagttgcatttcatacatgtgccagagctgatgaacagaacagagccaccaccccttctctgcaattctgaaacccaaacagctctgaaaatcaaaatatttttcctaactcgtatgatggcaaaaccaaaacctgccttcaggtatttatgggcgggtttattagagtcattgatgccagtaattgtgagtttatgttttcgtttctgcaaaaattcagtgtttggttttagctgctcacgacccagctgacagtgtaacgtaatacctatgtgtgccctacatggccttttacctcctaaagattctaaattccaagacatatctggccacagaggtttaggataaggagttaagtatggatctgtaattgtgttaaggtttgggcttcccttaaataaaatcataattctgtataccctgctgcaccttgctcttttcagacaccactgtaaatcaggaatctgtgttagcacttacagatttcacacattccttttcacggctgcatagtattccaaagcttggctacttgcgtttctttggctgagtgattcagtcatcctagtctttttctatcccgggcagcgttgcagtgggcatccttgggcacacctctctctgtgtgcacgtgcagtacaagaagcagaactgccaagtcacaaggttttgttttcacaacattgccatcatgtcagaagcacttccctgtactgtaaaatgcctcttctaaacttcattcttgatgactgcataatagtccattgtctgagtgttagtttcctgaggtggccataacaaagtcccacaaactgggtggcataaacagcagaaattgattgtctcacaggtctggagggtagaagtgcaaaatcaaggtattggcagggctggtttcctctgaggggtgtgaggaggactctggtccaggcctccctccttggcttctggtgttttgctggcaatctttgctactttttggctcatagaagtatcaccccagtcttgccttcatcttcacgtgatgttctacctgtgtgaaaatctgcgtccaaattttcattttttaggaggcacagacatattggattaggaccaaacctaatgacctcattttaactaattgcatctgtaaaatgaccccatttccaaacgaggtcacattctgagtctgaggtactagaggttaggacttcaacctaagaatttgaaggggacacagtgaaacacaaaacagtctgaatttgccagattttacttaatccgcttatactggccacttacgttgtttctactaccttatgaagcaccctatgacaaacatccttattcagaaatcttggtctacatttccaattattcctccagaaaccattccttagagtcagggggactgtccatttgtcaggctctgggtggcaccttgccaaattgccttccagaaagcagagtagggggatgcccacctggtcacacctgggcccttgtcttcattcacctgggctctcagatgactcctgcccagtgctccaggctgaagtcctctgcacatatgtgtgcgcctctgccagcatgtgcacaggcattgtttctatcaagtcacttttttatttctcattcctgccaaaaagagagagagtctatgggttaatagcaaagtagaaaccgtagctcaaaatgtctgtttggggcatgtactcttgcatctgtatagatgaatagagatttcagaaatactgggccctctgggcctcaggcattaaatcaatcagtgcaatttcactcacagggcagcttgccaagggagcccaggagagagtagcgacttctctgatttagttcagtccgttaagctcatggcagcctgcaccagctcactgttgcaaaaggcaatcaagtaatgagtactcagccactttcggggggcgggggccggctggggaaggggctctctggagcctttcaaatggagccaacttttgatagctttttagggtagttctgagagctggagacgggtgaggaacccgggaagtgagagcttaattaacggaactacagagaatgaggcagcaaaggaatctctcagagaaccagggggttttgtgtgtgtgatgagcaaaaggatagaactaggtgcttgagtactgccggctaggaaccagcattgaacagcagatgcctaactcagcacagcaagggccagcttagcacagagaccagagagcaagatgcgcggaaggataaatttagcctgcatttcaggggaaaacatcgatctcaaatgtagtgctgtcttttaaaagaaagtggaagccttaggccggtcatctgggacaatttcacttgaacagctaaaagcccaggaaaaacgagtgctcataaccagctcatgctgctagcacacccacaagatcttccctctgcaggcgggcggctggtgtctgcatgggtctgacagatggtcctcctgctacccttatctgttcccaggaaaaggtgctgccttgttttctggagagatttggggtttctatttctgatcccaaatgttcatcttcatgaggaatgacggggggcccaagctctgtgtttgctcagctgctggtccaggacattgacatctggtgggttgcacctgtcagagcagggccagtgccaatcccctctgttgtctagaagctgagcaaaagacatcagttactggtgtctgtagatagggttgttttgtttgtttttaaccaggtcccctgtagcattcacacagcatcctgagcattgtttctacctggtcaaagctaagggcaccactgtggtcccaaataatagagcacctgtcctaatgacgttcccacaatctcgccagtcaggtggtgacggcatctttcctccagcctccctctgacactgctcccctgtgtcaaaggggaagaaagtccagtctgtcaatatttggggcactaatcatctgcgttcgggcgccaggggtcattgaaaggctgagacgcttccaggaattcatggctctaaaaccgtggggctgactggaaaggatctccagcgagggtatgaagaaagaaacccaaatctccactccaccccgaccccgcagcctctgagcattgtccattgtgtcttgggttcttgggaagaaatgaagtcaatgcacatagtgatgtgggcccaagttaataataaatgtagaggaaggagaaaggatgttcaatatttaaacatttcagagcgctgtgtttgtttgccagttactgccctccgcctgcttcctggatgggttctgtaaaacggagccttccttccccaactgtgcaattggcatctgacaccagcgatttacatagaaagggaaatggtgccttttctaggtagtccccgtgccagcaggactccttctcgttttctgttgcctttcttgaaggaagaggatgacaacatagaaactaaggtttttatgacccctggagcacttgtgaggagttgacagctttagggtcatgtccagagttgtcttaattttcccagatttgcttctttgaaactgtctcatattttaacataaatgttgtgctttggttcttacctctaacagattaaaaaggctaaacaatgaaacgtacagttgtgtttaagaaacgtcactctaagtatacatactagatacgttccttaaaagttgcctgtaatgcagaattctgtgaatcaattcctcctttcttcttgacgcacattatagaaaaggaaaagcattccttctgggggagggaaaaacatctgaccccaagacataataaaatcatgcttaagaatacagtaaactttaaagtctcttagttaaaggaaatcaatacttttatgatgaaatattaataatactaaaaaaataagtcaaaactacaaatgcataatagctagggtgatttttaatgttggacacattagctcagcatttgtgaggaggaacaaagggaaaagagagcaacctagcccatttgagaagcccttctggttcctaataagtcccctttttgtgggtcatctgtcaagaagacacacacctccccataagtgccaaccttatttctaagcattttgttgaagctaccgattttggaaatgaaaggatgaatgtagctggagagaggaacacacacaggtgtgtacacacgcacactcctgcacacacatgcgcagacagggcaaagagaaatggagaattggggaaagccatttatttgtttgaatacactgctggctgttccctccgtccccatcctccatgaattattctggtagggatctttaagagggatggacttagagtagattgaaccatatgaaatggctgtttctgtaggtcaagttagttgaatattggcagttgcatatggttcaagctcatccattcaactctctatcaaagaaatgcaaatagaatagtcatgtgtcttgaatgcagtgtaacatgaggtttttaagaatctagatgaaaataacttcatttttctcgtaaacgattttcatataaatcctttaaacctagatatttaaagttcctttagaaaggctctctcatgtctcactttgttaactcctaaaatcttcagtcataacagctaatgtgaggaagacttttgttttgtgttgcgttcttttctccaaagagctgggccatttcttttgctacatacccctttgtctaaagacacttacgaaaatgaaagtcccaggacaggcgtgggggctcacatctgtaatcccagcactttgggaggctgaggtgggcggatcacctgaggtcaggagttcgagaccagcctgaccaacatggtgaaaccccatttctactaaaaatacaaaaaaattagacaggtgtggtggcagttgcctataatcccagctacttgggaggctgaggtaagagaatcacttgaacctgggagtcggaggttgtagtgagctgagatcgtgccattgcactccagtctgggcaacagagcgggactccatctcaaaaataaataaataaataaaacccaccactacaaaaaacagaaaaattacccaggtgtggtggtgtgcacctgtagtcccagctacacgggaggctgaggtgggaggatcagctgagcctggcgaggtcaagaggctgcagtgagccgggatcatgccactgcactccaggcttggtgacagagtgagaccctgtctccaaaaaaagagaagaaaatcccagttattgcctcattgggcccaagttccaggcaccgtaaattccagccgaggaatcaaaacagcgagtgctacctgaacatttagattgcgttaatgctttcatcctcacgaaccctgtaaggtgtggtggtgtcactctgctttagagtgacaacagtgctttagaggacacaggctcgtggggtgaacaggtcccctgctgtcacatgcccagagccacggcactctcctcaccaccgtatcctgtagccagagtaaaagtgacaagcctaaagccaagttgctgctcttcaggtttctcccctgcagatagcagaaggctcgtgtccagccgtccggttagccatgtcccacaggtctgccagggcagacgtcaacagagccctgtccacttaacaacctcagctgtgggtttttgaagcttgttctgtgctgttatccatcacggcctttctgtggctccgcacatactccctgattctatctgactcacatagttccagatagtatcttcagttcttgttgtagatgatgtgtcatagaacgtcatcagccatcggtctggcctagccccaatctgttaaaacacacggtaggagagactttggtgaggtgacccagctgcagaagttaactaccccaccctgcaaagtcggagtcctggcgaacacaagcaaatggaatgggtccacaggcatggtgctctctgccttgggtgcatactaagtatgtgtcaacggcaggtgccttttgcagagaatcaagactaattccctggcccctttgtacagtgccacctcctagaacacacggagcaggccaaacatgtcagtgtaggatacacactgtacggcctccctgcttctggccaaaaaggtcaaaatggggctgatgggataagagacttgctggggaagaatctggcgctcctggccgggcatggtggctcatgcctgtaatcccagcactttgggaggccaagacggctggatcacctgaggtcaggagtttgagaccagcctggccaacatggtgaaacccatctctactaaaaatacaaaaacaaaaaaaattagtggagcatggtggcgcacacctgcagtcccagctacttgggaggctgaggcaggagaatcacttgaatgcgggaggcagaggttgctctgagccaggattgtgccactgcactccagcctgggtgacagagtgagactccatctcaaaaaaaaaaaaaaaaaacacaactaatctgccactccttggccagccagaaccttggggggccatcctttgcaagcagggccatagtgacccaccctgctcctggtgcattcctgattctgctccagctggggtcagtgagcgcctgtgcctgggagtctcctgggtgctgtctaacccgccttcctcctgctgccgtttcagccctgctgactgccgcagtagagaggcagcccagatggccgctcccaagcttgctagtgccttggctgacagactgttgtggaggtctttgcttgctaatttacagacggtaataccagtggaagagggcaggggctgggcgaggcagggactgggtccttgggaatcaagcccagccctggcgaccttcagttctagaaatccaaagcaaggttgcaccactgcgagagattccaagatctggtccacctgtgtcccccatgtgccatccaaccctctgtggcctggataggtgctcatgtaagatgcacgcattcctcatattcacacagcccaaatgcccgcccccccccccacccaccccctgccggtagcaaaaggggcattagacttggcagccctcacaggcagaccttcacccgacagcaaaaacatttctaagggcacaattaggacacagagagaaagcaagatactgaaagaccattttttcttttctgcaggttttcaaggatagtgtttaaaatctgagaggatttatccatggataaagagctataggctaaaagactctgcaagttcccagctatttttgtatgttggacatgttatccgttgaaaagcaatcagaaataaaaagtatttaagcgttgtgaggtgcagcctagtcagtgatcagtgatgtgggggtcgcccatggtggcagctcaggcttggcccgggaggccatacgaacatcccttccccaggtgcctgatgtgtagacctgcgccctgggctggacaggaagtggcttcttcagcaccagtgcacaggaagaaaaccagatatcaccatttgggggcaagtccttcattgccccgaaagcacagagttttgtgcactgaaacagtaaatcatctgagacttattaaagggatactgaaaaggggtctctgtgcatatacctgaagctttcccaaacttcagggtcctagcagtgagggaggaaacttctggggccccccaaggctcctgcaggcccttggagtcactgctatctgaaccctgcccacatgtcagtgaatgcttttgtttctctttggtttttgtgtagattcctaagaggagtcccgggcaaggacccaggcctcacctggcccatgtcggtgtgctgttgctagacttgaatctgaaccctgcttcctcagcccccaacacgtgctctttgagcagccgtgggtagtttgggccctgtgccctgtcttcctaaggtggctttcctagggtagccccccactgagtagctcctagcccccgcctgccctcgggtattgctgtcatcttgccagggtgtaggatccagagctgcttcttgagtcagaagcacgaacaagaaggttctatgtcacctgcagatctttctagtaagccgcaatctgtccagagccaccagcagctgaagtcccagacttagtcacctcccagccccccatctctcgccccagggacctggcaggctgcactgggaggtgaaagggcagatccaaggaaggagccgacaaggggagaaataaggccatgcacacttgctgtcttcagtttgtgtgcgaggtcacagggccgattgatttttttttactgtttcccagcatcgtgatgggtggtgagaaaatatgaacactgcatcgtcagaaacctgagccacagcctcggaatgaatttgctaatgaaaggcaagctcagggcacccacgcctcatggtcctcattcacggcagagactgtggaaaatgcacgggttgcttctcccgaatcagccctcagcgggttttatattatgctttgcaatctgcaacaaccataaataagtgtaggtttttcttagggcaggcagctctcctgtccaaatcttagagctttttcctaaaagaggtctattgaaaactggacttctttgacacacctctaactgagatttaaatgtcttagtctcatacctcagactcaaaagccccccacctccagagtttggtcaaggaggccccaaggtatgacagacaccctggggttaaaaacagaggctggagaccgggagcagtggctcatacctgtaatcccaggactttgggaggccgagggaagaggatcactttaggtcaggagttcgaggccagcctgcccaacttggtgacccatctctactaaaaatacaaaaattagctgggcatggtggtgcatgcctgtagtcccagctacttgggagactgaggcaggagaattgcttgaacctgggaggcggaggttacagggagccaagatcatgccactgcactctagcctgggtgacagagcgagactccagctcagggaaaaaaaaaaaacagaggctggagacccctctggttgcatacaaacggctcacaagatagatggcctggcttcgctggcttggggtttcccacttcttaattttcaaaaggagtatgaatgaagctgtcaacattttcaaaatcaggaggtgttatgtcaaaatccagatatccagcttctcttgacaaactggagactgcggccatactgaggtccatgttctcctgcagcagcagttagaagaagctggaatctgtgctttctgatttgccccagtctctaccaggccctgccatctccctggcacaaaagctgaatgtcccatggactgcatgtattagcatgcctgcactgttgttttaatagaagagaatggtttctcagtgtgcgtgtgtctattaaataaagggaaacagatgacagatagagaggaccaccagtgttttatctccagcccctcctcattacattaccgggctggccagccttgccctgtctgattttcaaaagtaggatccacagaagtgtctagaaaggggaggggaaggccctccttggtaaggcaccatgccagcccgagcagttccattttcatctcatgtataaattggagtttcaccatttagaaaaaatgtttgaaaagggctgtcatagggcgttatctttgaggaatgaggttccatctgcagtcaggcagttgtgtctcccattaagctgctttcaaagacatgccccaggagggtttcatgggacagaaaccttgtgggtgaattggtgtgtcgtgtagatcgcctgtttttttccctgtggtcttagctcctaggaagctcagagttaaatggtgacattagcttcccatagcttgaagtctttctgatataacttttcaccttttattgtcgggttcttatttactttttgttttagtagctttcagtatttagtatctatggcatttaggcttgggttttaaaatataacataagccatctcaaacccttcctggaaacaggtagtatgtaagggcatctgtagggaatgaggctgcagggcgaggttagtgcttttgagttgagtggagaatccccaaattgaattcagagccaactgggttccttccctttcagctccctaaaaggttcctgtggaatcccctataatctcaggtagttttcacatcttccaagggtagatttttttttaagcctgaaatagttgcactttagtcacatggccagtatcctcagagtaattaccaagtgcaaagcggcaccaactccaggcaggccacagaggtcggggggcgtccctgctcatttggagattcagaaaacttttggtgcaagcccactagtttttgtgcctacacacatccaagcccttcccaccctttagtctctctcgggcctcgctctttctgggtcttaacaattgtgtgtaatctctgtgaccaggtgtgaacccagacaaaaactcggtcccatctctggtttctacccaaaaagtccacttgcaccacatgggaaagagttgaccaagtgtttcataagccctaggtggcgggtcacctccccacctcacttgcccctttccctctttcccttcagcccaccacacctagattccacccagcaggtacagggcagctttttctgcaccaaaaactctgggagccagcccgtcccttgtccctaggggacttaactcacatccccgcattaacaaagttttttccctaactgtatcagttaagattaagttcaactacatagtaaagataaactcaaaggggaagttaatttccctctcgggtaaaagaagccttgtagtcaagagatacacaaagacgtcagggacccaaactccttccttttcagtgctctgctgtccctaatgtgtgattcatcctcatagctcagggcagctgctggagttccagccattgcatccattttccaggaagcagaatggaggaggatataccccctttccttttaaagagctttccaggaaatcccacatgccacattcatttctatctcactggtcacaacttagtcacttggccacgactagcttctgggttctgtaactgcaaccgaaagggagaatggttattgagagacagcttacaatatcaagaacactgtccaaaaccctcttctttttgcttttttgttttaagccttcccaataaagtgaacaaaaccctcttaacctagaggattccaggtgctagctattaatgtaatgataatcatcacactaaatacctaaacatctttgcagtcaaatttcttatgccctgcttaggtaggccgactcctacacagccatcaaggccccaaggttggacagagctgctgcagaagcacaggggagagaatagttaaccctaccttatgcaaagactcctcccaggctaatgctgagctgcgtgagccatgaagaatggggcaggggtttgtaaagacagaaaagaagcaaaacagaactccagaccgagggaacggcctagcaaaggttgagagcaagtggttcttggtaggaggtctgaggactgacctaggctgctggaggcagatcgccatatttccacatccccactcctatgcacacccagtgattctggggttgtaggagggccttgactcgaaagatatctgggggttccagcttccctgagtcctatggatttgaccaacaatctaggcataaagagcagagattatcaactcaaacgcccacacggccaggcaagttgcaagagcagggacccagctctgctcatctctctcccgttgctgtcctgcaggaatggggccccataaagccagatcttttcattttttaagaaagcagaaatccaggtctgtgtgtaaaagctcccaacgtgtccatggtggtacctccaacaaacacacatataacataaataagcaaagcgaaactcgtgtgcaagcccctaggcggctgctggccggctctgaatcttgaatcacatggttaagtgattattggtggggaaagcttaaagacctgtagaagaggaggaggggggcatgtccaaggtctcgaagtcagtttgggcagagcttggactcaaacctggggttctgactccaagcccagctttccttctgtcagtgggcctaaaaatagaagactgaccttttcttggtatttttgtgcttcacaaatgccagagcgttattcattagttcatcttcccaaaataactggcagaacacggccagagggcaacaggaagactctgggctgcgccccccgaccgtgaaactgggggctcctgggaagtgggggatgtgtctcaccatgggcatagtttccccccactgttggagtggcctgcctggccctgctcttggtgagtccaggggagagagcttcagagggcagaacagatctcaggaggatgttaggatcgggagcttgagtctatccagttcccaggcagtttgtgttccctccatcatcctcccttttttttctctttttggtttaaaataaggtttacaataggagtcttggaaaattcagacaagcacaaaaaataacaaaactcactgcagtacaactacctgcttctctcactgtgtcagcttcaaatctccagctgccttctctgctctggacaagggggaaagagagcacaaattttttgcaagagcggaaacatatgggacatgctttttctaaccttttttcattgactccatcttgagcatttcccccaacacttagtcttctcttaccagcgtgttggttggcagcagggaatttcatcatctagagggattagaattcacttagcctttccccagttcttggacttatcagctgtcttctgttctctgttctgcacaccaatatgctgaatatccttgtagttcggtatgtgcatccacccacagtgtcgtctgcagcatgggatgctgcaggtgtggaattggtcagatggtgtgaaagtccatgcagcctctgatacacattttgcaggctgtccttgaagcatacccagggagagccaagactgttatcactggagaggatctcagggaggccggtttgccttcactcctgtcgcacgatctctggcttgtctgtgtgtttgcacctacttcgcagcccaagtgtgtttgattcatacaccaaaagcctctggcacctctgccaaagctagttcatcagggactgcctgactgggatgaagcaggaaccagaggacagggcgctctggccatagacattcaccctgaattctccccagcaccctcctgattctctgatgtgttgccactttgatttggggaaaaaccccttgaaattgcaggtggggggccttggccatccagcaaaataaaggaaaaaaaaagccaaaagtcactgtggctttctggtctcagtgccactggcaaagggagagagagtggaaaggagggaagtgggagttttagtagaagtgggtgagggagagatgtgttcagtaacctctgctcagctagaccctgcaaatggatgggatcggtagttggtgatttttttgtttgtttgtttgtttaactcagtacatgcagattttactgccaatctatgacttgatcccaacccattcccaaaataaaagaatttaagcatcctgactgcagtgccagcttctcatctgctaccctacatgtcccactgcagatgtcttttgataataaaccaggtttatgatgctgtaataaaccatggctttaaagagggcaagagaaaagacgtgtcttcttcaaatgggcctgtgaccaccttggcaacggctatgtcattgatcccttccagccggggtcattgtcgggagcatacaaggtgtaatcccaactctgttactacactggctggccctctgttcatggccctgataaataggcagctcgggaaaagccatcttgacattttgatttgttaaggggtaattcattttcgaggcaagtaaacagcttgtaaactggggggtttaccgctctaagtgattaagaagtgagcagctataaaactggttccatgaggctgcggctgagtgtccccaaggaatcttcctgcccagtgtttggatttgccggatgtttgccatagttcatctgagcgggcccccgacacacacacacacaatatatcacattgtgcctcttcctgagaactccagctacattcatcctgcctttctctccgcaagcagacctctgcggtaggtgcgggcaggaaataccctccacgcaagaggagctggtgctcaggatgaccgcctcactcggagactcaccctgctttcactgggccccatgcacttgccattatagtcagcgcttgttaagtcacccccaaaacccaactgggggtataaatagggcccttgccttttaaggagctgatctttagacgaaaacagcttcacatgaacctgagtggaaatagcccctccttgatggcccggagaagagtcctgctaagccctaagctgagccgcaggtcccatctgtaggtgaaaggaaggaggctgagggacatcagggacttgcccaaggtccctcagctgggaagtgagcagaggagggttaaatcccaggcttccctggtgccataacctgggtgtcatcccctgcaccagatgggcacactgcttctgtccagagccaggtaacctggcaaaaaagccttttaggctttgcaggccatgtggtcgctatggcaactgctcaactctgccgctgatcgagaaagcagccatagtctctgtaaacaaaggaccgtggcttgttccagtaaaactttacttaccaagcaggcagcaggttgcaggatgccaacccctgctaacaccctgcagccttcctgagtttcaagaaaggtgaggtcagggcctagagggccttctggaagtagtgttagtagagagctggaccgtgtgaagttcaggcagggcaggtggcatgaatggggtccagggctggctgtggtgaatgcattcgcttgaggagtgggaaggctgcaggagtgaccaagagggttgagatcccctctctcagctggaaggaggactcgcccccccatatctccaccgcaatttggggctgcttctgtgccacgaagcaccatcaccatgggtcctgcttggctcctaggggctgaagtcgtggcctgcagaaaagcacatgtccaccagaagaggggctcctgggccggataaaaggggctttgatttatcgtaaagaacacgtatcggccaggtgtggtgacacacacctgtaatcccagaactttgggaggctgaagcaggaggatcacttgagtccaggagttcaagaccagcctgggcaatacagtgggacccccatctctaccaaaaaaaaaaaaattatttgggtatggtggcatatccctgtagtcccagctgctcaagaggctgaggcaggaagatcacttgagcctgggagctcaaggctgcagtgagctgagatcacaccgctgcactccaggctgggcaacagagtgaaaccctatcgcaaaaaaacataaagaacaaacatgtatactgagctctcaccatgtgccacaccctgttctggggtgtgataatagttctttcattttattcccacaacagtgggagtatgtagtgatactccaggttgtggctgggaaagactcaagagaaacacaatagctgttcaagtgtctggtgcttctgtgtgggaaacaggggtgcacccaggtctgagtgtctccaagatgaggggctcgttcatccccgctgggtcagtttaccgcagaaacgtgtgggcagactccacctccaggtcccggagatgctgagggccatttgagaccatcatcactagctctttgccagggctttcgttgttcctgaacctgacttccctagaacctcaagggcagagcaaattctctggaaggagcgtccagggcactgtcctcctgcccgggtgtgacttcagagcgtgggtcccccaggtatgacttcagagcatgggtccggtgcccttccttggacaccatcagcagaagcctgagactctaccatgagggcatctagcatccctgggtgaacttgccacgaggctgcacgtccctcttcaagggcacagctggcacgctgctgagccagtatcaggcactcggatttacgactcatggccccacactcagctctgtggctggttgtactctgttccttgaaataaacctgtaataaaccttttccttgaaatagcttcaaaatgtggctgggtcagggccacgaccagtgaggtcagcctgttccagggaacagagcaggactttcaaggaactgaggttgggttgttcagtggaaccatgacattgaggccctcaggcctactctttgcttccacttggtcacctggtactttgtcttgcaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcaggtattggccacgtgactcagtgatatggggacatttggagaaccccgtgatccctcaccattaccaaaacccctgacctccaggtcctccttgtcacagcacttgaaggatgatgccgctcaggtgatctgcacatgaagcctctagagattcctctaacttgatgttccctcccaggctgggtcagctcccagatggggaagaattgctcctttttcaggccggtccccaccgaagctgtcactgactgcagagctgatgggcagcaggcgggctgcacctaaacccaccctatcatcacctccacagtcttaggtgtcacaaggaggggtctcccaaggggattgtttgcagtctaggaaaagaatcgcgttcctgctgattttttttttcctctgtaacataccagttttgtccttaaatgtggtgcggtccagttgttcgagtaggcacgcactttgccactctttggtaggatgtgatgaagtcgtatcttgccatccttcaacttattccacttcagacatggcacagagggaacccgggagtgaatgggagcccctggagtcagcctggaatgggacatgcaccagctcctcgttctcggctgccgtgagctattcgctgtgtgagatgtggggaagtacagacaccaggcctctggcacaacatggccccaaattgtagccagaggagcagggatgagcatccatggccttgagccagcaggatgttctgtgccccagcagcatccccccgccatgggtcggggggtcacaccaactgcctgcacctctgactggagatccttagtatccttcactgttcctgcaagttcccctccagagccctcactcatcatatttcaggggcacgtggcccacctctcattgagttctggattgattgatcatggcaggaggacacgggctactgcagagccagggaggtcgagggcccttggtcaccatcctctcagcaccaggagccaagatctccctgggcacctacacctctctcttgggcacttccagcttttgcatttccagttcatgcctgtggctcagagcaccccaacccacctgtgtctctcccatccacacacaatgttacctgcacttcatattgacttcacgaggcccaggcaggaaagtcaccccacagccacctcactgagagatcctcttccactcggcacctgctccagggcatgaccaccccttctgagctatttctgagcccaatttaaggttggctgcacatccaagcagatgccacccctgttgccaggcttgtagctgggaaactccagcagagcttctttcagaaactaagacgcaccctcagtagccctcttgatcccgtttcatgcttgctcaggggcgggcatgcagggttgtgtgttcatgcaccccaacgcacatatttaccgttgcactggggatgaaagcttccttgcccttgtagctgtggtcacctttctgtcatttttaaggacgtacagccaacagctaagtgaacaaacagccatatacttctttgcctaaagttaacaccggcaaagacccacagtatcaaaaatgatcaaaaatgggcttctgtatatggatgtctacctgaatgtgacccctgaggcttcaactctgcactttcccagggcctggtgtctgcagtgtgtgctagtttcttttttcttggcctccctcagcccctctgtccctacccccaccatcccctgcatggtaccagcgtaatgtcttctcatctcagaaatccagtggctattaacttggctgtcaggtggccaggcagttccagtcaataagtgagagtcaggacctccgaggtgtctgctcccatttggtgcgtccccagcaggcctgcggagacaagtgtgtaggtccccattctttatgcagcatgacagtaaaagcctgaggcccagcctgcctgtctggctctgcagacactgagacaactcacctgatgaagggccatgcccggtgggcagcctgggctttactcttacagatgcctcaggatgcagctattgatccctggcaggagagctcatcagagcccacaagctcctccctgtcttgaggccagacttctaggccagcctgcaatctccctcccagtccacccagaccaaagcatatgggcttcccatgttccttgtagggatgggcctaaccagatggctccaacatctgcctgctgttccagcaagccgcagaggagagaaagccaaggacaggagaagggagacagctttgttgggataggagcccttctgccagttgcttgatttgacattggctcagagtgcgactcagcattcaggcttctgatgagggaaggtcaccctgcgtggctcgctcacccaactttccacccaccagggacctggccctgatccaccagagatgatatccttggagggccagccaggcagcggggtgggccagggcctctcctccaagctcattcatcctaaccgcccactgccttcagcctggacagcagaagacagctgcagccccctacaaggggcagcatgtcctcaaagtggtttttgagggtacagtgctaagtcagaggcgatcccgtctctgtgattatggagcctcccagagtccaggaagctcccttttgtagagagcggctgccagaccctccgaagtcagaactaggaaaccccagtggcttctttgccattgatttgttttttgttttgttttgtttttttgagacagagtcttgcttagttgcccaggctgaagtgcagtgtcgcagtctcggctcactgcaacctccacctcccagattcaagcaattctctcacctcagcctcctgagtagctgggattacaggtgcgcaccaccatgcccaactaatttttgtatttttagtagagatggggtttcaccatgttggccaggctggtcttgaactactgacctcaagtgatccacccacctcagcctcccaaagtgctggcattacaggcatgagccatcacgcctggccctcctttgcacactttgcatggccaggtgtttggctgggcaagtacacaagatatgccatcccccaagtgatgagacaggcccagttttccatagctctagcccacggttttgaacacttgaattgttcaaggatgttgttaaaagctgggagtgaccttcatgctgttttgacagttggtgtggcccaggcacccaccaatcagcctaggctcctgctgtagccacggcagggccttctcagtgtgcacctgctgtgtggcgtcccagtagatactcctcctgaaattgagcccacctgtgccagacaccatgcttataggcacttcacagatgtccccttgttgaatcctgccacactccgcctcacattgtacagtagaaaacacaggggcccagaaaggctgtgcaacttggcccagaggatgcagctagccagcagaggagccaggatctgaagcctagccttggcagccctaaagcccatgccagcagaatatccgatgcggtttccaagactgtctcaggcacctccagggtgtcgcagagacccgggccccgatctggatcctggttggaggcagcccatgaagtatgtttctccttccaacgtgcgtggctgctctagggcccaagtgaaaagtcacggccccactcgtgaaggcctgctaacatgtacaaccccagccagcagaaggctgggtggtgtgaacccctgggggaggaaggcctggtgctttcctaaaatcagcagcaaagtggaccccagggagcccacgtgggttcatcccacatgaggcagtgaaaccagctgatgctcagttgggttttccgcctccagcctgcgtccagctcaggggaccttagatttcctgcctgagtttgaaaactctccacatttatcccaaacacgttctcaccttcccgtggggacctcagcctggctcccaggatttaggctcaggctgtcctcttggttttgtggacttgagacctgatccaagagatctctccacccgcccggcccacacgtggccttccaacctcttagtggctcatctccctgcatcttatcttccctgggtttgggcaccccactccctgtctcagtgaattattgttttccaagcaagcaggattaggataagtccctactgtgcacagcattcgggatacaatgtggcaaaaagcatgatcttgcaggcaggcggggtggctgaggcctatcaggtggccacccagaggcatgtgcagttacaaaccgtgacaaaggaaaggtgcagcaggttctgacagccgatgcagaacagtgcgggaggctcccagaggtggcatcgctgcagatgacagccgggggatgaggggttggtgaggccctggtccgtgaggaaggtggcctttgggtctcacatgaggccaccagggtcccaaaccacatctcctagagaccagtggattccttttgcccatctccctggggtctgcctgtacattctgtcttcccaaatgcagacgggccgtgggcaggggggaggacacttttgaggaacattccccatgcccatcagggccgcggcctatagcccagcggtagcttcaggcccagtacaggtgagggcctctcagctggaagggggaaggggacagccccgaggggtcactgactccctggtcacccagaggctccctccgtgtgcagcacctgcctctgagcctccttcgcacgccagaggcagagctatgggtgccctggagtggctctttcagtgctggccccagaccaaagggagagtcaacaccgaactccctgatgacccgagcaactgtgccccagggcactttaatggccagtccttttgagaagtgtggtgagatcctccagtgctctgtggggagagcccgacaccctccccacgaagtgtccaggagccaggcatcttgtcgcccacacatccagcagagctatcctggcaggcctcagccagcccctagtgagaaaattgcagggttggaatcagcattttttccccttaaacattttatggttttgagaagctgaacttgcaaagaatatacagcgggaaagtgaaaaaagacccaattttagaaccacatgtggggccacaggaaaacgttagaaatatcttctggtataccactgtgcacccacacagtgacacttctgcatacacacagtcacacatgccaatgcgcatgttcatacagccacacatacaaatgtgcatgcatagtcacactcccacacagtcacacacatgccagggcacatacacactcacacatacaaatgtgcatacatagtcacacacaccagtacacatacacactcacacatacaagtgtgcatgcatagtcacactcccacacatacacaatcacacacataccagggcatacacacactcacacttacaaatgtgcatgcatagtcacactcccacacacatacatgcacacagtcacacacatgccactgcacatgctcacatacacaaatttgcatgcatagtcacacacacatacacagtcacacatgccactgcacatgctcacacagtcacacatatacaaatggacttacatagtcacactcacatacacagccacattcacatacatgcacacactcatacagtcacacgcatacaaatgtatgtacgtggtcacacacacatacctgcacctacacatacacactcacacatagatgcacacagtcacatacacacacacactctgagtgagatgccgataggaaaaccatctcctcagataagaactctgacctacagtgagttccttaaatagcccactcacacctctgagctccagattagttggagttcacatacattccaagtgaactaccttggggaagacagaaaactgtttgatcaaaaatgaggacagtgtgaatgtcagcctgcttatttatttatttttaatttgggggagcacatagtaggtgtaattaaacattcatttttaaaaaacaaaaacggccaagtgcagtggctcatgcctgtaattccagcactttgggaggctgaggcgggtggatcatgtgaggtcaggagttcgagaccagcctggccaacatggtgaacccccatctctactaaaaatacaaaaattagccaggcgtggtggtaggcgtctgtaatcccagctactcgggaggctgaggcagaagaattgcttgaacccgggaggcagaggttgcagtgagccgagatcatgccactgtactccagcctgggcaacagagcgggactctgtctcaaaacaaacaaacaaacaaaaccacattgggttatgagtcatggccaccttgattgtcccctgaggttttatagaaagaaagacaggtctggctgctgttgacggcccagtgcagggagcttccccggcttccctcccatctggacccacccctgtgcctgtgtccaagagagcccccttcaccccaccacacctcccatttgggccaactgagagtcagatgacctgaaacccacccacatgccactcaactcggtcaccactgtcccgctggagttttaaggacagaaaccccaagtaagatatcgtcccttttctcagttttctctgtggcatcatccttttttattgtggtaacatacgggtaacataaactaccattttcgccgtttttcagtgtatagtccagtggcatctaaggaccttcacattgtagtgctctatggcgtcacattcaagctgtgtgctcacccgccttcatctccgagagtgtggtttctcccttcgcagtgagatgctcccgacgtttttatttcagccaattagaagccccactcggccacctggcacctggtctccgctctcctgctgtggttcagtcttgatttttcaaaggcacgggtcaccaagtcgctgcccagttaggtggctgagggagaggctcgtggagaggctcgtggagcgcctcgagcatctgagctttctcaggactcggagctgtgctgttggcgtcagcgtgtgacaccaagaacctcctcacttggggtcagaaatctgcttgattcacttagctggtttgatgccagtcctccagccacacaccctgccctcctcacactgtcctgaggatgccgggttttcgtgtcctgactcctgggccatgtctaaaactgacaggtgattctgttcttccgtcccctgaggcttccgaccaagaccagatgttgcggatgaacccatctttcctttccaacaggactccaccttctctgcccctaacccggttaagttgcacgagtgaacaatttggttctcagcgatcccgaccctgcctcatcctgggggttgcatggggggtgtcttctctgcatggggggccagcgccccatgcaccggtggccacaagcccatgctgggcactgccccacgaccctcgcccctcgtcagtgctcagcgtccgctgctgctcagtgtcccctccatgtcgcctctgccgtcccattgttaaaggctttctatgatctgtcgctgtgttttccctctagtcaggagtggcaggaaaggacgccgacgagtgttcagcctgtcggaggccgacagtcatggcggccactgggtttagtgctccgaacggcagctgccacggcacctcacgcacagtcaattcaggcaggtctcccctgtgagccgctcgggccgcgacgtccactcgccacgctgcatttccacagtcggcagggtccgcgctggcaaggtgggccaagctgggcctgagcacagagccatttgccaaggcggcacttccccattttcccccaaagttggttctccctgctccctgtctggcctcacctcatgtgaagaccagatccccggcccttgaccttcgcgacagtccttcaccttcgcgacagtccttctgagccagacctgtacagcctggaaacgctgtccttctctgtgacatgtgcaccagtgtcaggctcggcccgggccagaagcagatgctcctgccaagtcccccaggggtccccccagtttaggccatgggggttgggcggcagttggctggcaaagtgagaatttgtagaaagcaaccaagaagtctcctcatttcttttttcctttcttcccctagtcttgatctaagataagtggcaaattcagtcctgttttgaccggaagccaagagccatttccctcatagacacatggatggatgtggccccaccatctccctttctgagtggcacccacacagcagtgaggctgatccatgggccaccacccagcagcctggctcgctgtcggggccatccctgctgcctcccctatgacgcttcttctgtggtttctgatgcgcttttctccattggccgttgcgcttgtctgctgggagcctttgccttcttttgtgttgaaatcctattttctctgagctttgccctccacttgctctacaggtaccatccttttcttccccacaacactcagccccaccttttcccagcccagcacaacaaatccaagtttttgctggaagtcaccatttgcttgacaaggatgtgttaaggccccaccctaggcctgcagatcagtttctgaggtgctggccaggcacatgggggacctgctgccttggtgtcctcactggccacagccacgggatgtctgtccgctgcttatggaaacgtggccttcctgaatgtcccattaccccctcggctctgtctccccagcccgtggccaggaagtcagacttttctccaaatccctcatttcctgagcctggcctcaacttgtggccctagagttcaaaaacaccagcaggcatgaagccaaggcttcaccagtaacttttgcagctcagcacttgactagaaaaaagtgtcctcactgggtaattttccccccaatgaaaacctggcagagttctcctttttcacctgccttggttggatacccttgtagatcaagttcaggaagcagttcttaaacaacaacaaggccatgtcataggtgatgggtaagaagaggttattttttccctatttaaaaagaggctacttttagcggggaaaccaacccttttaataaaaattgttggtccttttcctgaagaagaaatcagttctgtgcgcatgctattgttagttggtttgctctttttgatatatttgcctacaaggtttccacatccctgattattctcataaccaaacaccccattaaggagcagggaacgaagttggccagcttctttgaatatctgcatgcaaatgcagacttgagcaaagagagaaaacacttacatcgaaattttaagaaaacgtgaaggtaacgcttggctactttgtctccagatggtaggacagtgccatttggggaattagtcatttctaaactgcctcctcagcagcaaaatttatgtgtggatccacatgtgtgtgagtttgtcacaggtctgctcatgcccattcgaagcaagggcagaggccaccagagcaggtgagcactgctcagggaaccacaggttctgaggaacagcaggcagatcgtgctaggtcagggcgcacgcctgagctgaaaccagcccagcaccgcaagccatccttactgaatggagcaaatcagttgaaattcaaagaaaccagaattcgcatgtagtgtttactcagcatttctgggctcagatcacacctcaaatcactttttccactagtgttcaccgatgcccattgccaccctcccagagcgaggaccaaagcctcatgcagtggtttcctctagatctctctctctctctctctcttttaaaaaagacattaggaagaaattaattgggctgggcacggtggttcacacctgtgcacatcccagcactttaagaggccaaagcagaaggattgcttgagcccaggagttccataccagcctgggcaacgtaatgagaccccgtctctacaaaaaactttaaaaattagccaggtgtggtgacacgggcctgtagtcccagctactcaggaggccgaagcaggaggatcacttgagtccagaaggttgaggctgcagtgagctatgatcatgccactgcactccagcctgggtgacagagtgagaccctgtctcaaaaaaacaaaagaaatgaaatgaattgtgaccttttagagttcatcttgcccagagtcttgtggggagaaatgccggtgtgtgctttgaaatccagtctgtctctcgtgctttcgctccgtgatgggagctctcttcctctccctcttccctttctatatgctgcctgcttttatttcgttctttgtttttccattattttgctttatgttccatttgctcttctgttttattttggcctgacttaaaagagaaaataaaaaactaaactggaatcacgttgaacaaaaaaaaattctaccatgcttcccgggtcccaggctgctgtcagactcttagctcgatatagcatcgtcagcacctcccgccatggcttggggacccccagctctgtgcaaatgagaatttgcctccaagcaggatgcccactgtcttcttctcaatgtttttaaacacccggcatctgaagtgctggaagatgttttccacaatgaattccagctgcatctggtgtttctgttcaggcaggctcatcactggaaggcaaatgggccagcatgtgtctgtaggattttgaaaagggccgggcacggtggctcatgcctgtaatcccagcactttgggaggccgaggcgggcggatcacttgaggtcaggagtttgaaaccagcctggccaacatggtgaaacctcatctctacaaaaatacaaaaattagccggatgtggtggcagatgcctgtaatcacagctactcgggaggctgaggcacgagaatcacttgaccccgggaggtggaagttgcagagagccaagatcatgccactgcactccagcctgggcaacagagtgagactccgccaaaagaaaaaaaaaaaaaaaagcaccaaggaaagaaattgctgctccaagaataactgcgttgggtggaacctcacctgccttgtcctggcgtggtttctcagtggcccctgccgggaagctcgggacaataatggcctgaggaaccacagcagccccttggtgggtgctggctcagcactttgaggaggaggaggaggagacaggccaaggttttgttttggttttgcaagctgaaaagttctacagaatttcctttttttttttttttaatattgcagtgggttccctcttgggtaaatgtcatcaaatgtatactctggaaatggcctgatattacgagcacacccaagcccatttacttcccaaacaagtatttatcatcaggcaggcctgagatttgcccacacataaagcctgtcagctgggtctctgcacccaggaactgtgctttcataagccacatgctgattttgcacaggccctgaattttcccctcatatcacaagtcagggtaaccctaggccctgctgtattttccccaggcctaagtcagactggattttgcaggttctgtgtccccaaaaggagtgagtggagccacgctgagccctcacgccagccagccacctcccacctagctcaccagggccgcggttcaggatgggagcacagggcgcagtgcgacggggtgtctcaagggctcagtgtgtttccggtttttctcccccaatccagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagttaccaagaa

SEQ ID NO: 2446 - DNA, 142256 bp, Homo sapiens
  source 1..142256: mol_type = genomic DNA
tttgtgactaacatgcagactgaataaactgcatgtttattccaggctcgtttagctggacgagcagtacagacagggctgaggctgactccatggccatgtgggcagaggtcaaacccatgatctctcttcctacagcttcctaatgtctgcgatgttggtcttttgaaggaggcccccacagagctgagcttgcttggttatctgggactgctgctcagtctgagtaggggagggtaatgaaccagtcaggcctcctcctggaggtgcccaacactggcctagtccccaaggctgacgaaacatggtctggcctgaccccaggacgtggggtgaggaggaacactgggcataatatagtagcggaaacaggcaagcctctatgggtcccttccccttagaattttagggtagggaacgaggaggctacagactaaattgcagaactatctgcacctgggcctctgagctcttcctccactcccagtggagccattctggggactgagttgcatgaggactagcagagggtggcagttcagtctggtccctgtcttcttccagccagctgtgttcttagctgccatacttctgagcttcctgggaacatgagaaagtctggcgactatgggggatggggatcattctgaaggaaataagggacctccatccctccttgccttgaagggggtggaaaggcagctcctctcctgaaggcttgttagcaggttatgggcccacaacaaaggggccagagtagggcgaaattcctccttcaggttttggggctgagaaggggtcttcatgggctgtgaggaggtaagcaggcctgagactgggtagagatgggagcggcatgaggggaaggtaagtcagttgccatgccacagccaaggggcctttattggatggtgagggcacataggagcaggcaggtggctgctagatggtgttgcacaccttctcagggtgcagtggtgcccggatgtccagtctgcgagtcttgctgtccttgtcgatgatctccagacgcagcttggggaggcgcttctcagcctggggtgagggcagttctgggcttttgagtagctgcttgtctgagtcctccaccgtgatgcgcaaagtacagccccctggcagcaggtcctgctcataggctgctgccagctggttcaccacacggcgttctacctgtcggtggggaggtgaagtggtcactccctcggcctggacccagcttggaggtcggcctccatcacttactgctagggcaactcagagacctcctttgagcctgagcctcagctttctcatttgccaattggggctaataacagctagctcgcaggactgcgctcaagtttctgaggctcccagcccagttccctggtcctagtggggttcatactgggctaccctccagcaggggttttacttggtgatcatgtgtttatggttctgaatgggcatccactctgggtgtgaatatccagcaaccaagctatagggaggcaggctgagagctcagggactgggtctggggggccctggggagggaggtgtggaggcgcctcatttctcaggctcctgtgctcacctcatgtttgatggagcgggcgccatagtgcacattgtagccgtcgaccagcacatctgccacctcgcggtcccagagcagcgtgatgttgtgcctttgcttggcctgagatgggtcagatagaagcatgcctgcatgtggcccactgctttccatctcttgccactctggcctgaggccagggccactggccccacaccactgtgctccaccttttatgtgtgtgggggtgcccccagtccagtgttccagatttccagtggctggctatcccgcccccacccatgggcagttccctcttactctcttggcccagaagtttagttccttgttgacgagttggatgagctccgagtggcagaaggggaggaagtagacgatctcattgatccgtcccagaaactcatccctccggaagtgagcctgaagggccaggttaggggtgggatgagctcagtgacccagagcgggttagggaaattaccagacaccaggggaagactggggaaattatggggcttccagatctttaggatggctaagatcaccctcccccaaccttaggctccagcaggaagtgccaagaaagacctcttactttcaggatagggcgaatcacattctccttgaagttctttgagatggtgatcttgtcacttatctggacatcccctgtggagaagaatcataaactgcttattccccacattcagggaactttgggggctgtgcctgccccttggcctgcccatggaaagagccctggtcctgtccatctgtgtggtcctggtcaaggtctaaggctctctgggcttcagcctggtctcctcctctgaccaggcactttcggaggcctttccagctctcaagtgtatgaagtctgcgattcctcagggtgggagttgtgtgagggagggagaggagaggaaacgtcaggattaagacttgagtcctgacttggaggaagggggctgcagggctcgatcttgaatggaaaaggtgacagacacagcttcctgccggatgtgctcctttttttcagcactctccatggcccacctacgcaggaagctgccctgggtgaacaaggctgtgtccactgccatagagttttcgatctgctgtccccttcttgcaccaaagcatctgtgtctcttgcatgtgcatctcctcagtcccctaagacactgagcagcttctggccccccaccctggtgtagctctgtccattcctgcctggagccctcttatcacccaacagacttgaggctttcttgaagtggggtctctgtctcttttgtctcaacccccactacttggtatggtgtctgatatctgctcagtgtcagctagggacagagctgcccactagaaccttcacctgggcccagggccccaatcccatccttccccaggagataggctggtggcttggtcactggaccagactgctcaggtcagccgccatacccaggttttcggcaatacggttacggctcatctccaaagcttcctgcctcagctgcagcgcgtgctgtgcgatctcgtcgctggccacattggaggtcatgatgaagatggcgtccttgcaatcaatggtcttcccttttccatctgtcagccggccctgggaagggaaggaagggagtgtacagtcagggagctatgtgcctgggcaggccttagcactctcagttctcacctccttcaggaggcctccccagagccctgtgtctccctccagccccagcagccagctgcttcctcctctgggttctccgagcactagacttgcaccttggctgctgtgctcaccgccctgcgctgcaactgctctccctactgagtgcctccaggtgaggctgcagttgctctctggcatctcttggggcacccaactatccctggcatgcagaagtcagtcacagttagccattcatttgtgcaaccaacacattttttggaggcccgctgtgggccaggatctgtggtggggtactggggtcccactgagcctacaacatgctcccagtatagagaagcagtgagatacaggaaacaagcactgaccatccaatatgttacgtatgataataaagggaagcccagcatgctgcaggaattcagaggagggtactttacatggctactgtcaggactagatgtggttatctggtgaaaattcttagtaaaccatgctgttcaaatgttcagagctattattactgtagtaggtgatatataatgaaacaggacaacctcttttatctttggagctgccgcctggcctaacagggataaaaaatgagattgcttctttaaccaccttgggaagtttccttggaatcttcagctctttctagaagggacaaaggaggcatctatactggagaaagatgcaccaaagaaggagaaaaggagcaaacagtatagggcagagacagaagaatgataaaagtacagtgttctgggaccaatcagttgaagggtacagagccccgctcactcagcgaacctcaagggcatgaccgtacaacagcactttatgtcatttataacaaaagcaatgatcagggactccttgagagcaagcaatagagtgacaatgccgaacacggacagggacttctactttcatcacagatgctctgcttagtgctttttgtgtacaaccccactccttctactaggaaagtggctccttgacaacagaggctgggtcttgttcatcactgtgtcccagaacagcgtccggtacagagtaggtgtttgacacctgcttgctggaggctggaatcttcacatccacccttggaggtaggtgcagttaggacccctacaaagaaactgaggctcagagaggatcataacttgttcgaggtttcacagctaggatacagtagaggcgagacttgaactatctgacctcagagcccatgcccttcctctgcaccaggctacagaggtcagaccaatggtgctggatgaatgaggcctcgtgctattttctttccttcgacagaattttctcagaattctgccaaattcagtttgatcctcactggagagatgcaactgggacaggtgctagggaggagatctacctgagatttcttttgggaagcagagaaagcacagctcccgccaagccagaaaccgtggctctggggatatacatcactgacctcagcctgttggctcctgcctgagccagggatgctgggccctgcccgagcttcagggttagcccttgcttctaaagccagtgtaatggtaaacccagtcctactccttaggagcaaaggagaaaggactgtgcatcaaccgagctagcttactgcatgctgggtgtagtttccagccttgctttccactggaccttggcagaggcctttgagaaactgttaattcccaaagggtctatacacaaggggcctggtaatccacatcctggagctggtcactctgctgtccctgccttggggcaggaaaagggaagcaagggtgcaagcagatgtccttgagcttttaccagcagcttttcactcttaccccactgcttatgggttctaatctaacagatccactgagggcagttctagttttggggaccaggtgtgtgtgtgtgtgtgtgtgtgtgtgtgtgtgtgtgtgtgtgtgtgtgtgtgtgtgtgtgtgtgtgacatgtccaagcatgtgcatatgactgtgtgtgtgttccatactcactttgcagagctcatccctaaggactgggttcacacactgctatactggccagagcaataacctagcagcaatttcattctcagagatcaaagctctgctcataactgggcctgaggatgggtcccaggtgggtgaggggagcaggtgcagtgcatgactgacccaaagggtgactttcagtgctcatgtctcctcctcagtttccttagcaataaagatgtgtctcaaacaggaagctgtccgtgcctcacctccctctaacaaccagagcgtgcacatcttgggtggggcttgaatgctcaccccagggttatggggctgctttcccactgtctcacgtatgactccttggtgggaggagtgggggctgggctctctggggactagtctctttctgggacttctgccctggggtcacctgtgagtggccagcagtagacctgcttggtgctttgatgagagcaatagggttcttacttttctgggcccaggcttgggagaactagactgggtaggggtgaggctgcttccctcacacctccagcctggattaggtgcccctacaactcctggcacttgctgcttgtccctagcgcagcaccgaccacagtggactgaactactttttagctgcctgtctccgcactcattggtcacgccaaggccagggctgcatctgttttgtcagtgtcccctctaccccacacagcgcctcatgaataaatgaatgagccacattcttttggttggctcttttttgtttttgagacagggtctggctctgttgcccaggttggagcgcagtggtgcaatctctgctcactgcaacctcagcctctgaggctcaagccatcctcccacctcagcctcctgagtagtgaggactacaggcacatgtcactatgcccagctgatttttgtattttttgtagagacaaggttttgccatgttgcccaagctggtctcgaacccctgaattcaagtgatctgcccacctcggccttccaaagtgctgggattacaggtgtgacccatcatgcctggcctggttttgcctcctacttctctggcgagtctgtcttgacttccctgataggtcccaaggctctgtgtatagccctcttttctctgcacattatacactccctgggttacagacctcatccattcctgtggcttccgttaacctctctgggctgaaggattcctgaactgctattttcagtcagacctttcctaaactcctgacccataaaactgatgaacggccccttggccatctccatctggatgtccctcaggtatctcaccttcaacatttccacacctcagtgcctcaccttcctcttcaatctgcggcttcccactgtgttcgccgccttagctgatggccaactggcagcagccaactggccacccttggctcctcctcctctcctcagtcaaccttctagtagtttctccagcccatggcctccccagctgtagcttgggctccccagcagtctccttgttaatgaccctctcccttctcatccattctttacacagctgcccacggcatctttgtaaagtgaaaatttgactgtttctttcttgcttaaagtctttaaaaggctccttactctctaccagagaaatgcaaacttctgtgcctggcattttaactgggccctgtttaccttacctaccttgtctctagcactctgtccttgttttccctctgcaatcgagcagtactgaccagctgcagttccctgagcatgccagcctgtttcatgccctgtacttttatacattaggtttctactgccagccccgccactctgttcacctagcacttactaaccctttgaaggtttgctaactactgttgaattaaaactactgttgaattaaattagtcaatacaacatttcccctgactttgtgggctctgggaatggttcaagtgaacatgacaagggcccatcctcaaagagcctaaatcgagtaaacctggatggcagctttggtcaatggaaccaagagcatcagaaactatagtaggctggggctgggggaaggggcgacaacagctgcaggaaggaattcctatcaacccctaaaaggcagtcagtggagtgaagtgacggaggagggggagacagggcttccatgtatggctgattgtacttcagtcagcagttgccttctgttttttgggccaagaatgccatcagaggtgcctctccagggagaccagagatcaaacaggccgcgatgctcaccctccctcagcggcatggtcccgtcccttgcgtgcttcactgagacggacctcgctcttttggccctagctgcgtggcagtcattcaagctgcaggatctagaactgggctgcctgggtttgaatccttgattctctctccccagctgcatgaccacaggtaaatgacttaatcttactttgcttcagtttccacatctgttcaatggaggccgtaataatagctagctttggagggttgttgaaagggttaaattgatacacataagcctctgaagacagcgaatggcacacaaaatgcaaaatgccagctactaccatgtctcctttccacctgtctaccaggcagagagctccaagagggcacattcgggtctggtcatagctgtgcacttgaatcccatcaagaggctggaatggagtagaggcctcagtgtacacgtgagtaactgagtatgtgacctctgaaggactggtctcttcttcctcagcagaggttcaggggcagggagcagctgaagggctaggaagatacaacggaacgggcaggggcaaggaggctgggccaggtggggaaggcagtgagcagctggtaggagatctggatctggatcttcctggcttggtacctgatgtgctgttcggtctggaggagtcccctccctgtggcctcctatgacatgggaagcaaaccacctttttgttttcctagggctgcaggagactaggtagaaaggtgagctggactcatggccaggtgctagctaatatagcccctgcatgagagaagagaggcctcatccccggttcagtccttggctcctcacgctctcttgatggagcagggcccctgaaaaggtggaagtcatcttcttccgtgatcgtaagcaatccctcgcctggttcaaggtaaacagtggtatggggggagaattggggctctgggatcagacatatctgcagcccaatcttggctctttacacagcagctgtggccttaggcatgtcttttataacctctctgaacctcagtttcttcatctgtaaaaaatgagctaatttctcccttgcctgttaggaatttttctacctaccttgtgaggattagtgataatggctgtaacgtctttagtacaggtctagtacacagaaggtactggatagaagtaagctcttctctccatttagaacttacccctacgagcaggggaactggacagtctgtgagaaccctcagattctcagaagagaaaggctccatgaatcagagtatcagcatctcaccattagcagcaacaatattagcattttaaagaactgcaggagacaatgtttggcacacagggaggaacaagagctgtctgaggcagaaggatttttggggcttctctgattcagcctcctcgtttgtcacatgagatctctgatgcctagagatgggcagtgacttgccaaggccacaaagccagtcaggagcagagctggaactaaaaattcatgtctcgctctcatggcacctctgccataccatgtctctctagaaggtgggctgagcagccacacaatttcaactcttaggcagggctggtcttcgcttgagtgccccacccaggccctagtgcagaggggctaagttgcacctactggatgaatgaatgtacacatgcgggagcaggaagccgaggaatgaccagctagcctctgggcccttgctttctgctgttcacagtcccccttatctccaggtgtccccccgctccatcctggcccaaggtgactcacctcatcaaacagctgcagcatgatggtgagcacatctggatgggccttgtctacttcatcaaagagcaccacagcattggggcactgcttcaacttcttggtcagctggccaccctcctcatggccaacgtagcctggtggagacccaataaacttggccacctggtagaaggaaggaaacatgctaggaaggcctttctgtgcttttagtttccaacatggggcatgcatgggaagatgactttatacgctattaaggttgcctctctcaacagagatgattggctgtccatctcctggtgtggcagatagatcttctctatgtttattcttcagagcaaatcctatgtgaaacaaatcagtgaccctgctgcacacctgtgctcccaacgacaaatcccaaggctgctggaattatctgaggcccaaatgacaagaccccggcagtcatgctgacaagccctccaaaccatgcttcaatcaaggactgtcatcactcacctcgtgtcgctcctggaactcggacatgtccagcctgatgaagccctgtgtggaaacaagcaagtaccaactccgtttggaggcaggaaagtgaagagaagggttagggaggagagcacctcaactatccccaaggctttcacaccacaccaacataagatcttctatctcacgctcaagatgtttttttctgacttcctgtctccttttctgtgcactcatttcctacgagtccctcattctcttccttaaaagacccaaatcatgtacctgaccttctaaatctgacttggggtgtcttctttcagggaggcctctcctgttctgatcaccacatcatccacccacccatccatccattccacgtttcctgagggcatcctgtgtgtgctggacaccggagttacaacagggaacaagtcttggtctctgtccttaagaagcaccccatcgaatggtgcagacatggacaaagtcagtcacgatcagtgtggactgtggtgcgagggaggagagaaacactcagatggctccagaatgcctctcaactctgcaagtctgtgtgatgcccgtgtccctttgatttacttttcttcaaaatgaatatattttaaaatgtatttacatttcttcatttcattaaaaaagatatccataacatagctttacagcccttttctctccaccacagggtgtaggggtgatttccgaggaagtggccccatgggtgagggccatggttagcccttggggaagagaacagcttgcattatgtgatctgaagagttaacacaggcagagtgcccactggttttcaagaagcattacctgattagggagctgtaaaggcatccacaggtgccctgtctagccacagccaggaccacagttccccacagtcccccgggctcctctcctactggcacatgcctccatctaagagacagcattcactgaatcctgcttctcctgagagccggtgatgatgggggtgccaagattctcagcgggaggtagctatgtctgaaatccagggctatattctagcttggccactggtcagaaattcacgccatgatgtacttttagttctttctctgtcctgtcattctacagctgagacacagggtggcaagaagaaccctgggctgggagccagggggctcgggttccagtcctagttctgcctgcctgtggagccttggacatgctgcctcccctttttgagctgcagttttgtcctgtgttacagaaggctcttggctcctctccctgcctcaccaggggtctgaggatctaatccaagaggtgggacagggcttagagaagttattaaggccacatgggggaaagcactgctatcagcacatggggcataagccagaaagcatttccagagggtccctaggctgctcagtcaagagatctgcaggtttcaggatttactgggtatttactatgtgcctggcaatgttttaggcaagctataaagggcttagaacatgtacaagtctctgaggtaagcactactatcatctccactttacagatgagaaaactaagtcacagattaaagtaacttgctcaaggtcacctgcgcttggcaattcagctccaagtctgtgctcttagccatcatgctacactgcctcatagcttcctctctgccaatcagctgggctcttgacagtcttcaccttgaagggtgctgagctttgtgtccagatgccaatgaatgtcggacgacagatggactatagactctcgtgcttacttatgtcaagtgacctgggttctcaccctagttcttctaatgatttgctatgtaattttgaacaagtttttgggcttgactttcttggccggaatcatcattttgatttcacatgatcttagtgaggcaagaacaataagagtaacatccaacatgtactgattgcttaccacatgccaagaacggcgtttaacattttacatcactatctcatttaaccttccgaacaatccagtgagactggcaccattatggagcctactttacagatgagaaagctgatgtaaacagaggtcctggccaactccacctagtagagtacagttgggatttgaacccaagcagctggactcagatagttgttctttatcccttatcatattgctactataactaagtcttttgggctccaccaccctaccttatgatgatatcacagaacaccattaaggttccttcccaaggcttattagctctagtaaggaaagttaacagagccactcaatttggaagaaatagtatacaggctaatgagagaaaaaaataagttcacagatctgataaagaaatcatataaatgtacaaagaatgcttctgaagcagcaagatctggaggtgtcagtgtctctttacaaatgaagaaactagggatcagagagccagaactagaattcacatcatcagactccaggccagtgctcatttcatttcgtcagctgtcttgggaggcaaattaaagggagcttctgtttggtaaaagtctattttacactgggctctgagaatgacactttccatacatcactctttgggtcccaggtacactggctacgtagcttaaagtccagggctctcttggattttgaaggcaggtctcaaacatgcctgtcatgtggctataaagtgtctacgcaaaacacagattctataatgagttgacccacagggctagcacaggcaggagtttcatagaagcaccacctatgatttaaaaataaaatacatggttgtttttatggagcttctcatgcctctcatctcccaatgtgaaatggggacacactggcaagtttccaatccagcttcctagagcagctgagaacaacggtatcacagtgaggagttgagagactggattgattctggttttatttcttcccctaataggtgaccttagataagcctaagaatgctgtagggcctcagttttctcatctgaaaagtgggtctaatttagcatccatgctatcttccccataggatcaaatgggagagtagatggggcactgctatggtaagtaggaagtgacgaataaatacaagtcaaggaataggcacttgctgtgtgctcaccatgatgtgatgacataagtgatgagcacacagcatcgtcacttgatgctcaccataacctaagatatgggttggagggctttcaccttgaggcaagagagctgaaacttcaaggggtaaagtttacctgcctagggccagtagaaagtagaagcaccggaacctgaagcaaagaatggttgctccagagctctgtccaccacagtgcactgcctccgagggtggtggtgttacttccttctgagtgaggcatgcactgaaggatgccaacatcatcctgcactggggtgaatttgtctcccattcagttgtgccaactaaaaaattacttgcattattagtcttttaacaagccccctctcctttctacatcagcaagtcagtagatactttccttctacttctactgtgtatgaagacatatgaagacagcttggataaggagattataatttgtaattaaatattaacctttctgacagtattaaaattaaaccactcagaattcttcatccctaatcaggtggttcctgcccataactacatcttccctaatagtcctgctagtttatggccctttccagagtgctaattgtttcaatcgctgccaacctgatgaattgacttaaaaatgctatctcggtcggagcgcattagcatgctatgcgctgcttcttgcttgcctgcttgtcaagtgggtctgctccaggtttggtggaggcagagcacagctactggcagagctagggggagtttaagagccttcagccatttatgaagcagaagggggctcaggaggacacaatctgagctaccttgtttctgtggctgccagtggggcaggcaagccagaaagagaacaggagtccaagactctgtgctgctggggccacttggctggcagaggcccaagaaactcctcattgccttggccagggaggctttccttagaaaggcaagagcatctggggtctcgggcgacctcctgccctggatgctgggaaggctggtaggagaatgtttggctttcagtgaaatgtttttgcactctctccgaggactgctgtctctgcacaaaagcatttcctttctccctaaaaagttaaactgagcaggccttggaaagcctgagtgtgaacaaacaggggatggggatggccctctcctgtggagaatccagggctctgagccatggaggaagggggactataagtatcccaggctcaagacataagaaaccatgtttaaaagctcatgcaggatagtgagaggcaacaaggcatcctcttattcccacttgttttctcctacagcccccaagactcccattagcacagccatgactgcactgaacagtaatgttgtctttctgaagctgtttccccctccaacctgagctccttggagcagggggagtgtcttaataaatgctgtattagcagcatctagtacaacacctggcatggcacagatgcttgaaaatgttgtatggtagatctcactttgtttcctcaagagtcaggcagggcaaggattattattcctattttacagatgaagaaactgaggcacaaagaggtgggataacttgcccaaatctctggagcaactggtggccaagttggggccagagctgaggtctgcttcctgggtcagggcccatctttttgattgcctattactgaattcagagggtcagattttttgggatagcaggaatggtgaggtctccacgatctgcagatcagacctaggtcccagttcttacctttttagcatctttgtgcatatatttggctgtctgcttggccagctctgtttttcctagtaagaaagaagggggaggtgttgggttagaaccaggtgactaaccgctggaatgaaagaatactagaaatgcacggacactagaaagaatatattctatggatgagaatgttgaggcgcagaaaggatcagcgactctcccacagtcacctagggagttaatggtgaagctgggaccaaaatcaaagtctgcacctgcatcttaatttttctgggattgggattgaggccttttctctgtagcaccatcctaagagtgacaggctgactttataatccagaaccaacttgctttttaaagcccagtacaaacctcacctcttctaggagtccccaggcctcctggctcactgccctgcatccctctcaatacccacagtcctgccatttagccaggccctggaaccacatggcagatagagggtgggaggggctgaagagtacctctcactgtggcttcacggtccttctttgtaacacagagaaggaatgacaatactgaagtgggggctctgaagggccatttggtggatggtaacctttggaagtccctgactagtataaaagtcaagttctgtagcatcatggtcaggtggtggtatccttttgggggcctacatctgagggagaggcccatgaagatgctgggaggggaagaggaggaaactaaaccatgaaatttcccatcaggttcccttcaggttccagtgcttctggtgggaggtggtagtgaaggaatgggggggttctgtcagggcagagaatgaaggggtaagaatgcctcggataatccagcccaactggctagaaaaatactcaacccatcttactgcaaccaattttgctatccacctggcaccatggtggtcattaggggccttctttagcatttacagctaggctgtactgaacatggttgatgtgctgggcagaggaggtggttcaactgttcccgaaggggaggctctgcgcatgcagagtggctggaccagggttaatgggccctgaagggcctggtcctccatgtgaatcagtcttagcaccacaacttccagagggaggggcatattgcagctcttcataacatgacagatggtaacagagtcctctttcttggtggctctgtaatctggaggccgttgcttttagagctcaagttgacctagagctggacctgctgaccctggcccgcagcagctggggctgtcagacttgggccgggcactaccctagctctctgtccccactggctgatctgctcccaattacctattccagatgatcccaagaagaggaagaccagagggtgttcttcatcgtaccagccattctccttcctccggatcgctacggccaaacacacaagatcaggggacagggagggaggcagataaatcaatgacacaaaaggcaggataattatcactaagtatacaatatgttttactgctctgcgcccactcaaagtcctcactaccattagtgctgcctaatctgattagctggcaaggcccctagagacacgtaatcaggttagcatggatttggaaagctgcccagagcagatttcggataaagttttccaggatgagcactcagcgttgctagggaaactgaaaggcgggtggatggtgaatggaggtgaagggggtgggggactggtgaaggagaattcgagaggaacttctgctctcactggttactcatctactcatcgctagtgggactacgggccgcctcctatgcaaatacaagaggcagaagcccatggcaggcccttggggatgtggggtgtgagccctggactctttcctgtctggggaagctaaggtctggtccactgtctgggtcagaaagtggaaacacagccaaatgcattttctggaagtcaatcaaaggcaatgtggagctcagggcatggaaggggtaagccacatggttaccagagatgctgaccatagcctccagtggtggagggagtggggagcacggggagtgggacagataggtaccaggttccttggaggctcaactctgctagagcaagacctgacctcctcttcaagaggacgtatgtaattaagggctatgcattcaatctgagaaaactaagtgcttaattatggagtaggagaatcaggctcagaaacattctcaagtatacgagtgggggtggagtgaggcagaactgcaagaagaatcatgcactgaacatgctgtatgctaagcacaatgggaaaattcaccaacaacgtatctattcaagacccacacaaatacccggagaggaaagtagtattctcaactccattatactgaacacgaaactgaggcaacagatagagacttgcccaagtcacacaactagtagatggcagagttgcttctctctctaaacctgtcgtctttttttaaaaaagtaacatatggctgctcaaaaaagtatgaattttggttgcactaatggaaacacggcagtcaggagcaggaaagagagtactgtgtaatgtcaaggtcagtctgcaaatggaacagcatgtctgatctggtccccagggtgtcaggggaaaattagctaagggatagatgtcagagaacaaggcctggaacactagtcaatggggaaagatttgacagtgtttgggatgtgtctgcccatcttgagttgccaagatcctaactactatactgtgtggttggatttcaaagaaacgactgcagaggtctgggaaggttctctggaagaggcaggactggtgatggatcatggaggatgggcaggatttgaagaggcaaaggtggccagcatgtcagaggtggagagacaggaatgatcatgaggagtggtggggtgggaccagactgtgaaggtctggaatactgttttaggagttcagcctcaagccagtggtctttctcatctcgatctctaatgttcctgcctaaaatacgactttctctctacttctggcctcagtagaaacagatggaagctgtgcaaattcatggacatcagactagccacttctgcctgcccagaaaatgctccctgagaatcctgaaagaggcctgagaaaaagctcagtataacctctctcctgggcaagaatccagattttgtctaaactaactggcccaggatctctggaaaggctggctataaggggaacccacagacctcataggtacctgaatgctggggatgaagagggaaaagtgcaagcttggctaagcggggagtccctggtgtccaacagaaacagggagctgagagtgtgggtatctgaggaagtgaagatattgaaacggcaaaggctagacttgtgaatactgtgtggacatgtgtgtacgtgttagggcaggggtgacagcagtgacgtgaaaggagccgtgttcttctaaaagttggctaaattaagagtctaggttggaaacaagttgagcatgaactgagttcaagcttcatggggtatttggggagggagatgtacccagacatccccctacgtgggttctgcagggtatcatgtacctggggttctgatcctgccttttcttttaaggtagcatcccagcccacagagagctgcacactgctgggctgtgcagtacaaaaacaccatggagaatgaggaattgaattatgcctggggccactgttccccgcttcttttctaagaatgcacctgggagagagctctttataatgccaggcagacttcactgcacagctgtccctggtcaattctgcccgacctagggcatgagtccggggtgggcttgatgtgggtcccctgtgaaacaggtgaaatgccaaccattaagcaattccaactctggatatttctaataatatctgaagagaaaaacagccaagcagatggagtctgacagaatgaaaaatggtggcagctaggaaggactggagaaggcgggccctagtgtttgtggttggcagggtggccgaggaccaaggctatgggccttgaggatcccgtcaggccagagtagaggctgggacagagacctgcatgggcccacgtgggaggtggccatagttgttgttgctctcactgtggccagcaaatgtatttacaactgactcacttcaacatttcattgttgtctataaagaacttctgtagacataatttcatttcagccttgtgaggtaagcagaacaggggacttgatttccattttataggtgaggaaacatgcacgcagaagttaggtgacctgcttaaggttacagggggaagaaacaaagaccctgggctttaccctcagttctggcttagcctgagcctgcgctgtactatgggagcttagaggaaggtcagctctcctcctctgactctccgctgccacagcacctcctcacaccctgactccttggaaaacgttctctgtagtcttccaatctggcctgctcagccattcagcacatggcctcaggagcccctgtcccctaaccctgtcttggtcactgctcttgggctagagatggtgtcagggccctctgcacaggcagcctggctcccttctctggccagtcccatcgccacaagctccaggcaggctgctctgcctcccagcaggtagtgccgggtgcccacctggcttgtgttctgctttctcctggccatgcttgtcactactggaccatctgaaaactcacctgcaacagctctttttgattcactccaccacaccacatctagccattaacttgcaggtctgtattctctggcatgcattcatctaccgggtggtatagtggagagggcaggagttacaggatctagcatggagtcccgcctctgtcacttaccagctgactgactttaaataaaacacttattcctttagagcctccgtttcttcctctataaaatgggaacagtcacatatactgtgtcagccccacatgcagattaaacaagttaatggtgatgaaagcaatttgtaagtggcgaggagtgggataacaataagagtaaaaataatggtagtcatagcagcagcaatggtagttaccattagctttggtattttacagtaactctttcatcctcctaataatcctgataagtaggtgttatctccattttacacaggataccgaggctcagagacgggcagtgtaaggtgtttcatctacctgtgcccttgtgtctggcagggagggtgtgcccccaatctgaccatattccatgggagcaggtgctgggtgtcctgggtgccctattttctgaggacccctgagactagcccaacactggtttaatacttgctgactaaatgaattattggtctttctcaaattgcaagggagaaagaacaggtacttcaactcattttacagagaagaggagaagagtaaggcctagacttgagtctcttagtgccccaggtagttactaccactcttgcatgaagaaggcttccactttcttctaaatccttctccaggaagccttatgtatttgtttagcaaaaaagctctgtgctaggtgcggcggctctcacaaagaggcctcaaaaaaggtgcgtgccatagaggtaaaggctgctatgaaaactgtgggctccaaacgggatgggtgcacagagggaagtatgggaagagccatttgtgctggcctgacatttgtgcttgaagggtgagagggagattgccagccacttgcaggtatgatgggacattccaggaagaaggccccagtgtgtgtacaaccaaaaaggcaagagcggcctcctccttccaccccaggcctttgtttctgtccagctcaaggttctagggcagtctgggtgggctgacttacctttcttgataggtgccagggatatagtgtgggaggttttttataacctaatctggaacatgtttgtcacatgtctgtggcatctcctagtgggaaccagtccttcagagggactctcatggttgagagtcatacaaatgtttatcagcaattgcctgacaactgcttgtaggttcaaggaacatggtaagtactcgacaggtgcctactgagtggatactgatgccttgggtttggtggatcatgaaagagctctcttcttagtccttagtaaggattattctttctgcaggcaaactattgctgccaagtggttaacaacttaaaaatgcaagtagtagcttcttacaagacctaacattgtgcgtgagctcaggcttcattcactgagttcaacaactttttatacacctgtgtgcccaaccttacagaaaaagagctggtgtgcagtagctctggacttttggagggagaaagacatacaaacatagtagataacatgtgataaaggtattcctaggaatcccagggaacgagccctgaatccaggaggactgaggagggcaacctgcagaaggcctaggtctcttcttttttaaatgggtatttgtggggtacatgagatatttcgatataggcatacaatccataataattacatcaaggtaaatgaggcatccttcacctcaagcatttattatttctttgtgttacaaacattccaattatactctttcagttgctttaaatgtatagtaaagggcctaggtcttgaatgtctcagcagacaacgtggaagggcagggcagtccagcaacgagaaagcacagcaaatgacttcagaagtaacatgatgtggggtggaactgcaagcagttttgtaagttaatcactacaactccacaacccagggatgacctagatgtatttctcagatgaggattcaaagggagagtccagaagggtgcaaagcttgggaagattatgtttttgggctggtcaaagagggaagtgaagcatgagatctggtggtgtgccgtggtggccatacgcaatccttctgtaatatggaatatgcgtcatactctggcagagccgaacacatgaggtggcagagcttccccaggggagcatgtggcttcagagggtcaaccgggactaggtggacggaagctcgggacaggttcctggtcagaaggagctccgagaaagctgccgggtatgtgcaggctgacctgctgcccaggagaggcttcttagagcaggtctggggaatagcctgcccaccccaggggtcaaaggtcaaggagtatggctgtaataagctattctatagttgtattcccagtatgctgtgggctactagagagcaggtgttgcagcttctctgttttacctcagggtacatcctagagcccatgagggcctgggctctggggccattccctagagatggacaaggggccagaccaaattctttaatttaacaaactgcactaagcatctactttgagcagggtgctgtgccaggaattgggagcacaaaaacgattaagtcatgttatctcccctcaagcagcctgcagtcaattgctcctgaactgagttaggctaagtaaaaaccagccagtgtgtcggcaatgggctggggtggggtgggggaagggccagaagggaaggattgcaagcagagagggtggcagacaaatgcaggcaggaaatcgacagagtatgtgcagagaggcagaggcaggccattgtggctggtgcatgcagcacaaagcagggagcagcaggagcaggcctgcatgccaggttagggcagcaaggaacatgcaaaggttttaaacaggagtggtactgttagatacgtgttttgcaaagatcactccaactggtgagaactgattctaggggaaggaagggaggcagggacaccagtgaaggagctgcctggttcagataggagacgtggacaccctgagttagggcagtggtattaggaagagagtggaaaggccaggtgtttgatccttcattggctgtaaggggtgagggggagggaggggccaaggaagcatctgagtttctatttaagagaccagtgaatgtggtctctacacagatcagaacacaggagatgagcaggctggggagggggaggagtctggttctgtatgtgctgaatagatagctggttgcctttctgaggagcatggtggggcttagaggtgctgagctcccaggaagtctgcccaacagggcaggcagcctcccttcctcaggatcgagagcagctctggattctggaaggagagcctcactttcaatgccaaggctctggcttgcaggttgtcctggtttggctccagtggccctagaccagagaggccatgggggcctgagctgtgaggctgacgctttatctcctccgtttgtaaggtggtaactgtgcgccagccttgctagaggccctgcagctggggatcacactgataaattcactgtattactttgcacaaatcaatatcccagcacttaccaggggttgatgtgaccgaaattggtttcagccaattcgtgagggtaataaatggccatttatcaaatcaattcattctgcggcacttctctggctgcccatcctcatggtacccatggggtgccaggctccatccagccagtccctaccacacatgtgacactagcttggagaactcagggaggcctggcctagcctctagatctgcctcactctcctggacctgcttcagtttgaggtcccgaggtgttgggtgctgcttgcctaccataagttctgacccagagagtgcttcatgcttcagctgggctggcagttgcaaccaccgggctgccttattccctcatgcttgggtttagaagcctctgggagctagtcacaaggactgggcatggctctgaacattatcattgtgatccccagctgcagggcttctcagcaaggtggatgcagtaacttccttacaaatggaggttaaaaagcaccaacccctcaatccaggcataccacacgaccaggtagggccttcctggggcagtggtattttaaacttcagctgagtgtcagaatcacctgaagggcctgttaacatacagatcccagaatttttgattccacaggtatggaataagcctgagatctgatttttaacaggttcccagaagatagtgatgccgctggtccagagaccatgctttgagaaccactgtgttgggggatacacctttgtcttggcctggcctggggttcctcttcccttgcctcatctatctgaaatcaagcccaaggagtggtgctccagagtcggagaacaaagatgaggccactgtattcagcagaaccttagttttaattatctgctcgttgggtctgcacaggcaggagggccattacattagggattacaccagagggcagtctggctcccagggatcaaagtatggaaataagagcttcatgggtggagaagacactcaaaagttgctcaggatattttctataaaattaggccagctgctgacaaactatctggaagtgacagaagagtcccaagttgacagatggggacataagttctggctcagctgctacattgctagtgacagacaagctcccatccctctctgggtctcaattctcccacttgaaaaatggagttgagggtagcggaccagatgacggtcagagttaaattctatgcataggaaagcagcctcgagcaagtgatttaggtattctgtgtcttggcttcctcagcagtaaaatgggatttagcagtaccaacctcagaggattgccatgaggattaaatgacacatgacatgcagagagcttataacaatgtctggcatgtagatagtactcaacaaatgctaatttttaatattattaacagcgcctatccagtttggtgacgacaggatgtacccctcaaagggcaccactctgccctttctggtgtcccacacactcaccagcacccactgtggcgatggcgctctcctggccaatgatgtgctcctttagtcgctgctccagggggaagcggcgccgctcctcagcctcacgcttccgctgcttctcttggtactgtggggagagagggcaaatggttgagggctgccgggcccatagcaccatagcttcactctatcccccaactcggggaaaacacaggtctgggtatccaggggtcctgcttcatagctgtggttcatggtcactggaggctggtccagccctttccactctccactcaggtggctgccgctcaggggtctcggctcactctgctggtagagtaagtactactagcagattaaccgtggctctggagtctgacagaagacctgggtccaagcccagctttatcacttatgagatgtgcttatcacctggagcaagttatttcacctcagttttctcatcagcaaattggggattaaatattaatatgatgatgtatgtaacaggcctagcatcatgcttggcatggaataaatgcttaataagtataaattcctttctctttcctcttgaaaaacgttttgctcaaaagagagctatgaacaccctccatttcaattatgctgcatttcaattaaacataattattcagcagttcttgcatgcccagccttgtgcatggccatgatgaaagggtggggcagaggaaggaggactgtgccccgttgcctgggaggttctagttgatgctgagggtctggcatgtctggccctgggcttcatccacttcacaaaaggcagcaggagaagcctaagcttggttgcccgcacagaagaggagacccgggcttgccctcaggcagctcaaagtcaggagatgaggcatggcctgcacacaaatacttcgcaaccattttcctcaagggtccaaagcatgaatgtttatctctagcactgtatctttcactaaaaacacaaaaacctacttgaaaacaagtttggtgaatataagtctgtcctctaaatcaattatgagctccccaaggacaggccctatctttgactcactgctatttctagcatgggtcctggcatagtggggcatctggtgagtgtttgcaaaaatgacaaagaggagagaattaacagctagatggggtggtgtaggagtagagaaaggaaagacacataagtgtggaacatctgttggggggctttctggggaacaggaggcttgaagaagctggaggaagactgggccaggagggagccgtgggactgtctggagaacaggcaaggaggggtgagggcagggacctgatggtagagtatttgtggaggttgggaactggaggggaaggaagcagatcttgaaatggaaaggaatgaccaggtcttcaggaggctcctttcccccaagcctgtaacactaacatctttctggaaagagagctgtcaaagtcaggccctgtcacaaaagttgtggttgcagattgctcttgcgggcagagtggataaaaaatacctactgcttgggcagtgttttcctgttacagtagtgaccttgacagaagttaaaaaaaataaatagcaaacaatccaattttggctgttgctatcagtctataactgaaagctcccatcagtcctggggtttcatatggagcaataattcggcgccaatcccagtggagtgacacttgccggttggaatccagagtgtcactgtgcagctccctcaggcgccacatacatcacttggctctgccgacttcagccatagatctgctttttcctcctccctgcccacccagccccgctcagcacttaggtccactgggctggaggctctgatggtgagatgcatacatactggctgggacagtgctgacttgcagtcgggcaggccatggaaggagcctgaagggatggaagctggcttgcaagggtttgttgggtcagtttcctcacttcccttcagtgatgagttccagagtatgcctgcctctgggcctttgctgacactattaccctactacaaaggtcttctctcttcccaccaacctccaatgtggtactgtctagggagtctgttgtaaggctttgtgcctaccccagaccctgggacctctggtacacttaaataacttcctgtttgtctctccttcctggaccatgaggtcactggttacaagaccatgtttatttctctctatagttccagtgcctagcaaagggcctggctcacagcaggcgtcaatttgtgttactaactgaataaatgtgactaccgtttgtggaatggctgctgtatgccaggcactgtactcagcaccttatacacagcatctgctttaattctttcagctgtctccatctgaggtttggctcttcttttggctcacagtgaggcaagttgtgtacaaaaatatgctttgctccagacagacctgagttcacccctcaacttcatctacttcctagctagctgaccttggggaagttaagctcccagaatcttagttttcctcattaaaacgcaggatagtattcatagttttagcctgtaggatccttgtggaatgccacaaggtgaggattaaatgagataatgcattaatatataagttcttagcagagtctctggcacatagcattaagaggtagtctgagtgaccaaaatggctaccttctacctaacccttattaaacctttgataaatgtgactcctcttctccttcactgcattttgataacagactgtctaatctagtgcctttttgtttttggtactggaatcctttaactaatttaattgtgggtggaattccacagataataagaagagttaccctggctcaagccgaagccatgagccgagtccacttggttgctaccactgccccagaggcggctctcgaggctccatctctaggaaccctaggtctgcagggtgcagtctcaacactcacccggctctagaggtgcctccactgcctgaggtggctcatctttgctgtcagttttccttacgtgatagagaattccacctctgggtaccttccatccattggtctgtggggcctcacataacgtatcttttccctttgccacaggcaaagtctaacataacttttctttccactttgttgatttgggtatgaccagtgtggcctccctgagtcttctctggggaaacacttctacttcctgtaactcttcttcagtgtcatggttttaggttgtttggtattcctgtttatttcttgggcaaaggaaaggactccttgacttctatggaggtgacaggtggggtggggagagttataccgtgaactggttagttttccaggagctttctagatggtcttgggaaagattcaaaccatggcctaaatttcagtacattctgattctccccagcctggagtcccagatatctatgccaattcactaaaacctcagaaaatggatcagacttcttgataaaaatgtaaaggacactgagattaagccaggcaggcagaagattactgcttcatgctcttttcacaatgcttagcacagagtttgtgctaaaaaacatatgaaatgaatgactgacttcttttattttatatatatatattttttgagacagagtctcactctgtcgctgaggctgagtacaatggcactgtgtcggctcactgcaacctccgtctcctgggttcaagcaattctcctgcctcagcctcccaagtagctgggattataggcacccaccaccacgcccagctagtttttatatttttagtagagatggggtttcaccatgttggccaggctggtcttgaactcctgacctcaggtgatccactcgtcttggcctcccaaagtgctgggattacaggcgtgagccaccgctcccggcaatgattgacttgtgcccagccttgtgaaaggctagccagtggagtaaactagagaaggaaaaatacttgagatatatatatatattctatttggagaagaggagaaagaaggatgggaggagcttggtaagggctctataaatactattgttcctgtctttgaggagatggggaggaaggctacaagacgagttcaaggctctgctctgatagggatccactagagaagaagagaaggcaggaattcagcctgcagaagcagagggcactgagctgagaggcaccgtaaaggagccacccaggagagcaggagtcggggagtgagcatcttcttaataaaagccacacacaattagcttcagaagccctcacctggagccatcagcgaccagcttcccatgctgcatcttggctgggtaattgcagtcactggtttccatcagtcttgatttaatatggcacccctcctggctgtgagtgcatttacaggaaagggctgggaggccgaggcgaagcctagctgggctcgctttgcttagaggtgggtggctgggctgagtggctctgcgggggagggttacagaagggatatggcaggcatcccaactgttgggcatccctcagggcagaggtctgacagtgaatctgccagtgtgttcactgagggggcagctggagtaggcagaacaagaccctgggcaagaatgggaaggtaggtatggagggggaagagaagagaggccaagctgcagtttgcctctcaaggggaggtcaggcctatagagtccacctgctactcatagataaactcgggtatgccccatactcctgaatccctgactcagatggtgactcatatcacagtcggggcttctaccatgtcctgaaatggtatgacatagaggcctgggaagggaggtcaacaaagggaacaagggggtaacagatgagatggtgggggtggggatgacgatggagaaagcctggtggaggggaatgataaaagaggagcccaggagtgccaacaaagaagtctaggggatgcagagcagatgggaacacaagactgggagatgagagaggcacacaaggaatttgaaagtctcttaaactagtccacaaaggacacatccctgtagaggaaggccgaaaacaaagcaggtgtcagccccttcacacttggtaatcactaggtcggcatcccagattccattctcctctcttccagtccatcctccttttgctgctaaagccaatattttaaacatgtaaatctgatcatgtcactcctctgcaaatagctaggtggatcagagacaagactgatgagagaaggttgaggggcaaagagtggctaaagtgagaaaatgagtttgtgctcgtctcaggtggaactcctgacctcaggtgatccacccgtcttggcctcccaaagtgctgggattacaggtgtaagccactgcgcccggcaatgactgactaaattttaaagacatgagccatgtgcccagccttgtgaaaggctagccagtggagtaaactagagaaggaaaaatacttgatatgtatatattctatttggaggagaggagaaagaacgatgggagaagcttggtaagggctctataaatacaggctactacaggcatcatatcagagacgtgtgatgttgatttatctcataactggtagtcttaacttcgatcactaggttaaggtggcggctgccaggtttcttcactattttttttccctttgtaattaaaaagtatcttgtggggagagactttgacactgtgtaaatatcctgttactcctcaaacttcaactcattaattttagcactcactgatttgggactgggtgttttaatcctcatagccctatgaagttgatagtatcatcatccccattgtacagagattaagtacattcaagcaaggttctactggcagcgagtatagagacagaacagtaacccttgtagtctgattccaaagcctgcaccgtccacctggagataaggaaagacttgccttcagggagttcagtctgtttaggaagatgagacttaaaacagaaactttctatctgttagaagtattaatgcttctagtaaagggcaacttgatacatttattgaaaataaaccccacagggtgttcttgccagaaatgcataatctgagtttaatcacaatgaaacagcagataaacccaaattgagggacattttacaaaataaccaacctgcacttgttaaaatgtcaaggtcggctgggcgtggtggctcatgcctgtaatcccagcactttgggaggccgaggcgggcagatcatgaggtcaagagatcgagaccatcctagccaacatggtgaaacctcgtctttactaaaaatacaaaaattagctgggcgtggtggtgggtacctgtagttccagctactctggaggctgaggcaggagaattgcttgaacccaggaggcggaggttgcagtgaactgagatcacaccactgcactccagcctggtgacagagcgagactccatctcaaaaaaaaaaaaaaaaaagtcaaggtcataaaagtcaaggaaagactgaggaaccattccaaattattatgttttatttttctttttgatttccacatcataacgtttggaccattccagattaaagaaggttaaagagacatgacaaccgaatgcaacttggattttgaaactgtcttttcttgtaaggagaattattaggacaacttgtgagataggaataacatctgtagattagttaatatcaatattaatgccctgattttgatgattatactgaggttctgtaagaaaatgtcatctttttttaggaaatacatacaaatatttaggggtaaaggagcatcatgtgtaaacttattctcaaatcattgagaaaaaaattatatatatatccttatatgtattatttatgtacataaataataaagcaagtatgataagatgttaatagttgggaatctagatgaaggatttataggaattaattgtactatctctaaaattatgcaaaaataaaagttaaaaatatcaggataatgcctacccttgggggatgagtctggaagggagtctgaggcaggcttttggggtgcttctaatagtctgtttcttaataaggtgtgtcttgtatgtgaaaatacagtgatccatacattcctgatatgtgtatcttatacaagtatatttcaataaaaagcttttaaaagttaaaaaaaaggccaggcatggtggctcatgcctataatcccagcactttgggaggccgaggtgggtgcatcacttgaggccaggagtttgagaccagcctggccaacatggtgaaaccccgtctctactaaaaatacaaaaattagccagttgtggtgtggcccctgtaattccagctactggggaggctgaggcaggagaatcgcttgaatctggaaggcagaggttgcagtgagctgagaccgtgccctgcactcgagcctgggcgacacagcaagacttcatctcaaaaaaaagaaaaaaataaaaataaataaaagttaaaaaaagggaaagagaaagttggtccctaaaaagcacttagcactgtatctggcccataccatagtaagccacagggccaagtacagagccaggcacatggcaagctggcacctgtaatgagaggcaaagcagagaatgggttgagtgaggccaaggggaggaagaacataatcctcctaccctcctgtgtgctccccctctctcctcctgtagggctgcactcagctctgagaggagcacccaggctctcagcctggaatgcgggcccaggggagcatcacatccccagctacccctgaagcaaatgaaaaaatatagataggaaatgtgcttgtgatcctgtcactgggatatgcaaataaaatatataggataggcctatctgcctaatattcctgccgatgcattctttgggtgtgattaaaatgagcaataaattcctcgtgagtctcggtgcagtgaggattgggagtggagatgcaggctggcacgagcacgttcccctcagctgaatattcatcatgggatagctccacatatttttgttttatctgctatcatgtcaacagagatatatttctacctctccttcatctcttagttaagacatgaaaatggtcctggctttaagtattaaactctccatctattgaaatccttcaaggtgagattacaggctacctcctctttgaagcctgccctgctctctctgccaggaggtgatccacgctttcttggagactctaccaactctgcgaaccctcctaagacaaatcagtctgcaggtatcagagctaagagtgcctgcctctcccccagccagatggcaaactcagggacaggggctgggcctcatcacctctggatattctcagggggcctaaggaggcttcggcgcacagaatgctgagagaactgaggaagccaacagtgagggacacatcattcagaccacttaaggtgacagagattctagggtaaatgatgcattttaaagggcagaattaaataaaaaattaggcttatggataattttaaatggaaaaatcaccaataatattaagtgaataaaaaccaaattccaaatatagaataggattgtaactccttcagggccaagtaggaaacaaaagtgtctgataatcgaggacataatataagagggaatggggggccctgtggctggacagtgcacactcccaatccccaaggcattaccttcacatttttggaaaactctgggtggctatataaaatgcggctgccagtctgagactcctggtatatatggtggactgtcaaccacattttttacaaaaaaggccatctatataactatacatagatatgatccagagaaggctaatacagtatcataagaggaaacctattgttcaattcctaatagtcacttataacaacttggttttctgtaaatcatctgcttgctttcctgcagctttagttttcccatctgaaacaggggtaacaagaactacttcacagatttgctacagggttagaaaaatatgtatttgagcacctggcacactacctagatgcatttgataaaaacagtatatatcattgttataattaattaaaaatattaatagtggttatgtcttggtaggagggctagagtctttgaattaaattcagctcagttgtcatctcttccaggaagtcttccttgataagtcataccactgatgactcagtggtgtcatggtttacttgcctgtctccctatcagactatagctccttgagtgttttactcatcagtcttcttcccatctagcccagaacctggcacatagatgtcattcataaatatgtactatattatttatttctcttcattttacttttctgtatctctaaaacttctataatgggacatacaactttaatacaagttttctatgagcataatttgactacagagtggtaggtggaggtggaggaggctgagcagggtggcagggggatgctgagcagagagaaggggagccagataagatcagagtgacagcaacccatgtctagacaaagagccaggagatggggcccaggctggagcttcagcagcctccaggcctgagtcattatgttacagatgcagggcctgaactcagaggcagctgcttcttacttactggcagagggagaagaaaccaggtctaaaatggtgttcttcccacaaaagcctgcctcacaattttgaagaggaagctttttgcagtttggaggaaaaatgcagaacagaatgaatgggtgaccaagtagatgctgaacaactcagagaaagccaatgccgttggcatccagggagggctgaggggtgcttcacataggtagaatctgatgggacagcaaagcaattaggtggagatgctcagtggacacattcagaatggagaaagtccagactggatgaagggatcaagtgcacagagtgacaacggatgaaatgatcttccagctgagagctagggaatccctggactggctccaagtggtcttcttagcctctaaggcagcccctccatggtgggacagctgtgttaggggctcttccctgaagctgctgcccaataagcctagccactctggctctgccatggaataaatctcactccctctcactcagagctgtttctatgctcttcctcttctggccagatgccctattaccatcagctttctctcatggcatagttcctcctgccaccctactgcccttttctgcacagattctaagagatcaatgtctacttcgaatatggtgtctgtaattgccctccatgctccagaagggtctgactggcacaggggattgcaactgccatttgttcactctggacattagccctgtaataatgtggccaacttcaagccacttcccttgggcagctaaattttgtgaagggtccctcagtgggcctaacccctccaccagcgctggcactaaggggcctgttctcttgcttcagtggccagaccagtacctgctctatgtcacacaagctcaaaagctacaggtactcttggccaagtctagggctggtctctcaggcaaaagccactgggcttgaaaggggagctgatgatgagcatgcagtccctaagattatgcacaacagtgctgagggatttccttaaggcacttaaggaagttgacctgacctcctgacctgctcctaggacagaaaaatctgaacaaaaggaaagaagcatttgccctctgaaatttagtagttctttctggtcacaagggcccccggggatgggctgtgaaaagctagtcacccttcctaattccttcccttctccagaagaaactactgcaaaacagttactaaaaataccagggaggcaaactctgtatggttcatgttgattaccaaatatttccagctctcccattctaggcacatggtaggatcactcttcttggccccccttatgattggtttgaaacatgggattagttctggccaatgaatagtgagtggaagaaaaggatcctccttctaggctgagcatttaactgcagatgtaagacccttcagagcatccttttccctctggcaagcaactagcaacattccagtgggtggctgctctgcctgctgggatccctaagtgcctaggatgaacagagtctgcccctcacccacaaccacaaggaacatgcaacataaggcaaaaataaatcttattttgttttgttttaaaccactgaaatttggggttgttacaatagcataatctagcttatcctgactgatccatagacaatcatatgttgcctagaacattagaaaccatttagtacaatgttttcatatcacagaagactgagctttaatgaggggatgtggtagcccaaggtcacatgggcagtgagtggtgaagctaggatcagaacccacatctcttcagtctcagtccagggagctaagtgcttggactcaagacagagaatatttgccactaggtgggacctgccacactgaatcatctcaaggtacttcagccaatttgtggataacagactccatgaggctggaaagggcacaaaagtcaaaaaccaggtcttccagtccccgtcctgccactgaacctaccacatgacctgtagtcaagcctattatgttcagttttgatgctaactcactctgggaccaaaggcaagccacatcacagccctgggctccagtttctccaggagtaaaataagtcagctgatttaggtttcagagattgaaacttgtggcaacagcagagtcccctcagaggctgagtgaagggcaggagtgaagggcaggccacgtgggcagtgctctagtccatctctctccttcaactcgaacaactcaattttcctctgatttattggcttatgtttttgtaagatttcccatcactggacttgatttctaaggtccttgccagctctcagatttgtgattctagttcttggattctgtccagtagttcctgagttacagctctgtggctgggagaggtggaagacttagccctgttttcaggagttcaaaagtttggttgggaaaacagaattagaatggagggttttttggctcagattctatactaggctttctggagtgtgtgtggaggggaggggtgaaggaatagttctagaaagaatgatgataagaaaagattgtttgatgagactgtagaatacatgaggcctaggaaaaatatgaccaaaatctttgcttgggctaaggattttgtctggctagaaccccctcctctgaaaaggacctgggagatccatcacttcataaaccaaatttaaaggtaatgctcagaagccagaagtggccaaggccgctccctggtcatgataggggcagcttcctattcttgatgagactgggggctggatttgtatttaaacagataataatcaacagataataatacagataatatctgtatttaaacagataataatcacctaaggagaagtggcctttggtgtaaagcctgacataatttaatgagtgaaggattaaatgatgcatggagtacccacaggcctcctcccttccctgagacttaccttggcttcagaagtcctcagaagcttcatcacttccccttctcgggcataatccaagggtgtgtgtcccatttcattcctctgcagggggttggctcctggcaagagaagaaggataaacagaggctctatgaacgatcagtgggacctcagccttcccttggaggtggcttaaggctctgatttctatgttgggaatgtccatggacacctacaaatggtggaaaaacatggtactggggctcctacatgtgcatgcacacatgttcgataacatactacacacacgtagatgtgttatacatacacaaacacacacagttgaacatgctaagaaagtatgccaaacaaatacacaggttaatataccgcagcacaaatacatgtaaacatacaatttcatacatgtattcattaaaatgtccatattttccaacatatcagcatacagataaacattcattcatgaagccatataaagggttcctttctaaggcagagaatatcccaaataacaattaaatggttccccttctttgttttctgctactctccttttatgctctctgacctctgggcatttcctgtctgtctgagtcagctgagtcccctggaagggcatgggcaccaccagcaacctgtctatgccactctggctgttggtgggtgagtgcatgtggctgggtatttcctccaatcattagttcctgtgacttaaggacaaagactttgagtatgacaagaagaaggggttagcttggggccatgtatctaccttctctctaagtactggcagctgacaagcctgtatcaagtgtctactttgtgccagccttggcagttatggaggaaaggtcactctgactctgtgctgtcacagccttcccaaagcccatgtgtaagcacctcactctcttcttcgaaaaccatccattccattcaagtcggcagaccctgaatgaatggggcctgaggatgcagaagaatcagatctggccctgccctttagggaagggcaggaagacagaaacataattagaaagctgctttgtacacagcagatgcttaataaatgtgtgttacacagaacattaaggtaataattatctagtattttttgagcttctctcttgctcaggaagtactgtctgaagtaaagaaggttaagactcagtccctgccataggatagaatgggctggctgggaaaccaattagcacagggcatggctcagggtaggtgtccagccactgttgatgtacagtaaaaaccagtatttctcaatccagtatgtgaaaacatttatatcatgatacagaagtattcctattgcaagtctctactttaaaaatttttttattaaaattttaattaaaaatttttaataaaacttttttaatcaaaaaaattttttttggccaggtgtggtggctcacgcctgtaatctcagcactttgggaggccaaggcaggtgatcacgaggtcaggagattgagaccatcctggctaacatggtgaaacgccatctctcctaaaaaatacaaaacattagccgggcgtggtggtaggtacctgtagtcccagctactcaggaggccgaggcaggaaaatagtgtgaacccgggaggcggagcttgcagtgagcagagatcgcgccactgcactctagcctgggcgacagagcgagactctgtctcaaaaaaaaaaaaaaattttaagagacagggtctcactatgttgcccaggctggtcttgaattcctgggctcaagcaatcctcctgccttgacctcccaaactgctgggattacaggcgtgggccactgtgcccagccacaagtctctacttcttcttttcttttctgttttttttttttttttttttttgagacagggtctcactctgttgcccaggctggagtgcagtggcgtgatatctgttcactgcaacctccacctcctgggatcaagctattctccacctcagcctcctgaatagctaggatcacaggcatgtgccaccatgcctggctaatttttgtatttttagtagagatggggtttcatcatgttggccaggctggtctcaaactcctgacctcaggtgatcctccaaccttggtctcccaaagtgctgggattataggtgtgagccaccatgcccagccacagtctctacttcttaaaagaccctatcaacttatgaacaacagtaaccatttattaagcatttacatgtggctgtctgcctgagaggcagaggaagtggctaaagctctatagcgatgtgggaggtggagggggaaggggcaggccataggaaatacaatccaggtgaaggaaacttttattatcagtaagaaaaaactaagttttttttacacagtactatcttctaacaggaatttagtgcagaatattgataaatatatttttttttattaagatacaattcacacaccataaaattaaacctttcaaagtatataattcaaggccgggcacagtggttcatgcctgtagtcccagcaatttgggaggctgaggtgggcggatcacttgaggccaggagttcgagaccagcctggccaacatggtgaaaccccatctctactaaaaaaaaaaaaaaaaaaattagccaggcatgggggcacatgcccgtaatcccagctactcggaaggctgaagcacaagaattgcatgaacccaggaggcaggggctgcagtgagctgggatcacgccactgcactccagtctgggcaacagagcaaggccttgtctaaaaaatggaaaggaaaggaaaaaggaaagaaaaaaggaaaggaaaaaggaaagcaaaggaggtatacaattcagtggtttaaaatataccattccagaacattttcaccctcctccaaaagaaattccctatctattatcagacactccccctacccccagccccagcaaccattagtttactttctgtctatggatttgcctattctggatacttcctatgaatggagttgtataatatgtggccttttgtgtctgactttttcaggcttaccagaatgttttcaaggttcatccatgtggtagcatggctgaataatactccattctgtggatatactacattttgtttttctatcaggtgatgatcgacatttaagctatttcccctttttggctattatataaacagtgccatgaacattcacacacaagtctttgtgtagatgtatgttttcatgtctcctgggcagataattggagtcatgatgtaataatagtaacactggtatttattgagcacttactctgtgccaggcactgtgctcggtactttctgagggatgggaattaaaatccccaagctacaggctcagaaaagtgaaataactagcccaaggccacaaagctagctttatttgcttgaactaggagtaaaaaccacccccaggttttcctaactccaattctctactctcatgagggcagccacaatatacccctgatgaaaaagccttcagttggcctttgctttcaggacaaagtgcaacctccctaggaaggagtgtgtctgtggtcttcctaactactgggcaagtccttagaggctcagccagagcctcatcctttctttccattctgttggcacttactgggcactttatatctgcaagcctctgtgtgcaggatgatgaaggattggcagagccaatgaatagtttccctctttatatttcacgactgttctgtagcaactgataccttggccactctctcctttgagttctataaaaccacttttcaggttttcttcccactcttgtgaccatttcttctgtttcttttgcagactcctcttcctgtctttaagattattaggtgctacctagagttcgagtccagcacaattccacctctccaggagctcatggagacaggaggtcacagactgagtgtcatcagtgtgctgaaggagggacaggcggcactggggggctcaggaaggaacaaagtgctcagggacttgttcgcctagcctagccttcctggcccagccccactgagttgctttctctggcgctcagcactgagcggctctgcaagggctgaggagccagtggcagacagcatcctcccctccccgcagagctaaaccacaacggaggcagaaagggagctgcaaagaagcagtggaaaggtctgtcctttcttagcctcaaggggagctctgtcactagatatgagctgcagtggaagggagggttagggagagacctctggaaggggaagaatggcaaagagaagagcttctgctttggataggaagaaagaaatgggagagagaagaggaggggcaagaggagagaaggtgacagaggaagacagtggaagaacgaacagagtgagattagcctcttcaaacaagtgctgtcagtgatctatatttgcttacagaatgaaaaatgtgtgccataaacattggccactgagtaatttctagtaggagtcgtgtcacttctcataaaggatgggatggggacaggtaggacatctctgcacctgggccagccagcacaggggctccttttaaagcagtacggcgcctgtctccagcccaggaggctctcaggtcaggctccacctgaccattcacggagaaggctccccaaggttctggagcctcagggcagcatgtctgcccccactttaggaaggctgaggcaggggtaccatggatagtgtccatctaatattagtaccccagccctgcaccctcgctctgacttgactaattgctgtaataattgatagaacctgacttctaccactgatcgatttcacctccacgaccaacggccacaaaccattacagtccaataaataaccacgttgggcctcacccgcctgccctctccaggggcatcaggatggcccgtgccctggcctgacctccccttgcctcccacccagggccccttcgggccaagcagctggtctagagggccaggcctctgggagcaagtgaaagggctggatggaggtggggaatgctaatcgcaggtcatccgtcacctcccactggctgtctggggctggggcaaacacctggagcaccccaggcagtgtggtacaggacccctcccctcctctccctctccagattagtgtgtcccagcttataatatttgataaatagcagactggcttcctggcagcactgctgcggctgcgcctgcccgctacagctgtggaaggtcactcattggggaaatatgtttctgtcagtggtattgaaaaaagtttagtggagtgacaggcctcaatttttcaaattttattaactccatcctcttaaccatttgtcttgaattccttcagattctgggggatctgtcaatagggcctaggccaggaaagtagtgtgggggggtgggtggtcgtggggctgatgctgattggtgccactatggctggtttggacctcatcacccagggcaaggtaaagcagtggcaatggtgttggtgggagtgaaggcctggctcactggtgctgagggagcccactcctcttctctggttcagtacctgcttttgatttgacgcaattattgactctccaagtggaaaaatggtgagttcttccaattccctaagaagatactcccttctactacatctcaaacgggtggtcactcgggctcctctgaatgtccccagtacccagccccaagctcatggctctcccaggggtgtcccccatttaactgagggcagatttttcatatatgagtcccagattctctcaccaaccccacttccatcttggttctgaaaacacctgttcatcttttaagactcagtcctagcttctcctccaggaaggtttccttgtttcccttccaccccaggttgggtaccatcctctctgctcccataggtctttcggcttccatcttactgcattggccaccctgcattaaagtctgtctcatctaagactgagagttcttagaagccagacactgtgtttgatacactgctatatatccttgcatgggatgggagctcaataatatttgccagatgattgaaccgtattctctccaggtgccatcttctgaggccacacagaacatggctgttctttctgccccaggagaacctttatgatagcaatacaaaaccatgtacctttttcctatagaccaaagtccccagtttctttgctggtcccagaagcctctctgcctggttggcagaagaggtcaggtcaggccccggtaccctctatgctctgtaggtgcgaagtggggaagaagtggttggagagagaggcccacctgcctttcctagggagagtgctgaatcccacctagggaggtgggattcagatcttctctgtgctggtgggaaaagctcataagctgagggggtgggaggaggcttgtcactccctcctcccttgacactactctgtcctggcccttgcctacctcaaataagataatgtgtataagagggcttaacaacaacaacaataacaacaacagtaaatgccctatataaatgtgtcggcctattatgattaacattgacattcatgcccctccccacccccggttctgtcagcacactgatcttctagtgatacgattccactacagttcccatgactcagcccttccctctgagagcactgggctggggagccagtgaggggccgcctctcccagctgtgtgatccagggcacttgctctacttctctggtgataatgactgctgccctacctaccacctaccactaagggctttgtgaggactaattagattaacaagttcaaaaatgattggaaagaaggattagacaggtgtacaatgttctttgtaataacttttacattcactcttgctttccatatttattgctagtggctttaccaccttcatcctcattgtcactatttcagcagtctgttgactatctcaaattagaagttttggttgaaacttctgattatgggaaatccttcccatgatcagagacatgtcaatgtggactgatccattcttttccgttatgagctccccatcaaggaaacattgagagagagagtggcaggatgaccacatatgagcagccatgcaccttccctgtgtccacgctcagctccactctgtccccacctgtggtctctccgattacccagatcctgcccattcttcaaggcccagttctctcctcctccagtgatcagtgctctcccttctgggctcctagtgtcctccctacttactccttttcctggccctcagcctcagggtcctggcctgccactttcatatcttggtttagtcttcacatccagtatgtatggggctactcaagtcagagccaattctcctctactttcccagaggctgaaggtgagagagaagagacttgttgagaatgctgcaggaagcacagaagaactgggaatagagctctggtcttctgatatcttgagctttttctataaaccacaccactgagccctgctcaacatacgtatgtacacagacattcacacttgcagatatgcccccgcccccctgcccctgtaatgaaaaatacttactgggcacttgttatgtgccatagcctgtgctgacaacggccatggatttaacaatttggtgaagacagcaggagacattattattttttctagtttacagatgatttaactgagtctagcagaagagcaaggggaaaggtgacaggctaacattttttgggtataatgcctttatatacagtgtctgaattattcatcaaacaaagattctgagaaagtagaggctcagaaaactaaaataatttacccatggtcatacagcagataaatagtaaagctgggatttaacatggggatttattatactattctctcttttgtacatgtttgatattttacataataaaaagtatttttttaggaaaggaagccaggtctgattttccactacaaaatgctaccttccaaaggcctgatgactcaaaaagagagaaaactcatcttttttcctctcttccagtgtgctcagatgctccaaagctaagataggggcatttctagaggtagatttgggatagacagctttgtagaaaggggacaagatgaggctccctttcctcccattcagggcttccctgtctgggggccaggggaatggtgacacacattaagtaacctctcagaaggtcatccacaagtcccaaccccccagtggacatgctctgatatgatcccttgccttcagggaggcagatttctaacattcagggaacagagagagttttaatggaatggatccagacattccccattccactgtatggaatcagacttgttcttgcccttgagcagaactcagagtagtgaaagacagagagggatagaaataatgtcattatactacaggggagtgaggagatgaggatgtcaggggagtgagatgaagatgatgattcttccccctacccccctggtacaagggagctaggcattgtgtagctgaggaggtgggaaaccacagcaccagctggagaagagcagaagatactacactgagcactaaacaaaaaaggactggagaagtggagaagcctggggaaaggaaattagagctcaaggtcacagagactatgagtaggagagtgggagctagaacccacgcctactagtccagggctctttccacctacactgtctcagcctctgcccaccccatagctttcacttccttagcacccactggaaggactggcctatactgggctaccactgttctcttctgtggtgccaaactcatctttgcccatcactcagactttatgttctgcagactcgggttcatcttccctgccctgaagctcttccaggccactcaagcctacagatcacttcttcctttgaaccgctagagttattacctgatcacagactttcacacataggtcttgtctccacaatcagatgtatgaccaagaatgctttgtgaatggctagaaaaggaatgatgatgatcactaggcatcaggatgggttcgcagaagccaagtcatgccagactaacctctcctttctttatcaggatgacctatttgctcaatcaggtacaattaggccaaatgtggacttcatgagacatctgatgggatgtctcaggataatcctgtggtcacaatggagaaatgtgggctggatgccagtaccacatggaatgctagtaaatgactgatggactaaccagacccaaggaggtgggtcactgatggatcagaggtctggaaggagtttccactggcagcaaacacttggtccttgttcagcatgtttatctatgacatggatatcacagggacatcttcctcatcaaatctgcagatgtaattaaggtgggaagggtaccaaatacaccagatggaagattgacattaagagctaaagcaaatatgatgcaagttagtggaaataaataggaagtcataggtttggaagagaaagtgaggattgttctgggaaatgtgattgagaaaggaaagggtttagagggcacctgagaaaaatagtttaaggaagtagagggtttaggctggacattttcagatatttcaagggccatcatgttaaattgggattagattcattctacatgaatccaagggtaatattaaaaccctgagaagcagattttggctaaatttctaaccatgggaacatccgaaaatagaatatgagcagcctcaagagcaactgagttctccagcactgaaagtgttcaagcattaaatggacaaccgcttaggaggtttcctacttatatactggtttacagattttttttcaagattaattgttatccattcaaagatatttttttgagtcttctatgtgtttggcaccatggtaagtgctagggatacaaaagtgagtaagaagatactgttcttgcttttcaggagttcctgatccagttgaggggagatggacaagtttatttcagtagtatcttgtgctttgattacagacctcagcacatggaaggctggctttagtttagattaagtcagagttcctgtggaaattcaaaaatgcgtttggttactaaaggccagtaacagtttaatcaaggccaaatcacttgcttaaacttactactggctgtgagaatgtaagtgtacagtgaaacagaatttgtgcatttttgtgcatgacattttgctcttataccttgagttttggtctttggctgggacttgtttatgaacctacagattgtcttacaagtggctgtggtgtcagggtgaaatgatttagccagcagggctacccaagtctccatttcttacccaccctatggggactgcttcaacacagacataaacatgctcctgccgttaccttattgcactcgtcacacggggaggctagaaggcttgattcagggatatgattggattttaaatcccagtctcacaggattttaattactggtttggggcagcagagataggcgctggctgcctttggatggaggaggtcgatacaccagtccacgacatattgagccacaatgcctgcagactctattgctctatttaatcatcttttgcaaaatttacagtggaacaggagggatcgatacggaatttatcacattctcttgtaaatatgagccaggaaagagttccaggcagtttgttactgagtgggagggaacatgtctgtgtacagctgggcattaggagatgagacaaaatccatacttcttggcataagctacagacattcagccagtccctcttacgcctgaaggcaagttcaatgggtagaatgctgattcattcattcattcaaccaagcaaccaaccaacattctagattacctattttatgccagaccctacagaggacagggtggaccctagagagctctgggaacatacactggaattctgcttatgagatcctaatcatagctataataacacaatggctctgccacttagtggtgaaccttggttgttactgaactgcttggtgcccttgtttatgcatatggaaatgtagataataagagtccctaacttgcagagttattattattattttttgagctggagtctcgctctgtcgtccacgctggagtgcagtggcacgatctcggctcactgcaagctccatctcctgggttcacgccattctcctgcctcagcctggcaccacgcccggctaattttttgtatctttagtagagatggggtttcactgtgttagccaggatggtcatctcctgacctcgtgatccgcccacctctgcttcccaaagtgctgggattacaggcgtgagccaccgcgcctggcaagttattttaagtattaaaagagagaaaagccttagtccagagcttttatcaaaaaatggtaactgttgttatttttccttcaattactattactaaccattccttcctacagtggatagggtgttgaacagggagccggctaccctacctccttaatagacagaagggagactggatggccttcccaggttagagatctggtcagggccaccagcagcagaatcagaggagcaagaggaagagggtgtgtaaggaggagattcatgttaagctctgttttttgaagcttcaattgcaatctttaaaacaataaaatagtctcctaaaattgctgtgggggaacagagtgagaagtgattcacttcatgtaggccaaccatggaaagttatacattaaagatataaatgagttggatcttgaaggctaagtaggagtttgataggtggagaagtggggaaaggatattccaggcaaagtgaatgaggacaggtttggaggcaggaaaaactatgctaggtagtgaacagttcagtgggccataggcagagacagttcctgtctcccaggcctacttggctgcaggcatcctcctggtaggcccacaggatgatcccaatcctgaagcaaaccatcatcctcatcctctcttggaaactggtggcagaagtcactttagagtgactgcatgctgggttaaacatctgggcttaatttataggcagtgggaactgctgaaggttttaaagcaggaaagtgacatggttttgtgagatggaggctggtttgatgggatcctagaggtaggaagaacaaggctgttataatagtccaggtgagagtgatgaagcctgaattagagaagtggggacagaggagagaatgggcttaagatgaaattctaagaaagacagggcttggtggaaagtgagggagaagtcatcagacataacacttcctagtttgagcgaccagtagacaaccatactattcatcaaagagaacatggaagaaagtgtgaggaggtatggatttggacgcattgaggatgagagatgtctacggaatattaagcatcaacaaagctatggaagacatgaaaatgcctggtttgttctacggaaaataggtagatcagtgtggttagaaagaggtggtataaaaaccatggaaatgaatattcaaacataacagagttagacaaggaaaacagcaaaagcaaaaactcctgccaaggatctctggtcaatgcaaagctaacgtagaggttttctaacggtggataatgctctgaatagcatgtgacacaggcaaagaagtgaggatccttagctcattttcattttggacaagtcccaaaatgaaaatgttcacgactttcctggaagtcgtgggctttcaagaggccagccctactcctccttatccccacagtatagcacagactctcctcagaggtggcagcaggttctatggccagagagcagctaggagcaactgtcagtggggagggaaaggctctggataaagcagagttcaaagtgcactatcagagccagggtcctcaggcctctgcagtcttccctcctgcaaatgacagctgagaccaaagcatccgagcctggggtctgggctgaatttagcagtcataattacactgttaacgtctggggcacagccacagtctccgtagaaggcggcagcttttgttcatgcactaaaaacacatcatcttcaaacatgctaatcctacgtctgcttccatctaacaacattgaaaggaggctgaggaaagggcacacaatgcccacacatctggctaattcagttatgaggccaatcaatcttgatgggttgtctacgagaccccaaccaccccaaaggactgagctgaccagatgtttaagcttctgttgaccaatcctagcctaatgtgcagggcagagaagaggggttatcaagagatgacttttgcttccacttacacatctattcccaaagccaagtagagccctctgcttggatgaaaagtatcagcacattaaagtagtggttgagccaagctcactggaatgaggtacactcaaatatacagactttcagtctgaactcaaggaagataggaagccttatttatggctgcctttgtgaacactcacagcaacagaaaccaatgaaatattttttgctaattgcacttccctatatggagagaatcggaaatgtgggggtgggggaggtagtatcttcaactataatatcaaatgttataggctacggttctgggaacaggaactgttttatctgctgatacctgctttcattcaaggctgaaggaattactcatctccctcataaaacatttgctttttaaaaaaaccagaagcttctgccaacaaggactcttccagtttatgcaccttcttttatgcccaaccacagtcaccaggcaaccatcaccaaaaataaaagtggaaaggtggtgggaggctaggaggaaggggagaggacagggatagactacaaacaccaggaggaccactttgacccagagctccttgctgttgctagtgattccatttttttcaagatgcttttccctcattaattctgaggatttcaccaagtttgtcccagaattgaggatgcatgacaaaacagatgaatggtcctgggtaaaagaaacttccaacttattagaaagtagtgagagagaagcaaagattaaaaatgagatctttattgtgataccctgtgcccagaacagtaattggcactcagtaggagtttaaaaaatacctgctgactgaataattatggccccattatgacacagctgagctgtgctccttccatttctgtttgtcaggagaggcctcctatggtcatgggcaatactgctcgacaaaaccactgcccacagatcaggagagtcttccttcagcctgaataagcacagatgaagttgtgctgagaggtagggctatgaatgtcattaccacatccagcaacctctttttcctcctctccatgggtgcagtaatctatactgctgaccaatcttgcctccttttaattcttttctaccttaaaaaaacatatttttttgaggcagggtctcactttgtcacccaggctggagtgcagtggcgcaatctcagcttattgcaacctccacctcccggactcaagcaatcctccccactcagcctcctgagtagatgggaccacaggcacatcaccacacccagctaatttttgtatttttttttttgtagagacagggttttgccatgttgtctaggctggtctcaaactcccgggctcaagccatttgtccacctcagcctcccaaagtggtgggattgcaggggtaagagccaccatgcctggccttcttttctaccttgatttccatgatatgcaatatccatgactttctctcctttgcagttcattcttcttttccaagttattgagtgtcaccgaagcccgagtcctcagcccttattcctttctctctctaggcattctcctttaaaaaacagctccgatttgtttaaactgccctagtggttctcactcctggctatatattagaatcacatgggaagtgttaaaaccatatcaatccaaagtaggataaaatatttctatatatcacagataaagggctaatattcttaacataaacagaaattttaaaaatcaagagaaaaacaagaccaaaagtcctatagaaaagtgggcaaaagacacaaatagacaattcacaaaaggagatataaaatgaccgccaaacatatgaattgatgttcaagttcacttataataagataatcaaactaaaattacaatgagatactatgtctcaccttcatattggcaaaaatccaaaagcttgacaatacactctgttggagaggctacaaggaaacagaccctctcatacgatgctaatggaagtgtaacatggtacaactcgtacggaggagaagcttggtaatatctaaccagaggacgtatgcatttaccccctgacccagcaataccacttctaagactttactgtaaaggcatacctccaacaagaccaaaatatatatgcataaggttattcattgtagcattatttgtaactgcaaaatattggaaatctcaaggtccaagtatagaatacatggaatatacatacaatgaagtattatgcagctattaaaaatgaggaatatctctatgaatttacatgaagtgattttcaagaaatattgttaagttaaaaaagcaaactgcaaagcgacatatacagtatgctaccttttgtgtaggcagaaaagtgaaataagagaacatacaaatatttgcttatacaaagaaacacagggaggataaaccagaaaacaacaaagctaattatttacaaggggtcaggactcactgagagggacagaagcaggttgaaagggatacaggagggaggtttacttctctgagtataccttttggtacctttgacttttagaaatgagatagtgctctacatattcaaacaataaaattaaatcaatcaggatacgtaggggagaaaaatcctaaaactgagagcaaattgaaaaattaacccaactgtatttcaaatgaagagcataaacacactgaagggggagaaaagaaccctagtaacttaggaacccagtatttgactatatactctcagccttggatagactaggggtgagaactgcaaacaaatcctgacctgaacttttaaggagatttgttttctacagtggcatgggtaaagcagttctgaagctttttaagatgtattataggattgagcaaatgagtaaataaataaatgtatcaacgttatttgcagctaccattgtcactaaggaagaaggacatattaatatgaaatgtgtgaagacacgaaagaacccgtcaggattaactagaatgtggggcagatgagggggcaggcagtattggtgttctcaggattactaacaaatgtaggtgcataagaatagctcgtgcttacagtcccagctacacgggaggctgaggtgagaggatcacttgaggccaggagtttgagagcagcctggacaacatagctagatgctgtttcttaaaagcaaatatcatccttagtgcattcacgttataaacaaaaaagtaaacaatatagaatatctgtgtgcatatgtatatacatgtatgtgtatattttaatggatatgtatatatatgtgtatatacctatataaatagttcttggctctatcaacagaaggagcaatgagtacacttggtactcagatttcacactctagtacaattatcaacaaaaaaatccgagggctcctcaagaaatagctgatttcagggcaacagcaaggtagatacgagatgagcctgagacatttcattatgtagaaaaataagaaaatgctatatgttaaaaaaaaaaaagatggagatatgccacactggccaaatatgaggcaatgatagccccaacataactaagcctataataaattttacaacattaaaatggtaagtacccaccgagcgtggtggctcacacctgtaatcccagcactttgggaggttgagatgggtggatcacctgaggtcagcagttcaagatcagtctggccaacatggtgaaaccccgtctctgataaaaatacaaaaaaatttagccgggcttggtggtgggcacctgtaatcccagctactcaggaggctaaggcaggggaatcgcttgaacccgggagacggaggttgcgatgagccgagatcacgacattgcactccagcctgggtgacgagagcaaaattccatctcaaaaattaaaaaaaaaaaaaaaaaaaaaaggtaagtacccatgaacacattttgacagtattagaaaatagagggaaaggggttcttgcttagagagaatgccaagtgctaactggtcaatgtggagtacgtgctggagttagaaaacatggaaaatattcattcggcaagcatcacataaagattggttcaggcaaaaaccagcgatgggtgctaattctagggtaaaattttgatgaggagcaggatatttttgtggtcttaaaagtatctcctcacagcctgggcaacacagcaagactctgtctctacaaaattatttttttaacaactcagctaggcaaggtggctcataactccagctacttgggaccctgaggtgggaggatcacttgagcccaggaattagagattggagtgtgctataattgtgccactgcactccagcctgggtggtagaacaagactctatctcaaaaaccaaaagctatctcttcatagagtgctaactaatgtcaagggaaaagatagtaacaatacagtggagaaactggacaattctttgattggagatggggtgagagtagacttttctctgaaaattcttgtgaattttgtactatgtacaagtattaactattcaaaaacaggattaaaaataaagcatttataaaatatctccgagagtgtgatacacagaataaccccccaccctcacccaagatgtccatgttctaaccctggaacctgtgaatatgttaggggaatatgaaggttgcagatagaattgatgttgctaattagttgactttgagattactctggactatctgagtgggcccaatataatcacaaaggtttctagaagtaaaagaggaaggtagaagagccagtgtcagaatgaggaaacgtgaaaaagattcaaccggtcattgctggctttgaggatggatggcaactgcatggagacatagaatgtgggcagccactagaagctgggaaagacaggaaagattctctcctggagtctccagaaaggaagacagttctgtcaacaccgttttcagtccagtgaaacccatttcagacttcttccctccagaactataagataaatttgtgttgttttaagccactaagtttgtgataacttgttacagcagcaatagggatgatacataagaagagttaggtggttgcctctgaggaggaccagggatgtggaagggagacttcctttccactgcatgtcttctggtactactccaaatttttatcttgtgcaacttttaaagtaaaaatcacaatggtcactaaacaaacacataaacaacagacagtcacttcaggagctctctatggactacaaaaataagtacaagtcctctgtctcttccccaagatcctccacacccatctccctacccctttatccagcaggtggccagcttctaccaggactctaaataatacacagtatttctggctcctggctcctgtggacagctcctgttgctgcctcacctgaaaagcttccttccttctctctctttgtttgaattttacctgtccttctaggtctggctctggtctcacctcctccattaagccttctataatgccacactggtctctcccctcctcattccccatgacagctgttaattctggcccttgcttatgtttaattgaaagtcctgttatctactgtcctgcactgttctcagtgtgctttgcatatgggcattttcaccaaactatcactgtacagggtgtagtctcaaggaagtgcctgtatctttttctcttatttcttggcatgcctagtacccattaattcaacaaatgttggctaggcacctatcatatgctaaggacagtgcaaggtgctgggaacacagtacctcagatccacatcctatcttctgtgaactcactgttaagtgaaggagagatatattaatcaaataactatagaactacatgttatggtaaaagtgataaatcatacaggatgctttaagaacatgtatcagaggaactgagaatagggatgatggtggttagttgtaagaaaataattaatagttgctgaataaataaatacttaagacagatcagtgagcaagtattcagaatcacaaaatattacagtgaaaggaagtctgagattatagtccaattatattattttacggataaggaaattgaagctcagtacgggggaagggcttgcttgacagcaaggcagagttagtgccagaaccatgtgccaggtcccttgacccctagtcagcactttaccacacaggcttctattacttcaaaggggtccctgaaggatttctcaagtggcaagctccttttttctgctacatttaaaaaatactcatttccaaaatgcagttcaggaaggagtctgtggtccaaacctatagagaacatccctgctgtgttcttccttggatactgcctggcttctgtatcttaggaagacagcacatgaatgctagaagcaaactccttttgggaagggacacttgaatgctaggagcaaactccttttgggaagggacacttggttctggtcatccccagtctcagccttggaaggggcttttgctgctactttacaggccctgactttcagattgacattctcctttcttaaagctgcagtgtggtcctttatctgtgcattctgcccaacagcaaaagctgcagtgtggtcctttatctgtgcattctgcccaacagcacatacgctggagggggcatgagtgggctggcaaagggcagctagaaaatctgattctgactcagcgctgtttccaggctcagtgcaggtggaggagagtgtaggacacggaacagacctggcccagccgatgctgacctctccctcacccaagggagccttggcctccagctgccactactggcggtgatgaggtcatgccggataccggccaggctcatctgaggactgcttggagccgattaaagccttgatgaaatgcgggggcctggatggcaagtggctctggagagcatgggctctggtgaccaggctcatctccagctcaactatgcagtggctcctcgatgtccacaggagccaggatacagaaatacttttccctgcggtgagcaaggacagttcctcattctatactgggtaaagggctgagggtaggacttaggtcactgagggccccttcaaggcctggtcttccacatgggctgcagatacaataccacagaactcctccactccccaaaattggactagactgctggatccctttggatgactaatggacatccctctccacaggattttctcaagctaaatgacaggctaacatccacattttgagtctcagtgtaaatgccatatgctcagggaagacttcctccattccccttcggactagattaggtcccattatgctcttatagtaccctctattcttccttaataatacttttattattagctagcaatttagctaataattagctggtaattttgtaattatttgcctaacatctatattctaccagactttaagctttacaaggatgcaatacatatttgttaaaataataacaggaaatcaataaaaaggaagggaagagagaggtttacaaattttttaatgatattctttaaaaggaaactgttttatacaacagaggggctcatctcctctaccacactagctgtggggttgatctggtcctcctggctttccagcctgctttcaggcaatcagtcagacatccaagacaagattttctggttttgagaggcatggaggatttttttcttttcttttttaatagctttactgagatgtaatttacataccataaagttcacccatttaaagtacacaatttagaggaggtttctcgtatacttagagagttgtgcaaccatcaccataatctaattttagaatattttcatcatctccagaagaaaccttgtacccattagcaatctctccccatccctcccccagataactgctaacatggagggactttaacatttgaatccaaacaagaagaagaaacctttagtattcaatcacctgacacaagttcttcattttatagaggaaaaaagtgatgttagagaagggccatgattttatagaggaaaaaagtgatgttagagaagggccatgttagagaagggtgagatgtggcagaactggggtggatcacagtccctgatgtctacatcataatggcagtgctgtgacctctttgccacacagtgtgactatatttgtcccagaatgtctataccactggactttaagctagttgagggcagaggctctattttgctcatttgtctcccctttctgcctgggagtaccagcaaagcagtcatgttttaaatgtggtctgtgtactggtgccagacggtgaactttgccaccagcttttgatgggataaatacaaacagtaagtgtctggaaacttttatagcaactagtcagagtaattttatgtctatagaaattagtggcacatttggggctatattttgcatgcctttaaaaatataatttttctttttctttttgaatcggagttttgatcttctcgcccaggctggagtgcaatggcatgatcttggctcactgcaacctccacctctcaggttcaagtgattctcctgcctcagcctcccaagtagctgggattacaggcacctgccaccatgcctggctaatttttgtatttttagtagagacagggtttcaccatgttggccaggctggtcttgaactcctgacctcagggatccacccacctcagcctcccaaagtgctgggattacaggcaagagccaccgcacccagcctcccctcatttttttttaaaacctgtttcaagtgtaacatataaagaaaagcacaaaaagtacataaggatacaactcaattttcacaaaacggacacacccacataaccagcatctacataaataacattacagcatcccagagatcccctcacggcctctcccagtcactacccacactctcgaggttaagcactaccctgacttcttatgccactgattagttttctctattttggaatttaaatgcaggcatacagtaagcactcttctgtttggcttgtgacctgatgtaaggtttgtgttgtagcacacagcaagagttgactcaagcccattgtacattattccattgtgtgaccatcccacaatttattcatccattcagctactgataaacattttaactatctttcacattatacataaagcctatcctagtcctcctctaaatcttaatgattttccattgcaggataagtccagtctcctcagcacagcttacattagtgaccttcaatattagctcctgctttccattcttgccctctgataccctccagctcttctgaactacctgcaatattctgagtaaagtatgctgcttcatactccatgcctttgaacacgttgctccctccgccttcctacctcatctacctggtacacttgcattcatccttcaagagttggtgtgaacaccatctcctacatcatgctttccctgccctcttcaagatttaaaaggtcttttctttgtgatctcacagcaccttctacagatctccattaatacaccagatagcaattcttggttaaaatgtctggttttctcatagaactgtgagttacttaagtgcaaaaatcatgtctggatcatctttatttccttggtgcctagggcagggcttgtggcagcagagatgatcagtaagaatctggtaagtgaaagaatgctggagctggaaggggtccttgggatctgctatcctaacttctttattttactgaggaggagagaggatatgcctaaaggtgaaaggatttgttggtggcagagccagaacatctgatccttcacccagtgctcattccccttctctgtactgctggcgtgaatcagagtgtggagcttcaacagaggacagacagcctgaggcacagctgattctctccacatcaggcagtgccgccagatggacagacggtgaagtgtaacaagaagcgaactcttaagttttgggtcctgacaacaagccaagaggctgttaaaggggatggcaccactggaaaggatctttgcctcaggcagggatggtggggaatttaaggactcatttgatgatggctagttaacactgataactcagtgcagacttggagatggggcaaggaggattcactaaagtaggtgggaaggaggctgagagaggccccagggaaagtattaagtttcgttaaagcccaagtgtttctgaagtgagagcaccagtgactgaaaaggaagtggcattatgactgtaaggagaaggaaggtagccaggcagaggtggctcataagtgaagctctaaaaagtcagacacattaggaaattaagagtcggggaaggggatcagcaaagagtagaccaaaaagtaaagacaccacatctcccaaaagaaaacctacagtggttttggagatttatcagtgcatccaattcaaaaacatactaaatcatgtgcagagcattgcagcaaaggagatggagacaaaaaaagacacaggcctggccttcatccaccttggtctagtaagtgagactggacccaaatccagagaacaggaaagacttcagaaggaaggtggcatgaggctggtgactgactggtaaaaggaactccaccagcatgcaaaatggtcttaaaggggacagagaggccgaacaaactgcgagaataaaggcaccaaggtgggaacacagtgtagctggagtattagggctccagtaggggaaaaggtaggtgagggtcagactagaacaactctaaaaccagttaaaagcattagtatggttagaatttttttttaaacgagtgagcactgagtgtttctgaagttaataataacagagactatatataaagtacctactctggagaagtacatatgtcctaatccttacaaatccttaggaggtaggtggcgccacccccatttccagatgaggagaaagaacttcagaacagtcagtaatttgccctggatcacatagctattaaatggcagggctggtaccaagatcctgactccaatattcatgctcttcccttgcaacctctcttagctgggggttctcctttgaagcacatacaaaaaaaaattgactagtgattttctcaatgcttccaaagatgtgtgtgtgtgtatatatatatatatatatatagctagtaccattttagattcctgggagagaagttaattcctgtgtacgatggatgccttggagaatgagggctcaattctctggaggaaccttggtcaagaaaaacggccatgattagagatatgttttaggaagatggatctgccggtgggatcacatccctgagaggacctggttgccaaagcaacttaacagtcctggaaatatcaagatgagtcatcttcaggcacttgaagtatgaggctccagccaccttccctgatcactcctctttctagtcctactgcctcttccccaccttcctccctccctcccaccacacctgcattcaagtgctgaagcagagccttcctgctgataagccatcaacacaggcaaaagcagcatcttccaaggtaaaaaacatgagggtctctgtacttttctgtggcggttgggagtagaagactggcactagttaattcaaaacccttctggagaactctggcaaactcccatcatccttcctgataaggcctaagcaccccctcctctgggaagccttctgtaactgattctacctctctgatcaccaggcagaagacatcatttccccctgttcgtccccagagccccttgtccaggcgcctgccagagcacctaccccattatcatggtctgtttccacatctatctcctctgacagtgtgagagcctctcagggtcagtgacagtttgcctgatctgtcttaggattccctgaggcccatggtctcagagatggcaagtggcttgcccagggtcacttgacaaggctgagatttaaacccaggtctgacttcaaagcttgtttctttttcactatgctacagggtctcccgaaaatgagacgacgttaagcagtctgtgctaagctgtacaatgctgtacaagtttggaggaggaagtatcggagtagaccagacgacgaagaaaggcttcttaagagagagaggccttgaagagtctgaggattcagataagaaaacagggaacatgatggcactttaggcaggatgggaatatcgtaggtaaagacagaattaagaggccttaaggtaggagtaaaggttctatattggggaggaatggaattacagctgccagaatgagagtttgatttctttatacatgtcacaatgataagtacttataacagggaacctaccatgtgcctgccaggggctttcataaaaaataccaccaatcctcatgctatccttgtgaaacaggtgttattttagatgtacgaaaactgaggcttagagaattaaggaaacatgcccaaggcaacacagctaataggtgggtaaactgggattcaaacctaggttggcctgattctgaagcctgaggttccctttctattactccatgccacctcctaatgggccagagagctttccacattatcagcctgatgcttctgtctgaatctcctcccagctcaaatggggacttttggtcagacagcaagagcagctgacttttctagctctaaccctctaaggtctggggaccctaaatccctgaggactaagtaatttcaaggaaactgttctgtgtgggccctgtgagcacaggctggcctctgtatttaggcctgctttggatctcacagaatctccctttagttactgcagcaaagctggtggcaagtacagcctaagaaaaccggatggggctgggcgcggtagctcatgcctgtaatcccagcactttgggaggccgaggcgggcggatcacctgagatcgggagtttgagactagcctgaccaacatggagaaaccctacctctactaaaaaaaatacaaatttagctgggtgtggtggcacacgcctgtgatcctagctacttgggaggctgaaggtaggagaatcgcttgaaggcggaggttgtggcaagccgagatcgcgccattgcactccagcctgggcaataagagcgaaaatctgtctcaattaaaaaaaaaaaaaaaagccagccagatgggcaggaaggtaggctcccttgcctttcctgaaaccctttggagagggtcagctgaggtcaaaagactctggaaatattactggcaacagcccctagaatgatagagcaggatcctgcctctcggttggctggtcacacacacaggcagaccaagggaggtcaagggggaagggaggtcagaagttggcagcctgcaggccctgagtgacggcaacttgttcagggttgggagggagaaatagtgggttaatggttttggcccttgaggctgggaggctagggcaaggggtgtaaatgtatgctggctaaaaaggcaggtgggagaaatgtaaaggtgggggctaagggcatctgttccaagtcaacaggcaggaaccatgcccctggaacggctcaaagggccagccttggcctgggggtgaggatagagggagtttcataaaaggccctcgtcttttcatttcaaaggtgttcgatctagaaggctaggaagaggggctccttataaagtgaattctcttgtctgggggttgggggaagcagagaatgtaaactactggacaatagctgggagtattgattgattttaaggcacggcagagataatgtccttggtgaacactccaattcttagctacaaatgtcttgccacagagttttccaacggacaaaggaagaagctttctgcttggggatgttttctaagtctctgcttctgagaacagcaagttctcgctccagaagcatcagtcatcccaagaactgctgccacatccacaagtagtcctgcccttcagtggctgtgccctagaacaaagcatattctggctgctctggggcaggtcccttgtaggcttggggatacaggccaggcctgggttttaagctagcatggctgtggctgacagaaagtggcaagattacgtgcgtgttcctgggaagttcccagaggccaatgagaagatgatctggggatgctgggcctgtggaggcaaaggctctgggactgaaagaactttctttgaagactggtatttggaaaagtgactaggtagcaaaagacagttggcataagttatagagaagaccacagctcattaaaaagatgtttcaaccatgccgggcgcagtggcccagcacttagggaggctgaggcgggtggatcacctgaggttgagagttcgagaccagcctgaccaacatggagaaaccctgtctctactaaaaatacaatattagccagatgtggtggaacatgcctgtaatcccagctactcgggaggctgaggtaggagaattgcttgaacccgggaggcagaggtcacggtaagccaagattgtgccattgcactccagcctgggcaacaaaagcaaaactccgtgtcccagaaaaaaaaaaaaaaaaaaaaaaaaaggtttcaaccagtctccctggggaagaaggaggttccttctgtctctgaaaaatgtcagctagccagctgttggagagggttctgctggaagagaggcaggcaatcatcagagtggcccagagacctttgaggacctttccagtgctcaggttctatgaagaatgatcccaacaaggaagaccctggggtctagccccaagagaggatccctggccctcaaaaagcaccagaggaggcatgaacaggcagtcatgtgccatgtactcactcaggggtctgtgctccacacatcctggccagatgcttcccacactctcccaaggagaggcaggagtgggatatggggaagtgggaaagaaagtgactgggatgtgtctggcaggtagcactaccagacttggacaggacttgcccagcctgagtctggggatggcatgttttgtctctccaattaactgatgttctccaaagggagggtattcattattcattgatttattgagtgcttactaagtgccaagtactatagtagatgctggggacacttgaaccagtcagccatggttcttgccttttagaagctcagagacaagttagggagaaggctattgaacaaataaaaacaatttcaggttgtgacaagtgtaatgacggaaaagaatagggtgccatgacccagagtaatgaaaggggcctgagacgggggtgggaccaaagaggatgtctttgtgacctgggttaggagggatttaaagagcctgtgtcctttgtttcattagctctgctttggaggtcacgggggagaagagagaacacttttagggatagcaagagtccagaaaactctcacagcatacacagacaggcaggatgacatggtgtatcacaccacatataggcagagaacacacatcagccacaggagggcaaaccacatgtgtgcactgccactgtcagcaggcaaagctgctctcgaggcatctctagctctaggaggataacagggctctggggaagtatgttatttccagaatagtgaggctgccaagtactctctccccctgccaagccccatcccacccctcctccaccccccccaccccacccctcttccacttcccccaccccacccctcctccacctctgctctcacctccatcaagcagctccttgacagtgcggtagtcatcagcaagaacagcatagtgcaaggccgtgcagcccttgaaactggcgcggttgttcagcctgttgttgaagtcatcctctcgggtgatcaggactggggagacagcaacacaaacccttccattagcaacgacagcatgagccaccaatctcacctgttttctagtggcattttaattcactcactcatctacctacttactaagcataaaatggcacctactatgttcctggccatctgtgctgggtaagaagaggcaaaacagaggccagttagttccacaatgtttactgacatctgttatgtgttaggattcatcctggggacatgaaatagatcagataaggtccctgacctaactgacaagggaggcagacaataaccagatgtttatagaactgtttgagataaatgctctgttagaggtataataggagaatataccagaacgccagaagagagtttagctcaacttgggcatgaagagaggatcccagaagacaggagtcttaaaggatgaagagaagttatgcaggtaaagaaagcaggttggggtaggataaggaaagagtggggcaggagacagaggctgttttagcagattaatatacctctctgctctgaaaatgtttacattctagtaagtaagtggttttaattttttaaagcttaaaaaatttataaaagcaattaaatttttaaaatcacagaaaagtacaacaaagaaaaggaaccaatatctcagtgacttgagaaactatgtgtcagattttgatatatgttcttccaaatttcatgtgtgtgtgtatcccctataaaattggaatttactgtaaatgcaattttgtaatctgcatttttacccttattacctgtaaacattttttgaaagaagaacaagcatttcatgtggtcaaagaaccaaaatcccccaggctcactctagtgctaatatttgtgattttctcactctgatttgatataaaataacataaaaccagtccatcatttttccaggactctctgggttgggtgactccacacaccctgtttacccagggtggtcctggttttcttctgctgttatagacagttccagtttggacaataaattagaatgttaccccacctctggggccctcccttgggaaatgagacccctcagagcactctctcccctgctcaggcaatggagcttctttctagcccccatgtgaaagttatccaggcaactgtcttacattccctcctgagctgagtttgtaggggtagaatttgggtcctgactacctatactcctccctgagtccacagcacaggatctgcagaggacaggttcctcttacctctcactggataaaggggtacactcagtcaagaggcgatcttacctatgtagtcaaaagcaccagacaattcctaaaccattctttttcaagtggtcttggaatggagtctatgcaatactaaatgtcctatataaagttccaaaagccagaagactgccatgcctcttccaaatactaatagattttttttttttggaaatggagttttgatctgtcacccaggctggagggcagtggcgcgatctggctcaatgcagcctctacctcggttcaagcgtttctctgccttagcctcccgagtagctgggattacaggtgcccgccaccacagccggctaatttttgtatttttagtagagatggggtttcaccatgttggccaggctggtctcaaactcccgacctcaggtgatccacccgcctcagcctcccaaagtgctgggattacaggcgtgagccaccgcgcccagccatactaatagatttcacttactgaccttctatactatgcctgacatggtcacttcacacaatcttacttaattctcataattaccttacatagtaggtaattattattcccattttatagatgaggaaactgaggctcagaggtcacatagctaataagtgattgtccccactgtttctcacatatcataatgtcaccctcaatttccaaatgaggaaatcagacaccaagaaagaagtagagcccagatgtcctggtcccagccttggctcttattccatcctgttttcctgtttgggtgaaggtgcaaactcactctctgcagaatttgcccttaacagaaaatggcctgaggtttgtagctagcactcagataacctaatgtggatggaagcatttcaaatgtttggccaaaataaagttggtggagtgtgcagctggagaacagacaacagtttcttagtttcttgtggtttatagaatcaatggtcaatgagccttctactcctgacatggcctctccagactgatgaaccccctgctcctgccccaggagtgttatctgacctttcctggagcaggaagaacaggaagttaaaaggcctctaacatacaagtcccatgtgcaatggcatctacacttttcccataagagagccgtttaggacctcaatcagagattactagcccttagttacagtcttatcaaatcatgctaggtgatcttatttccagcccactgcagattaggagaaggaaataagaaggccagggaggatgctacagaaccaagcagattgattacaatcaagcactggccaggcaggcagggaaaagaacaggacaatgaaaagctgaaaaaggaattcagagtacagcacctcaaaagcccctaagggcatcactgaactgccacataggacattaactgctggatataatgatgaacctgacgaaaagtgatagttggctcaagaaagcaggaaaggtgtaatccattttacaaagaaaacacatcattcattcaacatttaatgagcaccaatgcatggtggtagttcctggagatataataataaataagacacagttcctgactttcagaagctaacatcctaatgcaagaatcagaccactgagcagacaaatgataatacaatttcacatgtgcaatgacagagctatacacagggtacttaccataaacagcagatgaactcaaggaacacagctggggctattttggcacaaacgtcaggagagtgctggtgtcatagcccaactaataaggaatgtccagaggaggcccactgctcacctcagtctcatctctcatcatcacctttctaatgctctttcttgcctctgagcttttgtaaatactattcgactgcctggaacatcttcccctctcccatgcctttagttggctaactccaatacagcgctaggcctctgattagaagtcactttctccagtgattcctcctacgtttgaggtagttattgttcctaagagctcctctagcaccttaggcatctcccaattctagtatttattacattctatcgtaagcacttgcttacttgactacaattccccactagacaaaaaactcaatgaatacaggaagtgtgactaccttctccattgcccagcagtgtatggccataagtatgtgcttgacaaatacttgttgaatcaacaaataaacacatcaaacataaacaaggtcctaatattatctttggttttggaataataaaaataaaagtaataccagtcaacagtatttggtggggccctggagtcagaccacttatgtttgaatcccagctctgaacttactgactgtgtaatcttgggcaatttacctaacctctctgtgccaggctcctttatctatatgtggaggtaataacagtaacgccttcatgggatgttgtaaggattaaatgagacactatgaataaaggggctgggtacagtgcctagcatatagtagctctcaataaatgttagtcattatctcatcatgggcttccaaaagtgtattttctctgtgaaaaaaggcttcacttgaggaatcctgcatatactttcctctcagaaaggcacagtgaggtgggcaaagtgaggtgggggcagtggctcacgcctgtaatcccagcactttaggaggccgaggcgggcagatcgcttgagctcagaagtgtaagaccagcgtgggcaacatggcgaaacaccaactctacaaaaaatacaaaaattagctgggcgtggtggcgcatgcctgtagtcccagctactcgggaggctgaggtgggaggatcacttgagccaggaaggcagaggttgcagtgagccgagatcacgccactgcactccagcctgggtgacagagccagaccctgtctcaaaaaaaaaagagaaagtaaaagaaggaaggaagggaagggaagggaggggaggggacggagggaaggagggagggcacagtgagcataagaatagagttctgagttaagagtcatctgtttcactgggtgtcactcagcagtttcttgtttgacagctgaaccctcgttaaaatcctgcagtggtctctagataacaaaagctttatttactgttcacttctgcaggtgaagacaaccctagctttgagtccctctcggcctctactggccactcccagaagccggtgccatctaatgttatggaatgtctagcagtgcccttgcctttaaagatgtgaacatgtttccatgagagggaacctctatgactaataagacaaataaaagaataaccccttatgtttgtatcatgttttaaagtgtagggagcacttcaaggcaatcattccctcatcctcatgacaatccatgtaggaccgacagttcaagtactatcatctctattgaacagatgaggaaacacaggcttaaagaggttaggtggcctgctcaacttgcaatgctggtcggtggtaggctaggactagaccctaagcctgagtggctccatggcctctgctctatcttctgtactgtgcagcttctgccaatgcccacaggcccaagcctcatataactcagggtcggttgataccagctgaagctcagggactaagctaacttctttcaagaatctctaggaagaagcctctggcctctcagcttcctctcactgaagactctatacaaattaagaccctgctgaggcatcacagcaccagttagaagcagagcacttgccccttcttgccactgctcaggaatggcatctacaatgtgtgtgtatgtgagggagttgtctacaacccaccagaaaggtctccgactttccaacttggatgagttacttcatctcatcattttcatcttttccaccaccattcaaactaaaaaaagtgtagagagcttcagcatgaagtgtattccaattactttttatttatttatttttttgagatggagtctcactcttgatgcccaggctagagtgcaatggcatgatctcggctcactgcaacctccgcaacactgcaaccactgcaacaatccaagtgattctcctgcctcagcctcccgagtagctgggattacatgcacgcgccaccatgcccagctaattttgtatttttagtagagatggggtttcactatgttagccaggctggtcttgaactcccgacctcagatgatccacctgcctcagcttcccaaagtgctgggattacaggtgtgagtcactgcgcccggccaaaaaatttttttttattaaaaaaaaatatatagagagagatggagtctacctatgttgcctaggctggtctcaaactcctgggctcaagtggtcctcctgccacagcctcccaaagtgctaagattacaggcatgaaccactcactgcacccagccttcaaacaaattttccttcccacctttttcctttcctcctcccttcctgccacatagaggaccctggtgaccccagtatgactcctcagcaggcagcaacgtgtattagaaagaccatgggggctggagtcagcaagcctggaaagcaaaactgactgtgtgactttattaacatctgtgagattcagcttcttcatctccaaacagataatatcacctatctcacaagagtcaatggcaaacctaatttaaaaaatggacaaaggactggaatagacatttctccaaataagacatacaaatggccaaagagcacatgaacagatgctcaatatcactggctatcaggaaagtgcaaatcaaaaccacaatgaggctgggggtggtggctcctacctgtaatcccagcactctgtgagtgtgaaacaggaggatcatctgaggttgggagttcgagaccagcctggctaacatagtgaaaccccgtctctactaaaaagtacagaattaactaggggctgtggtggcacatgcttgtggtcctagcaactcaggaggctgagatggaggatcccttaagcccaggaagtcaatgctatagtgagccgtgatcacaccattgcactccagcctggaggacagagcaagaccctgtctcaaaaaataaaataagattcaatttctatttaatgtccagattaggcaaatctatggagacagaaagtaaattagtggttgccaggagctgggaatagttgaagagaaatggagagtgactgataatgaatacgaggtctctttatggagtgataaaaatgtcctaaaactgattgtcataatagtttgcacaactcttgtgaatatactatataaaccattgagttatatactctaaatggtgaagtgcatatagaaccaaaaagagtccaaacagccaaagcaatcctaagcaaaagaacaaagccaaaggtatcagactacctgacttcaaactatactacaaggctatagtgatcaaaacagcatggcactgtacaaaaacagacacatagaccaatggaacagaatagagaactcagaaataaagccacacacctatacccaactgatcttcaacaaggtcaacaaatataagcaacggggaaaggactccctattcaataaatggtgctgggataactggctatccacatgcagaagaatgaagctggacctctacctctcaccatatacaaaaatcaactcaagatggattaaagatttaagtgtaaaacctaaaactataaaaatcctagaagaaaacctaggaaatacccttcaggacatcagccttggcaaagaatttattactaggtcctcaaaagcaactatgacaaaaacaaaaattgacaaatggggcctaattaaatgaaagagcttctgcacagcaaaacaaactatcaacagagtaaacagacaacttatagaatgggagaaaatatttttgcaaactatgcatctgacactggtctaatatccagaatctataaggaacttatgtgggtcttttgtcttgttttgttttgttttgagatggagtctcattttgtcacccaggctggagtacaatggtgtgaccttggctcactgcaacttccgcctcccaggctcaagcgattcctctgtgtcagcctcccacatagctgggattacaggtgtgcaccaccacacccggctaatttttgtatttttagaaaaccctgttttctaaaacagggtttcaccatgttggccaggctggtcttgaacttctgaccatgggtgatccacctgcctcagcctcccaaagtgctgggattacaggtatgaaccaccgcacccagccaagaatctataaggaacttaaacaactcaacaaagcaaaaaacaaatcccatttaaaaaatgggccaaagacaaggacatttctcaaaagaagacatacaagcaaccaacaaacatatgaaaaaatgttcaacatcattaatcatcagagaaatgcaaatcaaacccacaatgagataccatctcgcaccagtcagaatggctcttattggtgaggctgtagagaaaagagaatgcttatacactgttggagggaatgtaaattagttcagccactatggaaagctgtttggagatttctcagagaactcagaactaccattcaacccagaaatctcattactgggtatatatccaaaagaaaacaaatcgttctaccaaaaagaaacaggcactcatatgttcatcacagcactattcacgatagcaaagacacagaatcaatctaggtgcccatcagtggtggacggaataaggaaaacatggtactataccatgggatactacatggaatactacacagccataaaaaagaatgaaatcatgtcctttgcaacaacatggatgcagctagaagccatcatcctaagcaaattaacacaagaacagaaaaccaaatactgcatgttctcacttactattattattattttttgagatggagtctctctctgttgcccaggctggagtgcagtgacacaatctaggctcactgcaacctctgcctcctggattcaagtgattctcgtgcctcagcctcccgagtagctgggactacaggcgcgtgccaccacaccagggtaatttttgtatttttagtagagttggggtttcgccatgttggccaggctggtcttgaaatcctgacctcaagttatccgcctgctttggcctaccaaagtgctgggattacaggcatgagctgtgtccagcctgcatgttctcccaaagtgctgggattacaggcgtgagccactgtgcccagcctacctgttctcacttataagtggaagctaaacaatgggtactcatggacatgagtaccctgttggatggcaacaatagacaccaggaactcttagaggagggagggatgaaggggggcacgggttgaaaaactattggatactatgcatagtacctgggtgatgggatcaattatacaccacaccccagcatcatgcaatatacccaggtaacaaacctgcacatgtagcccctgaatctaaaagaaaagttgaaataaaaatatttgatacaaaattaaaaaaaaaagaaatgaggtaggaattctagtgaggtgtgagaggagaggaagagaagcttttttatattaagctcttgtataattcattttctttctttttttattgatatataattcacactccataaaaacaaatggtgaattgtatagtatgtaaattaaaacttaataaagctgttaggttaaaaaatatatgtaagaagataagcatattgcctggcatgtagtaaggactcaataaatggtaataaattcattattgtaccctttcctcttcctgatgtcattccaatactggctaggatcacctctaacactaacactgtagaatatgtcaggctcattcgaggcagcccatttcatactagtggagagtcacaggtgagtcctgaaggctaacatcccaagactaagagttttcctccaatactcagacaactaaatatacaacagaacagtaagaaaataatggttccatttattgaacactcactatgtgcccaggtactgtgccaggaactttacgactattctcatgagaatcctactaggctgttatattattattcctattcattaaacgaagaaactgacacttagagaagttatgtatcttacaaagtcacactggcagtcactgactgagctggaaagttcaactccaaggcttataactctttttctctaagtgattacatggctttattatgctttctcttatttatgcacattttacccacactttacaattcaagcatcttgatttcactgatctccctttcctctatgccttctgtttacatcaaattagtaaacatttccttttacatagtcttgtgtgttctcagattgtttcatgtatattctcttaagtatggcaggttgcttaataaacacttctttagtgaatggatgttaagcttcctcaggcaggaaacacattcttgatggacagacactgtgtcttcaacatgtctttatcctttatatagagaaggcactcatggtcaagtaggttggccgatggctggaggaccattccctacttgaaaatggttctcacagacatcatgctttctgcccatggactggaagttttctccttaggaataggacctcacctcattatcaccccatcctagtgtagcatgggggctcagaatagagctgatgaattaaagactgggtcaacacttattccactggagacacctcaagggcagccttcccacagggaccccaagcacattttctctcacctccatgaaagggaagggggagaccaggaaggatggcaaggaacttgaagaagacaggctattgtccctgcctgtggccatgacagtcagtgcggcatcctctctgactcaggacccttctttttagtgcagacccagggggtgctttccagagcccacatctcaccttcacaccaccaaattcataaggtggggtaaactcttaagaatctgttagtcggttatctacagacccatcaaaactctgttttaacctcctctacttcctatctcgcctaactctcagagtagtgacatgctcacaagtatctagattcccttagatttgtcctataagtaccctgaggtcaccctcttccccctcctcccccacccccatcctatccaaagcagtgttctttgagctccagggatcctctggggcagggatggcaacaagaagaaggtggcagctctttgcctctcggcagctatgctacttggttggtcaaacttggtccctctgtgttccccgtctctacacctgcttgcctctcctctgccttttcttcaagatgttaaaaactcgcaataaaaaacaaatacaaaatgctgtaattaatagccaattccaagccaacccagcatctctactaataaacctcaacacttgcaaaaagaacaataaattctgcccctctctggttctgaggtggtctcttttatatagtctgtgtgtgtgtatgtatgtgggtaagtgtgtctacatatatatttattttcctttatttcccatccagggaggggcagaataatgaactgcgtgcgtcagggaagatgaatctgagatactagggagcagtgcagtaaaaagattaaagtgttattattgttgggtttttttcccccatggtccattgtgacagctcgaccgtcatctgtaaaaaatgtctcagtgagagataatcatcggaaactcaataaagcgtcagggggagcctcagcccctatcaatcactaggtgcctggaaaatttcagccctctgtctcccttcctgctatccatataaatgtctctaatatattttgtgtggtgtgtgggacccgtccctgatttggaacttttgatgaaaaaatatttatacacaaaatatgtaaatcagttaaaaatcataagactagttctttgccacccaatcctattgtttcttatttttataaatgcatcaaatttattctgtttaataaaacatgtcaactagtctatctctctctcctaggacacagacacacacacacacacagtttggagggctaaaaggatggaaataattaacctaactggctgattcatttaatcatgcagttggccaaaatgtatcctggtaactctatggtggccagaaccagcactatggagaaatgacatgtagaaacattggccatggagtgtgacaaggctctgagtgagcctggacaaggatgaggaaggggctgtgacattattaaaaataataaattgcccatacagcttttggcctggcagattctcccaagcctttggacaagccagagatctgagctgactaagctgggggcacatgcaggctgatatggttgctgggtcttatacaagagcaggaggcagttctgctggcatttgacatcctcactctgccttagtttcctttagtacctgcatcataaggttactgtgaatacaaagtaagtatcaatcaatattatctgctacccttgcagctatcatcatcatcgtcatctcattatcacctccctctgcttctctaccctggaaggaatcagttcctgcagtgccctctcctttaggaccttcaaggctcttctctgtctaaaggataaagtccaagagtcttgatctggtcctattctactaatgttgcatctttattgctcattactctctaagatgaatcttctgctgtgtgcctgcttcaccctaacatgttcgtctatcagcgtgaaacataatttttctgtttctcatatctgagtggtttttttgttttttgagacagggtcttgctctgtcacccaggctggagtgcagtggcgtgatcatggcttactgcagccttgacctcctgggctcaggcaatcctcctgtctcagcctcctgagtagctgggaccacaggcacaacccactacacctggctaattaaaaaatatatatattgggcagggcgtggtggctcattactaatcctggcactttgggaggccaaggtgggcagattgcctgagctcaggagttcgagaccagcctgggcaacatggtgaaaccctgtctctactaaaataaaaaattttgccaggcatggtggcacatgcctgtaatcccaactactcaggaggctgaggcataggaattgcttgaacccaggaggcggaggttgcagagagctgagatcatgccactcactggactccagcctgggcaacacagcaagactctgtctcaaaaataaaataaaataaaataaaataaaataaaataaaataaaataaaataaaataaaagttgtgtagagatggggtctcacaatgttgcccaggctggtcttgaacacctgggctcaagcagtcctcctggtttagccttccaaagtcttgcgattataggcatgagccaccacactcgaccactctgtatgttttgaatatagcacaccccttctctactcacattcaattgcactcacctgtcaaccctccatacagctgtccaaaaccttcctatacttggaggctcaaatgtcattttatttccttgacttctcagccacagattctcttctctgagctctgatagtccttgttatctgaacctctgactggaccctttgtcaaatattgttttggtaatgtcttacatctttattattactaattattgttcttgcaagcaccttacatttgcacaatgccttgtattttctcaagcgctttcgtaagtactccaatttgggccttaaaataagcctatggtgtaggaaatattattctctacagatgcgaaaatcaagctcagagagcgaagaagaactgccaaggtcacacagttaggtaatggctaagccattccttggactctaaataatatttggctctttgagggttaatggtttgctaccagaggaaagcatttggaaggctgtgtcaaagactgacattccgttaagaatatgaggaggaggatgtagaaacacaggtttacattcacagaatttcttctatgttctggggtttaggttaggcgtaaatgtactatgctgcctcccaataacctttattttacaaataaggagacagtgcctctggcaggtatagaaaattgctccaggtgtcagagctattaagtgttctgcacacatataataccatggcttaaacacatagcctctctaggagtgaagcttaaagtggcaaaataagatctctggtagggaggtgaaggcccagatgagttttttaagcagttcaagcacaacaccacaactaatacctgtagtccaaatcatgcttcccaaagggtaggagcctattattagaaacgcaaaacctcgggtcccaccccagacatactcaatcagaatctctgagggtagggtccaggaacctgtgttttaacaagctctctaggggattcttatttccttgggagccttattattctcatctgagtttttgctctccaagagcatgcattctctctgctatgcttgggttaggctgggcacacagtgggtgctgggtagttaacttatactgagtaaaagagatagtcagatgagaccatccttggcatgtcctggggagggggagaaatattatacagagcagttccattaccgccagcggggagtcctagccatctcctgaactccagggcacttgtccactggtttgtgatgtgccggcttgcaccgtcctgtcccccatctgaagacacagagatggggaggtcagctggagcaggccaggtcctgcaggccctggagctctgggaagggggcactcaggctggtggggttgttccaagccctctacccccagaagggccctatgccaacccagcttctgccccactcatctttattcagctgccacttggagctgagaagagaggctgatttatagcctgctctggctgcgtctctgccgtgttttattgttttaattgtacatatgagaggcactcaaaatgcttgcttgcatttctgacagccccagacacccaatgtttataacagttacttataagcagccagcggcaaccccggctgggcgacttgtttactgttaccactaatttattacctcctccatctgaggattacggcccccacccatcagccagccacaagtggaacactcctggagtgggcatgggtagggctcaaggcactgaatggaatgtggttgagatcagggaataggttggcagaggaacagctatgatcctcatacttctctctacatttattccatctcacagacattctaagctgtgccctctgcttttttatttttccccatcctcttcatcctccaaagcccaactcaaatcccacttctttcaagaatatcacattgggtgcagtggcttacccctgtaatgccagcactttgggaggccaaggtgggtggatcacctgaggtctgcagttagagactagcctggccaacatggtgaaactccatctctactaaaagtattagtaaaataaaaataaaaattagccgggcgtggtggtggcgccagtaatcccagctacttgggaggctgaggcaggagaatcgcctgaacccaggaggcagaggttgcagtgagccgagatcatgtcattgcactccagtctgggtaacaagagcgaaactctgtctcaaaaaaaaaaaaaaaaaaaaaagaacattacttgctctgatagtgagcctagagcttctaaacattagaaatcacatggctgacaggggcaccggaggccagataatccaatgacccatggcgagaatcccctttacagaatccatgatgggcagacatctcagctgttagtaccccttgagtggtgagttgctcaatacctcctaggcaggcttcctgctttacactttgccaaaacccacctccatagagaaattctttattaaatgtcactgtgctttaaatatatatgattatctctaatcatcctaacaaccctataagatgggtattgtttttactatgttacagatgagaaaattgaaattcagagactttaagtcatttactcaagatcacacatctagtaatagagcttagatgaatcattcagatatctggtactgaagcccaatctttctctaggacaccaatgtgcctctgaagatgccactctgagggctggagggaaagcaaagaacaatcaggccaacaagatttccataccaagcatccttgggttacctgaaccagtaagactgccctctacccagaaacaccaactttgacaaaagtggacccagctaagtaggcttcttgctaaagagcaaatgctcacatgacatgggagaagagtgtcactaggaatggcataaccaaagataaagtctcagcaaggatggcaaagaagtttctttcctccctaggctgtgtctgttctcagcaggtaaaacagatacaaagcatctttgataccttttagttttcttgcctggatcctttttcctgctcacaccttaaatgctggtatcctgagtaaaggacttgtcctcctaccaccccctcactttaaatcctttctttgggcaattttggttacatctattgttttaactcccaaggaaatggaaaatactcctaaatccctatctcctgccaaactactcctttgagctctccagacccacatatctaactattcactcaaattggaaactgaggtgtcaccatgcatacctccttttccatcaattctcacaatccactgagtactcaatcttctaatattctgctaatatctatttactctattcccaaagatcacctttaggaatctccagatattttaaatgtttttttggaggacaggagcatagcttcttacagattcccaaaggagtccattatccctaaaaagtcaagaaccattgctaatctttcccctccaattcctcctccaccctgtcagaatggtccatctaaaatgcaagtgtgaattcgacattgccctgcttaaaatcctttaacggccttcagaatagagaatgagctccctagaactgccttacaaggtccttcctatgtgtagccttcttcactctccggccttatttcttgttattctcctcaatcctgcagcagatggttccacctgctgtcactccctaacccccacccaacgcctctgcatagactgttccctctgcctggaaggtccatcccttttagccttcctggcaatctccaactcatccttaagacccaattcaaggtcacttaccctgtgacacttcccagacaccagcctgctcacttctcaggtagagctcaccaatacttacagcagtgctgcctacatactttgtgcagctaccattgcatttatcactctgcgttgtgattccttgtttacaggcttgtctctgtaaatgactgggagcactgatgaggggctagactatgtataatcatttatataatcccagcaactggcagagtgcctgatactcggtaagaacacgctgaattatgcataaatgaaactaataagcaattacaactgtagagcactttacaatccacatatcacatattttatctcttgatattcacaacaatactgatacggaagaaaaggaatgtatcattggaggttagagaggtcttgccaaagccacaaactacaccttccttccaagggccacagaaatatctattagaaatttagtggacttcatggacttggcagtgactccatagtctaatataacagcaaaggactgcccaactttcctgagcttgtgaacttcctgtgaatttgcctagacacactcgaaggaaagggaattacatctcttgttttactctaccttccttacccatccctacaagtcaggtaatttttcatgcaaaagtcaatgcaatacaaaaataagagaactacaggattcttttgtttctatttcatccatgagaatgagtcagagctgggtatggtgccttgcatacaattggcagtcaatatatattggttgaatggcttaaaaaatgaggtttccttaaacggaaaaaggaaagacatggttaagacgaagctaaaggcttaggctgatgagagagaagagccctgagaagattctaaaagactatcactatccaggtccaagtcggaacgttcagtgcaccaagttggacagcagagcacatccaaactgatacacccaggaaaataaagccagctgccagaaaactgtggcagacaaaggtagtctagaattatttaaaaaaaaaaaaaaaaaggtagagagatcttgcaagccacagtgagtttattaatgattcctgacaaacttctaggacgttattattattatttttttttaacagttgtttgtttttgtttttgttttgagacagggtcttgctctgtcacccaggctgtaatgcagtggtgtgatctcagctcactgcaacctctgccttctgggttcaagtgattctcgtgcctcagcctcctgagtagctgggactacaggcatgcaccaccacgccctgctaagttttgtatttttagtagaaatggggttttgccatgttggccaggctgctcgaactcctagcctcaggtgatctgcttgcctcggcctcccaatgtgctgggactacaagcgtgagccacagtgcccagcgttttataacagttcttaaacacttgggtaattaccgggtaccagtatgggttccctaagaacaataaatcaacatgccagaataacctgatttccttttttggaaagcgttattagacaggaaaatacgacaaatgctagaaacattttaattttagcaagaaatatggggaaaaagctcttaaaattttgtgaacaaagcagaggaatggaggatggaaaagaatgaaggttggtagaattacacctgagaatgctgaataatgcatcaaaattatcctgaccatgtgctctaggactctgtgtttaataaagtctttataaacattttaatccaagtaagaacatgacggcaggggatcttgtctgtctaactcatcagtgcttaaaacactgcctggtatacaggaatgtgatcaataaatacttttgaataaataagtgaatccacaggaagcctactactaaatttgcagatcatatgaaataagaagagatagttaatattttaattgttatttcataaggggacatgatagccttttcaaatatttttgttgtctatctctccctatctacctacctacccagaatgtaggctgtctggcataagagttaaaaataatccagaggttgaccaggaaaaagaaaataaaagaaaaaagaaaagaaagggaagcaaaggggaagggaaggggaagggaaggggaagggaaggggaagggaaagggaaggggaaggaaggaaggaaaaactaagaaaaagaaattatgtaaccttgaactaggaatgcgaaaagaaaattatgtagagcagggttggcaaactacagcctctgggccaaatccagcctgctgtgtgtttttataaataacattttattgaaacatatccacatcacttcgtttgtgtattgtttgtggctgcttctgtatcacaatggtcgaggtaagtagtcacaactgagatcaactggcccacaaagcttaaatgtttactatctggctctttctagaaagtttgctgactactgatctacaatgttgaatgtgagtatcaccctggaggttaccattaaaacacaaagctacaaaacatgaatgtacattgtggagatcagtgtgacagcagaagttggactagatggcttcatagctctgagattctataaaacaaaaaaatgtttattgagccctgctagaatcctgacagcagaagagaaggcactcaaaagaatcccctcctgtctacctggccctgccctctcaacaaatgctccaccttgctttttggtgagagcacctgtattagttcgttttcatcatgctgataaagacatacctgaaactgggaacaaaaagaggtttaattggacttacagttccacatggccagggaggcctcagaatcatggcaggaggtaaaaggcacttcttacatggcagtggcaagagaaaaatgaggacgaagcaaaaatgggaaacccctagcaaacccatcagatctcatgagacttattcactatcacaagaatagcatgggaaagactagcccccatgattcaattacttttccctaggtccctgccacaacacgtgggaattctgggagataaattcaagttgagatttgaatagggatacagccaaaccatatcagcacctaaactgaagacagagctgagcactgcaatgctgtgcctgaatgagaagaggatggcccataagctgagtccccacatatcaggctgcaaatagagggcaaggtggtactcatgaaattctctgtttaaaacataaacacaattcctccggctcagtggggaatacaaggacacaaagatcatggcctgcacatgaggaggagagaaaggacatatgggtagatgagagttcaagtaaccatacaagaggccaagatctagagaacattcaaaagaacagctgagggcaggttgcaattattgtcaaggacagggaagcctttgtggaggatctagccttagcaatggagccttaagagaaggagcaggtttagagaggtggaagggaagggagagggtaacttcaaactttacctgggcagcaatgccttaatgctcttggacactcctctcatgccactgatttgagaaaccttctccccggggcagcaacaacaccgctactctgagttaccacataccacgtcagtctggcagccttacagctctgaaggctgagcacattgctccccttggctgaatttcccccagcgtcaatattctggctctcaggcagtcagagaggctgtctgtcctcctggcatcactgctaacactaaagcagccactgctcagccaccctattgctggcaatgtcagagggatcgcagcctctgtgaatgatccaggacaaggggaaagcagtggcgacagtctggataaacgaaagctcaaatgtaaaatactcatttctgactgcagccaaagcaaccagctgtttttttcaatcccactttggaagaagtactcaccagacacaacatagactgacttgctgaggcaccccccaacagacacatgatcgagccctagtgcaaacccaaacacctgccttggacattcaatccccaagactcatcccagagcctcttcattctgaagttcaaaccaccaccaacacaacatcccagacatcccagaggaggcattgatgatgacctcattttatgaggatagacatcaaaacacagagaaggtccactgtttgtcctggatcatagagtaagttgaggggacagtcccagagacaggactgcaatttacatttaggagggggaaaagcagtattcagagtaatagtatttagggacttctgaggctgaggaatccagtgaggctgttgtctagttctggggcaggaatggggcaaggtaagtctgcaggaaacaggagacgaacaaatccacattccatgcagttgccttaattattttactgaaatctgctccgttgtccactcatctgcggctctccaggctgaagcactttcaggaaaacaccagttgaaatgtacttcctacccgcaattaggtcatgaaatcaggcctctatttctttccccaagacttcttttgaagtgacataaagttagagccaggggactgtgaaaggcagctgttccaagccctttggggtctccatgagtccacagaggtaaagaacatgcaggctgtcactctgagttgctggtagagctgacaccacagagcaaggctgcatgaaagccacaagaggagagctctcagagaagcaggacagcccacacttaccttccaaagaatggattccctgttccttggcagtcttgtaaacactgctgaaatcatctccaaggtttggatcagccccagcagcaagcaggacctgtaccacactagaagaaatcacaaagacagaagtgtcaaaagcaagaaaggcccaggaggtacagacccagatccggaagcatgtttggggactggagctgtctctgctcatgtgagtgatacggtgggaaaaaaaccatgaactttgggagtgtaaaagacaaggataggaaagacagggacaggagatcttagccgggtgcagtgactaatgactgtaatcccagcactttgggagaattacttgagtccgggagttcaagaccagtctgggcaacatagtgaaacttcatttttaaaaaaaaaggcagcagcctctgaaacttatcagctgagaagcttgggacaagttacttaacacctttctaaggcccagtttccacaattataaaatacaaactgtttatccaacaattacttatcaaatgcctaccatgttctagtccctattttaggtgctgaggtctgtgacctcaagaagctagggccagtctgctgagaaaaacaataattaagtataaagctacagctcaaagtgtgataaaggttacgacaggagaaacgtgcagcagaccaagaaacaggatcaagaaagcccttacggcatcagcaagatggcagaacaggactctccagcacttgctccccagcagaaacatcaatttgaacaattatccacatgcaaaaataccttcacaagagctaagtaaaccaaatgagagattatagcacctgggcgtagcacagaggtaaagaaaagattacctacagagggtaggaagacagtctccccttacccatatcacccctccccgaactccaggcggtacacatggagagacatacactcatgggggaaggagagggaagtgagggctggactttgccttggaccctgaaaccaggcccactccagtaaaactcagtgcctggaaggctcccaaactcccggctgataccctcagactaagcctctaggcctgccctggtgccaggccataccccatagccccaggctccagatctgcttcctagccagactgaccttagcagcccgactctggccctagtgccaggccagccccagcagtcatggactctgggcccaccttaacatgagcccagcccctacagactcaggcttcaggcccaccttgcagattcaatctccaggcccatcctagcgccagggcagccttggtggcccagggctctagactccccccagaaccggctggggcatgaatccaggcttcaggtctgccctagcactgggtcagcctgacagccttagttatcaggcctacaccagcagacccagcctccaggtccaccccaggctccagcccagcccacagccaagttggtccacacagctcagagctttaggcctgccctagcaccaggtcagtacccctggccttaggcactgggccagcacctgtggacacaggctctaggcctgctcagtttcacaccagtccctgcggccccacactccaggcctgctctagcaacccccaggcccatcccagtagacccagtactgagctggctcccacaaatccagactccaggatagccctcatggacccaggtcccaggctggccctcattgccctagtacccaggctagccctcacagacctaccctctggggcagcatctgcacatccaggctcttgaccatcactcacagacccaggctccgtgcctgcccaggaacaggccagcccaggctccaggccagtccccatgccacagacttcagtgaacccaaagtctaggcctgctccagcagactcaaggtccagacccactccaacagatgccagtaacagcctggcccccatgggatgagactccaggaccatccctgtatacccacgttccaggccagcccttgtggacccagggcccgggcccaacccccataaactcaggctccaggtctgccccagtaccagaccaacccctgtggacttaggctccaggcccgtccacctggatgcaggcgccaagtcaatcccaatgactaaccattccctgcagattcaggctcaaggcccatgccatcacagggtcagtccctgtgcacttaggcttcaggctggctcccgcagatataggctctcagcccacccctgtggtcccaatcaataggtccactccagtgggcccaggctccaagcttaaccctatgaacccaggcaccaggcccactcacctgctgacccaggtaccaggccagcctgcctaaggacttcagcaccaagatcattcatgaaccacacaagatggcctgcccagaatctctggacaggctgaatggtgaagggctttctcaggcaaagccaatctgcaaagactggataagttcctactttttcacatgctcagacaccaaagcatggccagaagaatcaagaacaatcagggaaacttgatcccacccaaagaacaaaacaaaggatcagtaaccaaccctaaagaaatggatattcatgacctgcctcacaaataattaaaaataattgttttaagaaagtttagcaaacattaagaaaatatagagaaacaatttaacaaaataaggaaaacaataaatatcccaaacaaatttaagagattgaaattatttttttaaaaaacatcaaaagaaatcctggagctgaaaaatacaatgaatccaatgaaactgcaacacagagcatcaacagcagaactgatcaagcagaagacagaatatgtgaactcaaaaatcagttatttgaaaataggaaggccaatggtttccaataagattcagtccaaataacactacaccaagacatattataatcaaactatcaaaaattaaaagacaggctgggtgcggtggctcgcacctgtaatcccagcactttgggaggctgaggggggcggatcatgaggtcaggagatcgagaccatcctggctaacacggtgaaaccccgtctctactaaaaaataaaaaataaaaaaattagccaggcgtggtggcgggcgcctgtagtcccagctactcggaaggctgaggcaggagaatggcgtgaacccgggaggcagagcttgcagtgagccaagatcgcaccactgcattccagcctgggcgacagagcaagactctgtctcaaaaaaaaaaaaaaaaaattaaagataaagaaggattctgaaagcagtgagagaaaaaaagcaagtaacatataagggacttccaataaggctaacagtggatttcacattataaaccttataggccaggagagaatgggatgatagattcaaaatgctgaatgaaaaaaaaaccctgccaactaagaagactatatccagcaaaactcttcttcagaaatcaaggaaagataaagactttcccagagaaataaaagctgagggagtttatcaccaccagacctgtcttatatttcttagacaggtctgacggtaataaatttatatgaaatgctaaggagagtgcttcatgttgaaagaaaaggatgctaattagcaacacaaaaacaagaaagtataaaactcactggaagcctgagaaacatgctgaaaccccatctctaccaaaaacagacagacaaacaaatacaaacattagccaggcgtggtgtcacatgccagtagtctcatatactcaggaggctgaggtaggaaaatcacttgagcttgcggggcagagattgtagtgagctgagatcaaccattgcactacagcctgggtgacagaatgagaccctatctcaaaacaaacaaacaaaacaccccaaaaacctcactggtaatggtaagcacatagttaaattcagaatactatgatactgtaaatggtggtaagtaaatcacttttatctttagtattaaggtcaaaatacaaaactgctaaaaataatattagctacaatcatttgttaagggatatataatacaaaaatatgtaaattgtgacactaaaaatacagaatatgtttgtggcgggtatggaataaaagtgtaaagaaaccacaaagtaaaacctaaagtagattcataaaaggtaaaaagtaaggaatataagtatactactaaagaaaaccacctaatcacaaaggaagacggcaagagaggaagagaggaataatggatctacaaaacaaccagaaaacaacaaaacgtcagaagttagtcctcaccaatcaataattgccttgaatgtaaatggattaaaaagagtaagaccctactgtatgttacctacaagagactcactttacctataaggacacacatagactaaatacgaaggaatggaaaaagatatggcatgcaaatgggaaccaaaagagagcagaagtactgatattcatatggaataaaatagactttaagtccaaactgtaaaaagagacaaagaaggtcattatataataataaaggggtcaattaatcaagacactataacaattgtaaatatatatgcacctaacatcacagcacctagatatataaagcaactattaatcaatgggaagggaaagatagactatactacagaaacagtagggacttcaatatcctactttcagcaatggacaggtcatccagaaagaaaaccaataaggaaatgtctgacttaagctacactttagactaaatggatataacagacctatacagaacattccatccaacagcagtacaacacacattcttctcaagcacatgggaacattaaaggtctccccttacatgcatctccttagtccaaattccaagagtaactactgtttatagattggcaagtttccttccaaacctttgcaattacaaaaatcactccagtggctgtataagaagagggagtatgaccagaggcagggactccatgttagcttcccttcttcctgctatttatgtaatattcccactaatacattttttccttctaataaaaaagggctcatgttcactataaaaaaccagaaaatatagataaccaaaagaagaaaacgtcttagaacatataacatctttccagtttcttcaatggatatatacatacttttatttataaaaatggcatcatatataaactttctctctgaatgcacatacatctttccatgtattatatgtctattacattgttttactggctgggcacagtggctcatgcctataatctcagcactttgggaggccaagatagctggatcacctgaggtcaggagttcgagaccagcctggccaacatggtgaaaccctgtctctactaaaaatacaaaaattatctgggcgtggtggtgtatgtctgtaatcccagctacttgggaggctgaggcaggagaatcgcttgaatccgggaggcggaggatgcagtgagccgagatcgcgccactgcatcaagcctgggcgacacagcaagacgccgtctcaaacaaacaacaataaaaaaacccacattgttttaaatggctacacagtattccactataagactattccatgcttgatttaaccaatccctactataaaacaatagattgttttaaatattttagtaacatatttctgattatttcctttggataaattcatatgagataaaatttacatcaaaaagtataagcattttaagagttttataaatattactaagttgctttgcaaaaagattgtgctaatttttattttcactagcaaagtatgctgtatgagagtaactgctgtgccttcctttaccaaaatagagtagtttttttcttcttttccagaatatgtcaatctggaaaacagaaaatagaatcacactgctctttcaatttgcattttttgattactagtcaggatgaatttttttaaaatatgtttaatagtcagttgtgcttcttcttcacaaatcccttattaaggtcctttgcccatctttctcttagggtgtctatcttttgcttactaaccttcaaaactgctaatgcttctgcaagcagaagtggtaagcattttaaacaaattacttatcgtaactattaaaaagccaaactatggcttgttttctcttccttgatagttttttagtatttgtaaccagtaatgttgatggtttcccacgtaccatttggtttgaatttcattaccttcaacaggcacagtatctgattcaattacttgctgaacgaatgaaggaatttcactaacttacatgcacacaaagatacagtccttacaggtaagcccaaaaccagattccatctcctacatagcagtggttcttctatatgtgacctaaatcagttaagtgagtcttctgtgcctactcaccttacctaaaataacttttaaaattaccttcaaaggtaatttatccagaatatgaattaagatttcaaagagaaatgagaagggtctctaagcagctaaaatctatgtctaaaactcatatgtttaattcatagaagtctgttgggttctcatttggagactatttactctcagtttatacacaatttggattaagattggcattagtcagtcttcctatttcccagaacgtttaaagctaagagggtacaaaaaggcagatacagataggcaaactaactgaaagcactgcaaaacaatgtctgatagagaagtagtatggcacagaaattaagaaaactggctgtaaaatctgggatgatcagagcatcagaatgaataatgacagtaatgtattataacccattaattatatataattataacccactgagtaaaataagattctccattgaagtccacactgaaaattaataagtaaatggagagaagggaaagttctgtcttactatagaatgaaaactaataattgtagaaggaaggatgaaattagaaaaccaccattttgtggcctcataataattattaggataataagagtagctcatctggttgtgttaatacacataaagtagcttagaacagtgtcttgacacataacaactgctcaatgaatgttagttattattactatgtacctgaccctgtggctggactaaggaaagtcaggagacataccaattaagacatctaaattgggaagacagcatggcattttataacaagcacagagagacctgtgttcaaatcaaagctctatcatttactgattgtgtgttcttggaccagtgactacacctctgggccttcatttccttaccagaataatggagataatgatggctgccgtgcaggttataagtacgtaaaactccatagtgcctgacacattaaaaaaaaaaaagctccacaaatctaagctctttaccctctgtttgtataatctcagcaataatcacatgaatctgggctgtgatgggcaccagatctatacctgaccaccctagcactcatgctggaatagtcctgcgttaagaaggcagctcttctatattctgcacaagttgatgtgtgttaaaatccaagtgtcgatctaaactcaaagggacgtaatttggttaatcctcagctgctgtgtccaatcaccattcaatcacaccccctcccatggcaggctgtccctccaggcagctagcgtcactaactgtgctacctgggcctctccaggttcatgagtattgatttcatctgtccaatttgcaggctgtaggacgtgtccaagcaaccacgtatgttgcccttggtcccagagggcagacagtggtctagcagggtggggagaagagagtgactaggatcgaccctggggctgctaacccaatcaaagggaataagcaattcacttcacaaacttggaggccaaagagggtaagcatccaagacagtgactcatcctgaaacctcagagaagattcccttccccttttttttttttttttttgagacagaatctcgctttgtcgcccaggctggagtgcactggcgcaatctcggctcactgccagctccgcctcccgggttcacaccattctcctgcctcagcctcctgagtagctgggactacaggcacctgccaccatgcccggctaatttttttgcatttttagtacagccggggtttcaccgtgttagccaggatggtctcgatctcctgacctcgtgatccgcccgcttcagcctcccaaagtgctaggattacaggtgtgaaccaccatacccggccctcccttcacttttaataatactcaaaaggcagcagcaccactgtggggtatagacagggctaaagaaaccatggctgctcagtaaccaacagtggcgtcaaacaccttgacatatggccagtaggttttttgttcaacagccttcatgtacttataaagtatctaaccaagagctccaaacgggtcaggcccttcttggagaagccagcccagatcgggctagagggctacaagagtatgattcaccactagctttgatcaccaaaagaacctcactgaaactatagcatatagcatatagcagggcagaaacacggtagaaggctagccaggttagagaaatctaaggcaaggatggtgaaaacgggctcagcagtaggccaacaccagggagtgccaagaagttcacaatcaaaataaaattaagggccacacaccaggcagcaaaggtgtacatgaggtcagaggtcaagaactagagggtgaggtagaacagattataaaccaagtgagtagccagaaaccaaggattacactggtaccagaagtcaaggcaaggcaaaagcagcagcatccaggagcagcagtaaggagacaatggaaatggaattatttctgcctcttttattttctgctgaagcagaaagaaatccccaactcaaaacagtatttgggagaaggtgacttacatggggagatgatggtgagtcagcccacctggctgatatacagaacacagagtgagcaataagaaccaaatctgatggcacagaggaaggtaggcactgctactggagctgatccattaaaggacaataggacagtagcaacttctcctttgttctgatgctggcatactggctgccatgttgtaggtgtgggtttcactattactgtcttaaatttgagtagctggtaccacatgggctgtggtataaggctaggtcttcacggtcttaacagttggattaaaggaggcagagtaaaacaggccactcaattatgtttttctatatcaggacacatctccactcaaaggaattactccacaggcactcactgggcaaaggcttaagaatatcagcgattctctggctggcatggtggctcatacctataattccagcactctgggagactgaggaaggaggatcatttgagcccaggagttcaagaccagcctgggcaacatagtgagatcctgtcacttaaaaaaaattaaaaattagccaggtgtggtggcacatgcctgtagttccagctactcgggaggatcgcttgagctcaggaggtcgaggctgcagtgagctgtggttgtgccactgcactctagcctgggcaggaaaaaaagaaagattatcagccattctctcaaccagctcaagatttggcctctcatggtagtacaaccctcaaaggctagggataatctccagataccctattacccttactaatttggggaagcagagaatgtctatggcacaagtatgttatattgcctttcacttcccaatactgactttcaggtagttaatagtctgtaggagcactttgccccagatcaggctttgatagaaatgctaggatcagaaggcccaacatgccaggcgcagtggctcatgcctataatcccagcactccgggaggctgaggcgagcagatcacttgaggccaggagttggagaccaccctggccaacatggtaaaaccccatctctactaaaaatacaaaaattagccaggtgtgatggcaggtacctgtaatcccaactaatcgggaggctgaggcagaagaatcacttcaacccaggaggcagaggttgcagtgagccaagatcacaccactgcactccagcctgggcaacagagtgagactgtctcaaaaaaaaaacgaaatagaaaaaaaaaaaaagaaaagaaaaaagaaaaagaaggcccaacaaaaatgaggcaaagatatcaacagccaattcctagaggaggaaaccaaaaaaggattattactaggtatataaagaaaatcttcaagttcatttgttattacagaaatgcaaattaaaatgagatatcactgtaaattcaacatattcacaaatgttagaaagctgaaaaatggcaagtgttggtgaagatgtgaggatctgggacacttcatgcactgttagggtatagactggtgcagccattctggaagccaatcttgcaggacttcattaaagcaccttaccctatgaccaagcacttctgctcctgagtatacaattcttagaaaaattcttatgcaggtccataaagggcaacacaagaaatggttcatcacagcattctgtggcagtggggagttgcgggccatcaagtgtccaccactggggggacagataaggtaaatgtggtagtcacacactatgaaacacgatgcagtagttagaagcaacaggctggatatacatgcaacaacatagatggatgatttttttcaaaaagtgttgaagtcctatctcttttatttacatattaattgaacttgaccatttgttccaaaagttaatccctttcagggagtctctcaattataaaacttctaattcctatatgatctagtagtcttgggggctgaaatattaaagacccactgaaaacaatgaactccctgcagtacaccaagggccatcaaagatgccacctgctgtcccctccttcaactggttggtgttcattcaccttcagggctccttggtgacaccatcaccaactcaactgtgccttctctgattcccagtatgagtccatgctctttctctttgtctgcacagcacccagtactcactcccatggtaggtgaccctcatattgtatcatgatggcctgcttacttttatttgcctttcccactagactatggggcaagggccatgtctcaaccttatttcccagctccctgcccagtgcctggatcacagatgttttctgaatgagtgcatgaataaataaatgaaagatgaataaatgaaatcattaatttatttgatggaaaatgggagagaaaggtggacagcagctgtctctgccctgctcagccttctcccacctgaaggtcccaactaggctgcgggtggtttagctgtggaaaacgtatatgttcctctcctgaacagtagctccttcctgggctacagaaagttcccagacaaagctcaggaaatgaacaggagggtggtcactaagtggcagctcctgagattcatggaactccctttggagccacagccaaattaatttgctgatcaggctgtaattagattaaaagtggaagcacatgtaggaaggttggctcacactgaccttgatgagctcttgctttcagggtggtggggagtcacaataaatgggagggcagttacttcaatcagtgtttaggctttctgctttcagtggccagagggggttggggtgctcacattgtttagggaagagcgagaaaacctatggtgtgagctcaggcttgtgttgggccaggcgcgtgtcaaagacggctggcgagcagctggagttggtgaagcaagaagggcagtgatcccagctccaggtcatccctacacaatgttgagcttcagaagaagctcctctaactcctcctcctccccaccccccacatctgaagcataggatcactgtgatgagtgtcacgggtcccaaggagaagacaaagagtgacctcttctcaacccagtgcacacctcgatgaggggaggaagtgaaaaggtcacagttcaggaggtctgctggaaagtcaaatgagttgtggctcattcagtaacctggtctctggctggtcaggaaagccgggtggcccaaccaaaggcactagcatttgttaaatctacaagtcctgtggcatggggacatgagctgagagtagagagggcacagagaacagttttctttttaaagccagattcctaaggaaatgaattaaagattgggtaggaaataaggtacctgtatagaaaatgtgccccagtttcctcaaatgaggataatgtttatttatttacttcaaaaagtaaagatcaataatcataataaagcagccgcagtgtgttagacactttatattcactatttcagatccttataacaacttgcaatgaggtaccagtcctattttataaataagtaaactaaggctcggcaagataatatgagttacccaaatgtacacattaaataagcacaagaaccaagattcaaaaccaggtctgtctgagtctaaatttggtgtacattcccctaaaccacgttggctctcacccaactgaccatccattagtctgtcttcttatcccatagttactaagctcttactgcatagtaccaggaacagtgatattttcagatggcagttaaagcaaagcaggtcatagcagctagctgggataagaaggagtctgtttgagatagacaagggtaaaaatcagtggtgaacccagacagaggtgatataattaggggcaaggctcgaggaaggcatggcacgttaagctgatggccaaggaatcaagatcacccacaacagggtttccaagataatcccaatttcacatcctcagcgtagttctaaatacacttccatgtctttcaatttgtggttcataatatatggtcaccaaacctaaggccagtgtagtcaggccctagatgttaggacttattacagtatggacccagactaggctctctctaggcaaatgatccagaacagtatgatggggctggcatatctcttagactcgggtgaaaataacaacaaaaagaaaaaacaatattaataacagcagcagatacctacttattcactacactaagtagttttatgtgcattttaatctttgcaaccaccttatgctgaggtaggtgccattattattcccattttgcagatgggtaaactaaaaaccataagaggcacagcaaggtcttcaacacaggcagcttcactccagagcccctattcttcactaccatagtatacataagtagactggatgctccccaaagcagggactgtgccttgactatttccatctccacacacatagggcctatacagggcagtaaatatttgctgaatcaattcacttctggggcctgatgttgcacagcagacaacatattgggtttttagtcagcttctagactttacttttagtattgctaagttttgcacgttgggttttacagttggtttttaattgttgacccatatacttatccttgttagtttttatcaacacagatttaaccattgctctagcccactgaggttttatttaatgtcccctattttttcacccaatatattagtacctcctcaagcttcattaactctgttggcatttatcaatgacctcaatgaaatcagtgatataaaatactgaacaggacagagccccattgctcaccactcaagcctgctctctagtctgatgtccattcatacataaacaatgaaccaggtcatttacatttactagtctgactatactatttttacatcataattttactcatatagatgtcattagagacatccaaatatcttactaaaagcctgaaacacccatgatatctactgccgacccctggcccaccagcctggcagctctgttaaaataagcagcttatggtacagctgtttttaaagaagtctcttaaagaagaggtatagaactagaccatctcacagttcctagagatggaacaccctgccccaagcagctgaactgaatgaacactggatgctttcctatccccaactgccactctccataatgaacactggatgctctcctatccccaactgccactctccataatgaacactggatgctctcctatccccaactgccactctccatgaagacagcactgaacacagaaccccaggacagaacagagcattgggcccaggaagtataccctgagactgtcacgttaggcaaatgagctggcactgatttccagggagcagcgtcttgagttgcctgaggttgaggcatgtgtctgccaaactacgagtgcatgctggaattggaatatcattaccacaaaacaggattatcttgagcaacgattccaaatgggattagaaatgactctttcttactcagagataatcggccatagcagtaggggtgggagaaacgtcaagcccaacactttcctgggggcacggtgctgcggtgctggcattctgggcacttggccagcaccctcacccatccttccttgctggggaatactgggtactgtcctgcactgggcaggtggccacctgtaacaaaagccagcctatatcaaggtaccctgctcaggggtcccatgttcttgggttccctgccggttgcttctacgagcacatctctgctttccacctttgtgagcctatgctcacaatggtccttctgcaaatgctctccccctactccctatgttaccaatcaaatcctgcccaactcctctgaaagggcctcttttcatgatgctggctctacacagcatcatctcctccacagcactctatgtgttcttctctgtggcactgaacacattctgcctcattctccaaagcgggacttttatcccttttctgagtgtcagctttctgagaacaaggagagtggcttgtctgtttttacagttctcaaaatccatataatacatcatgggtcatcaagaaaccctgatagagccgacttgactcctggttccagcatccttcggtccatcccatggccttgctcccggccccttccctccataggcagtgtagtccagtggaaagagcaagggtttggggttcagaaagacccagcttcaaatcctggctccttcttttactagctggacaaccttggacaactctgagcttcattttccctatctgtaaaataggaataataatcccttcctttcaagattgccctgaggattagacccaacatgggaagtgcttgacatgggcctggcacacagaaagcacccaatcaactactgccatcatcattactacagtcaggagatcacacagcacaaagcccagcctccttgggcagaaggtagccctactctacagcacgaagccagaccaagaataggttagaagacggaaaaggctctgtgcccctaaggcaggaccgacttccatgtggttggtcaggttccctaaggacctactttcaagcacaggtacactggtactctacctgctccacgtatagctagccaggaaggaagcagagcctcccagggaggctgccagtagtctagctgcaagattagcatctgctcttcgctctaagaacacccatggagctgttggggtccacaaaggaaggcctttaaaacctcttctgtaggacagcaatctggcttaggctatcggttttttaaagaaagggtttaatgcaccctctccccttagtaaggcagagggaaaataagcaaatgctaaaaataaatgactgctgtgagagggaattgaatggtcttcagccaaggatggcagcactttaaaattaacaaagcccgggtaccacatccaggaaggccttggcaaatgcgtgttatccactcattagctcagttcctcggggaccctggccaagcagggaaggcagtgccgggaaccagtccttccgacactgatgaaatgcactcggggagaaaaggcagaaggagggagggagactcttgtggggaatttcaaacagttctgatgtgcttcatgctctgccttgcagttctcaccttctccgaggcaaaggcttgcaaaagccaccaccaagcccaagcaggatgaaatcaaaatctccccacaccagcctcccttttcaggatctttggttcctgaagcaccacaacggcctcactatataggtggtgtccctgcatgagagtccagagataaggaacccaagaatagtgtgggagaggcaagctcccagtctgtaacctcaactttctccttgctggaatgaagaatcatatactttatgaatttatacaagtccactgtacactactcataaagtgaatttatcactattcatcagtaattatacttcattacatcactgatagtatgaattgacaaatcttcattccctactaaaaatcagaatgcatatcactctaatgtgagatatcatcaacaataagaattcaaaacattccaggtgaccattaacaatatgaattaattttgatactactaatacaaattctcagtatgccactggtcacaattaataatgaaaattagagagggatgacagctttttaaaaagtgtttaaagtcagtttactgaagtatcacatttacacagagtaaaattcatcctttttaagatatataatttaatgaattttgataattatatacattcatgtaaccagcatgataatcaggatacagaatatttctccatcatcccaaaaagttcctttatattctcttcccattcccaaacactggcaaccaccaatctgatttctgcccctaaagttctgtcttctccagaatgtcatatacatggaattacagagcaggtagctttttgtgttggttttagcttagcatggtgcttttgttgttgtcattgtttgtttggctgtttttaccgtatggatataccacaatttgttggtccattcaccagttgatggacattgcattatatccagtttttggtggtcatgaataaagctgctataaatatttacatacaggtatttttgcagacgtacatttttatttctcttagacaaatacctaggagttgctattgctctgtggtatggtaaatgtatactttacctttataagaaactgccaaagtgttttccaatgtggctataccattatgcattcctatcagtgatgtatcaatattgttctgtatccttgtcagcccttagtattgtcagttttcctaaattttagctactgtagcaggtatgtagtggtatctcattgtgacttgaatttgcactgagtatgttttcatgtgcttatttgccacccatctctttttcgatgaagcatctgctaaaatattttgcccatttaaaaaaattagattttttttattattgatttgtaagacttctttatatgttctgggtactactgctttataagatacatgtttttacagctccttttttatgaattagaaattataagaatctaagtcttacaatttttcttctaaaccactatcctctgcacatatactctaattaagggactaggaacaacttaaacttctaatttacaaacatcttagtgctgctggaacagagggccaagaagtacttaaaccgtgctaaaactcatgagactatttttatctccattgcaagcacctaacaataccagagctttaaggaaagctacatctggagaaatgactgtcctatgaacagcttttggccccccaggctctgcacctcccaaagccctgttctggtccaccagacttctggaatggtcaacagtcgtcacactccattgctggccattgttcactgggaaaggtaggaggctcccaatccatccctcagtggaagagcaaatagtggggcctgtggctgcttggacatcaaagttgagcaaacaggcctggcaggccctgcctctccgcctacacatcctgcaaatgccatctgaaggagcttccccaagggggtcatgactttcagcctgtcatagaacacatcaaagtttgcaccacacacgaactgggtgcatgggttcgaatcaagtcgcccgagagcggatactcagccattgtgtccagttttaatcctgtgttttcccaagtaattaagccttcttgcttatgaacttgtgactaagtaaagcatcaccgagaggttgtaacatcaaagtgccttccaccgtctgtccgtgtttggtaaaattggatttcttttccttcttaaagaaaaactaattgaatttagctgaaggctgtgtatatttgcacaagccggtgaaggctacgctaagtcacagtgatcattctgggaccctgtggcttagcctttagctggactgggtcagagtgcaatatagaatgagacacccagactcaggctaaacaagtgccttgtggcatgaggcttatagagggctaactgtggagaaggggccagaccccaatgactgttccttgagtcaatactatacccaagctgttactagggctggcaaaaggattgtcctagtagaatgttggtaaagctttggcagcacggctactgaagacaatggccatcacattactcaagtcctggatgtcggcagtccaagtaagcttcttaaggcaaaagctgtgactgcttattctctgaatccctgatagcctagcacattagcacctgacaccacagagtttttaaatatgtttgctgaatatacataatgataatatatattttatatatataaaaccataaatatatataatacataaagatataactctctgtatcccttttttgccctatcaggaaacttcaatctaaattaatactcaatttccctaattacttaatttacagtaaatacagcatggtcccattcatgttaaatttgtacataaacatatatataacaatcaatttccagataaagggaattcaggtgactactattttatgtatgatttttacaaaaacaataaatctattttcagaaaagagaatctctggttcaatctttatacaattatctttcctttaaccaatatgatttctgatcttgatccagttttccctctcctgtgtatatttatatttgtattttaagtcacttcaaactctttttggaaataaaaggagaaaataaattataaattaaattattgtgcatatttttaaagtgtagttctatagcactgttatttcctattcaaaaccaaataaaatgtacatacagacctagaaattcataagacattaagctccttaaggacagagactattgtattctatatccctaaagacttaacatattattaagcagcatcagggtgaaatgattgggctactccgaggatctctctcttgagcttgtggctgcctacatcctaaaggaggtgaaggaggtgaaggttctctgctttcagccttgaatcaagggtgctccccctctatcttcccttcatcgaaatctaattcaaaggtggtagcatttcaggcctgaccaatatgattctggaaggatttggagattgattatatgaaaatcagtatatttctaataaggaaaaacttattggcagattgtgctggtatggatatgctaatcctccaagactactcacagggcaccttaacaatgaggcctactcaccctgaccaatgtactcctggtactccctttttaacaagttctacttttcctttttcccacggcacttatcttctaatatattaaatagtttacgcatccattatactcattgtttattgtctatccacatctttctctaccaaaggaccacaactaatacagaaataagctctatgtgggcagggatctttgtttttcatcaacattatttcaagtacatagaacagtacctggcaaacagtaggggccaaaaaaaaattctgcgatatgaatacataaatccaacccaagagtgtgctattttcagtaaaaatctgtcctccctggatagtggaagagaaggtcacaaaatggataattagtcctaggaaccaaagcaagtaaatataagccaacactctcactttgctcaacaagcatcactgatttgctaacagctctggataaagacagagcaatcagttaagccaacaactcattagattcaaagagatgtgtccccaaaagcatatctactagccatctgatcactaattgacagtatttttaagcatcgtgttgtttcctattcagtctcaaccttgaaaatactacacacagaagggaacacacctctccacctctccttctttagcaccactggctatttcttgcagagggaaacagctacaagctgggggaaaagactggtgcatgtggtgaagtaccagcggtgtagaataacacatgtgtttgtgtacagagatctaatgggggcatcagggactaacaacccacctttataacctgtagcacatacattaccttatttgattctccaaagaatatggtgaggatctactatgctgccacattgagtcccctcacaccctttgcttcgagggtatcccatacatactgctctgaaatcactgatcatactatactatgtctccttacctgcatttgttttccccattagactgcaaactccccaaggtctcggattctgcaaacactagcacagggcctggctcaaggcagatatttacctaatgttcatagaaataattaatttctgatgaagaaacaggctgtccatggagttctgaaattcagttaaggcttggaaccaggactggactctaggtctctcaactacgaagcctatttatatcaattttgcttttaaagaataggtgcgccagacatggtggctcacgcctgtaatcccagcactttgggaggccaaggcgggtggatcacaaggtcaggagatcgataccattctggccaacatggtgaaaccccatctctactaaaaatacaaaaaaaattagctgggtgtggtggtgtgcgcctgtagtcccagctactcgggaggctgaggcagtggaattgcttgaacctgggaggtggagggttgcagtgatccaagatcgcgccactgcactccagcctggcaacagagtgagactccgtctcaaaaaaataaataaataaatagtaaaagaaaaaagaaaaaagaataggtgcttggagctaaagagagcaaatcaggaaaccgagtgactaagaacaagtccacaacaaaggagcagagaagagagacctatctcatgtacagctaagtctctcagtcagtctgaggcagtaccacctctagattataaaatcccagttacatttgttctttcacatttataatcctttcacaggtggccagtacaccttaaacacctacttgcagaaagaactgaaattggtacctccaactatcaatttcaatggctgttactaaagtgcccactctgctttctttgaaagtatccctttttgctcttaattctttcgcacaatcatagctagagcaaatgtgtacttcatcccagcacttccagaattatacagactccaaggcagaaatcagaacagactgaaatggaaaggcagcatcagcactaggctggtatctggcatcgggaggtagcagtgagataaagtaaaaaacacagatcatggctgggcacagtggctcacgcctgtcatcccaacactttggtaggctgagggtgcaggagcacttggaggccaggagttcaagaccaacctggatagcacagtgagacccctatctttaaaaaaaaaaaaaaaattagcccagtgtgatggtgcatacctgtagtcctagctactcaggagggtgaggtgggtggatcgcttgaacccaggaggctggggctgcagcgagccatagatcgtaccactgcactccagcctgggtgaccaagcaagactgtatctcaaaaaaaccccaaaacccaaaaacacagacctttcaggcagccagaccaggttctaaatcctgtccatgtgacataaataaatcactttatctctttgggtttcagttttctgagctacaaaatgagcataatatatattttgtggagtgattgtgagaattagataactcactacacaaagtaaactatttcaatctttatacaatagctacaaccctgataggatgggggagggggcaggaaaatagcacagcctccaatgggagggaaagaagcccccatctttcttagtttccatcagaacttccaaagaaaaagcccctggaggagcactcactggggacagtaactgcagacttctcaaggtcaacagatggtaggtaacagaacattacaataatttgcacctataaacacaaccaattacaacaggcttccaaacatttggttgctacaacaatgcaaatgacgtgcctaaggtcacaaagccaatgactgagggagctgggattcaaggctacatctttctggtccacagctactatacagtccaatgcaccaggtgaagtccagtacctcagtctgaatctatcttcctgcctctggaaaagacagcagggaggcacaccaggtgggagagtgctcaggagcacagtctgcagagatctgcctaaaggagccctgtgtggaaggtggtctctcacctgttgtttcggttgatggctgccaccatgagtgctgtccagccaagtctgtgctttgcattgacatctgcaccttctgacaacagcctaaaacaagacagaggaatattttcagtgtatggcttgacatctgcaccttctgacaacagcctaaaacaagacagaggaatattttcagtgtatggcttatcatggatgtaaaagtagaaacaaccatagaagaaatgacatagtcaacaaacagagcctgaatgagtcaggaaatagaggcctttgaggactacattcccaatttcagctcctctggccattctgtcccatcaagactttccctacctctctccttcccttaaatcagtctgtcccccttattatcttccaaaccctttgagaaaagaatggtccctccctaacttaatactctgacactgtcactcccttggtccagaatgctctctcccggctcctttgcctatttgaattctcctctcatgctatttaatacaatccttgtggctcgtggactcctgagaaggaagccttccttaactcatccagtccacagcaattccttccttaatttcccaatgctaggaacagaatgcctaatgacatgtcttatctaggtagttctcagttcacaaaatgatcatattcctcaagtttatctgtactgtggttgtttggaaattgaaaatccttcaactcaaggaaagatggaaacaatagattaggttcctaggagagtccacacagaccctaccagaatctatatgccagtgcctaacacattgtagaagctcaataattattaaataaattaacaaacacagaatttaaagtatcccactaaaagtctgaatttttgctcccaggacaaaaggaccaacaatgtaggggtgggtaaatagaatgaactcttactgagcaccttctacaagcaggaactaccccaagtactttacattcatgattccatgtactctcaacaccacctaaggacctaagagtaatcgcctcttttcagggataaggtaacaggctcactgaggtgaaatgacttccttaaggtcacgcagctagttaaggggcagtgcagtgactggttggcagtgactctacagccaggctccttctcacctcaccacccttcctccagacagaacctggctctagataacatgaaagacaaacactacactgatgtcagtgaatcagtatgacatgcacttggtcccctgctagattctggatgagggtgaggagaagacatggctcaagacagcatatcaaagaacacagtgccaagaaagggaggaggggtttgggaagctaggaggctgtttttcagtgggttctagccaaagggcagagagtcaaaggcttgggtttgaatcctagcaccattcttgtgccacgatctatagtaaatgtccctacagaccaagtcaaataaaatctgtgttgctgatgttagcaggtaactaaggcttgagaggatgatgagaaacatcatgtactaaggcttctctcaaatactttcgaaggcactgtcaaagcccaagggggagacagaacagaactgcacatctcatgagtgatatgaatgggactatgggttgcaggtgcactacaaggaaacttaacccagtctcagtggccaaaaaggcctctctgaggaggtgctgataaaggggaactggccaaacaaaagcaggtgagggaggggaaggagtgttccaggtagacgcagtcctcttcacctggagcagacccagggtatatgagaccccctaagatgtttggtatgactggggtacaacatgtgagggaagagtattaagagaggttaggaaacattcctttcttacctctagtttggaggatttactctggtgaaggtcccttactatacataatgttacacttcttttatgcagaaacaattttctatggccaagaatgttaaagacgctaagaaccctgtctaatttacaaaaacctcttctccttgtttagcaggccacgtgatatggtagagagcgcatggttctgatcctaactatgatcctgatgggatggcctcgcttctctgaccctcagtccaagaggctagaaaatcaggataggctgaagaaaatcagaggcttctgacggcacaaacttgaattgtgtcttgaagaaggggaagagtttagagaagtggaaggaagtgcacgtcaatcaaggcaagaaacagggtatgactgcgaagcaggaaaggaacattcagagatcattaggcagctccatctgggtgacagttcacagcagagaaacagacagctgctgaggcatgcacagccaacacaagacctcgaatgtcagactaggaggctaaggcagtgggcataaacctttctgagatatgggctcttttgtgactacgatcaaatttcttccagaaaagtgcataggagcatacactctcaaaaacattttttttacatataatgatcaggtgttcgcagcccccatgaaatcagtaatggaccctaggataaaagctcagtctaaaggtttgacagattcctggcatgcatgctactgtcctgtgctcccacgtctaagagggatatcacacatctctcccagcagttcttgctgtggagcctttgaaagagcctcagaatcctcttcaaggccgggcacggtggctcacatctgtaatcccagcactttaggaggccaaggcaggtggatcacgaggtcaggagatcgagaccatcctggctaacacggtgaaaccgcatctctactaaaaatacaaaaaattagccgggcgtggtggcaggcacgtgtagtcccagctactcaagagactgaggcaggagaatggtgtgaacctgggaggcggagcttgcagtgagctgagatcacaccactgcacgccagcccgggcgacagagtgagactctgtctcaaaaaaaaaaaaagaatcctcttcaaaataggttccaatcagccaccatcaatccactgaagttagcaacagagagaaaacctagttgccattccttagcttcccaccaaaggcagtgaggttgtccattcaaggttttgggacaaaagaaattataaaattaacctaatcactaagcaggctgaatttgaagggcgaagagtacaaaatggggataagaagaccagtttggaggtgtaatacagaccttgggagaggagcttgggcaggaaaatgagaaaggagggtgcagctaggataaactcagagtgaccaaaatccctcatgcctccaagggaacaatgacccatgttcccctgcctggaccctgaaaattgtggaagcagcgttgctctagaggtagggctgaagaaagaagattgaaatgcctcctcctactgcccctgaagggccgagtgcagtctaataaaaagaaatggatgaataaagggcattggagtaagtcagaccccgatttgaattctgatctagctagataactctaagcaaatcaacactaattttcagtcttctgacctctgggataataatctctaagttgcaagatcccagccttggcatatagcaggtattcaatacagaccctactatcctatctcacttccatcattttgatggaacaaagtgttgcactctcaagctggtagtggcaggttggctaatacccagggattctaagatgtgatcacacaggatgacctggataattcagcaaagctggctctaggcactttgttcattcattcagcaaacatgtgcacacacccactctgtgcccagcctcttgctggctactggggaggagacagagagagaggttcttgctttccaagacctgagccaggcaagatctatctcttcttttccttccctccttccttcttttataaatacatatacatgggtgtgtgtaggtacgtgtgtgtgtgtatgtgtataaaattctgcttacaacttttttcacagaaaattctgttttaagtatactcatattgctaagtatgcaataactccattgtttttaactgttgcataactccccacggtgtgtgtccacattttctttctctgctctcccaggcatacccgcccagggagcctctatctcccagccaccaaaaacaatgctcacagaacatcctctcctatgtccccttttggacctatgtgagcatttccctgtggcatgtacttggagtgaaatcactgggtcctacagtatgtgcatagttgatttgactaaatagtgccaaggtcctcttctgaatagctgccccactgacccttccacaagcaggacagaggtgtgcctgtgtatccctcttcctgtcaacacttggccatagccagctttctaatcactgccagtctaatgggtgggtgtaaagggctattatattattgttttatcttgcatgtctctgatgactaacaattttgagctatttgttatacgcatgtttgcatttcgggattttctcttctgtatattgcagggttttctattttaagaggaagaactcctggaagaggcatttctctaaacctgctatcatagaactcctggaagaggcacttctctaaacctgctatcatttcaatgaaagaacatacaggagagtcaggagacctgggttctagctctagctctgccacctactatttttttttttttttgagatggagtctcgttctgtcgcccaggctggagtgcagtggcacgatctcggctcactgcaagctccgcctcccgagttcacgccattctcctgcctcagcctcccaagtagctgggcctacaggtgcctgccaccacgcccagctaattttttgtattttttagcagagacggggtttcaccgtattagccaggatggtcttgatctcctgaccttgtgatccacccgcctcagcctcccaaagtgctgggattacaggcatgagccaccgcgcccagcctctgccacctactattctaacatcctaaaggaaggcacatcatctggctaagctttgtctcttcataggtccaatgaggatcacaatcctcccagtgtcataggagttttaggaggcagcaccgaaatataaaggaaagggctctacaaacctgaggggccattcagaggaggaaatcttggtgttcttcagtgagactccagcattcagccctgcccagcttcttgactgagcatcattctttgcagtctcttggggctgaggtataatggaaaaaaagcaatgaccctggagtccaaaggctggagttcagattctagctctgtcacttactagctgtgaaatggaagatattaatccctcttgtgcaaggtggtcgtaaggattaaaacagaatttcgtaaggagtggtggcacctggtagatcaagaaagaaccgggctgggtgcggtggctcatgcctgtaatcccaacactttgggaggccaaggtgagtggatcatgaggtcaggagatcaagaccatcctggctgacacggtgaaaccctgtctctactaaaaatacaaaaaattagccgggtgtggtggcacacacctgtaatcccagctactcgggaggctgaggcaggagaatcacttgaacccaggaggcggaggttgcagtgagccaagattgcgccactgcactccagcccgggtgacagggcaagactctgtctcaaaaaaaaaaaaaaaaaaaaagaaaagaaaagaccacaagagaacccaaccacaagtaactctgaaagagctgggtaggcccctcccctgcctcccctcagtgcagagcagcccagaaagttggaattttacaaaccaggtctcctgcatttcactgtgttgctctgcaagtgaatgcacagtgggcagtcatttcaaagtcctgggccagctaggcggcgggctgcccgctgagagaggctgaaagggcgtttgaggcctgagaaagccacccttgctctcccctgtgattttcaccaatgggcaaaatgtggcaagtgaattaatctcttttaaaaagagcaatgcttgtgacagagtacggtgtctctgaaaaggttaggattccatcatccctgagatgatgagtagaatgcttaattcaggctgccactcagggcagaacagcctgtgtccaggggctagagaggcagggtgggcatagtgggcctttctgggctcactccagacttgtggaaggcccttccctaatgaactaggtctcctgcttggcagggcagcagtaggtgacccctatctggggattgcccagggtggtagacacagagtagaccgcattagaagtccagagttgaagccacgcatggtggctcacacctgtaatcccagcactttgagaggccgaggtgaacagaccacctaaggtcaggagttcgagaccagcccagccaacaaggcgaaaccccatctctactaaaaatacaaaaattagccgggcgtggtgtcgggcacctgtaatcccagctactcgggtggctgacgtatgacaatcacttgaactcgggagacagaggttgcagagagctgagattatgctactgcactacagcctgggcaacagagagaggctccatgtcaaaaacaaaaaaaaagtccagagttgaatccaagctcttgcacaactctcaggcagtagagtgggtcagaaaaatcagcagcaaagatctcgtttcaaatccaggttctgggggccaggtgcagtggctcacacctgtaatcccagcactttggaagacggaggcgggtggattacctggggttgggagttcgagatcagcctggctaatgtggtaaaaccccgtctctactaaatatacaaaattagctgggcgtggtggcgcacgcctgtaatcccagctactccggaggctgaggcaggagaatcgcttgaacccaggtggcggaggttgcagtgagccgggattgtgccactgcactccgacctgggtgacagtgagactccgtataaaaaaaaaaaaatccaggctctggcgggtggatcacctgaggtcaggagtttgagaccagcctggccaacatggtaaaaccccatctctattaaaaatataaaaaattagcctggcatggtggccagtacctgtaatccaagctactcaggaggctgaagcaggagaatcacttgagcccaggaagcagaggctgcagtaagccaagatcgtgccactgtaccccagcctaggcaacaagagcagaactccatctcaaaaaaaacaaaacaaacaaatccaggctctgttacttactaagtgaggagtggtggatgaatgaatgacttagcctctctgaatctcaactgcttccttcatttacatgatagctcctgctctctaagcctgtttctgcatctgttaaaaaaaaatggagaacacctcaccaaccctactatatatgtcacataggggtgctatgaagagacagtgagaaaaaatatgtaaaaatacttgggatgcaataaagcactgtacaaaatagcataagaagagcttatactattcttatcactttccaatttgtgttcactcgattttaaagaagtgacagagtaactaggatgatacaggaaaaggtatacacagaacttggaacacagtaagtgctccaaattactggaggatagataaatgaactgtctaaaattcccaggcaagggcagcagcaggaaagggaaggttccctagcccaagagctgaagattaccacagaaggacaaatcagtcgggaaaaacatatcctgctcccatccatcagtgatcctggagagtccagcaggctaaagaccaaagaggtaacagctattaccactgattggggaaggggcaatgaagcagtcaagctttctctttctgctgtgagtacctctgtattgtttgaagttgtgctgtttttataacaatgaccatactattactcttttttaaaataaaactttcttaggaaaaaaaaaagtcctatactttaagaagccttccctaagatgaccttgttgccaccacaatcccctgtgctaacctgtatcaatgtagttatcatacagtccacaggtctaacttccccagtaggcaagcatgtccttctagaaacaaggacttgccttcatctctttgctccaggtgcctgccatggcagttggcacaccacaaagctcggggtctgaatgaatgaatgtctacagcacttacctacattaacttctcaccaatacttctgtctggtgctggaagttacctgttttataactgtaagcttgtctttttcgaagaacttaggcttctatgtatatgtaggagggtgtgagtgcagcttctcagtctcagggctgaggacatttgtggatacaggcctaggggctacaggtcacaaattccagtcatggctctatcacttactagctatgtgaccacaataaatgtctttgtggtccttacttttatctgcagtaaaagaaggaaatgaatgaaattatttctgaagtccctaccagctctataatgttataattctaaatatgtgtagcatcaaaatgaaaattgagtagattcctagcagacgctgcactcagcaagacttccaacgaaaagacaactccccaggctctgtttgtgggagggagggaaagagtcccagaaagggacacaggggcagctttgagttattctggctaactagctcttccactcaggggagggaggtaccacttgatttttcttcctctttctttaggaccaatcaatacaaagcggccactgaacttcaatgacgcattgttccaactgatttccggatccttcacatgaaccagccctcagctgcagctggggaggggctgaagggtagggagccctatcccacctgcatcagaggcctggaagcactgagccatgcagacccaatcatgattgctatctgggcaacagggccctggctggagcctcacagaaggccctgtttacagtaataacagcaccaggccctgctgtctgagcagaggcaaggtgcctggggccagaatccccaggcagcctccatctgtgccttatctagcctgccagccagggctgggaggggcagggcaagggagcaaaggctgctcatagaccccccagcctgggacagcagacttcaggcagggtcttggtgcttcaactccatagacaaggcctctccagcaacttctgcatttgctacttgaactgagcacccttctccaaggcctagctggggacccttccgtgaggaagctctccagatgctctcactcccagtgagatggcccactgagcattctgtcatgcctggagaactccaagggagtgagagcagtgagggaggggagaggctggcaggtatgcagtacctaccacaaatgccaagtgtactgtggaatgtgtctgcatgtttcatagctggctatttcctatcacagaaaactttaaaatttctgaacttaaagaatgatctgcagagattaatcagtccaaatcttccttttacacacacagatagggaggctcagaaagcgtcccctttggaaaagactgatctatatatgagcctgcctctgtctgtctcttccaggctgtgtgactgtgggcagatcacactaccctctctgaacctcagtcatcttaccctatcagcctgtcagccctacctaacatgggtgctgagatgaccaaaggaaataatgtttgtgagggcacttacattttccaaatcttagttgctattattacacttgttctgtttgttgaggcacacagtggaggagctgaatcacaacctcagtgaatacttgctggatcaactgaataaagtgcaacactgggtgatcattctttgtcccatctctcttacagaaacttggcccacattaaagtgctcagattattttttaactttttattttgaaataatttcaaacttatagaacagttacaaaaatcacacacacacacacacaccccttcaaacagccttcatgccaggtgcggtggctcaggcctgtaatcccagcactttgggaggccaaggcaggcgagtcacctgaggtcgggagttcgagaccagcctgaccaacatggagaaaccccgtctctactaaaaaatacaaaattagccgggcatggtggcacatgcctgtaatcccagctactcgggaggctgaggcaggagaatcgcttgaaccctggaggcggaggctgcagtgagccgagatcgtgctattgcactccagcctgggcaaccaaagcgaaaatccgtctcgaaaaaaaaaaacaaagacaaaaaaacaaataaataaatagccttcactcatatcctgtttacattttgtttcatttgcttttctattccttttctatttttttttgctggaccatgtgagaactaatttcagatactatgcccctttacctccaaatacttcatcgagcatataccagatacattggtacatgcatctcgtacctagtaccagagcattctcttacagaaccactaactaatgatgataaaattcagaacatttaacattgatatactatttttatctgatatacagcccacattcaaatttcttcaattatcccaatattcattatagcaatctccccctgtgatccagatgaaagccaggatcaatatcaggaccaaacactgcatatgtttcaatttcatctaggatagttcttcaacctttctttgattttcatgatattgacattttttgcagagtaaggctagtttgtttgtagaatacccttcaatgtggataacaatttttgaggtactacttattatgcatccattcgttccataaactcttcctgaggactggttattacaggactctgagcagggcactcagggtactgtgatgaattctgtggtatccttgccttcaaagcattcactggacagctacacactgggcaaacagctaaaatacaagcaaggaccctagaggaaggtgccatgagagtacaggtcagagcaagagagccacagggatgacttcctagaggcagagtgtgccagaaaggatgggccagaagcacagattcccagagtgaccttctgggatcctctatagcaaacatctttgcttccccaggcagtgtgtgccaaggctgagactgaataaaacacggaagtccaacaatacaaggccataaacaggagggagtggcccaaagcaccttcatctgggtacccctgcccagagctattaatatatgcatttcccagagagtcagcagctgtggtggtgagaaggaaaggcctgtgcaggacctgaggtgtgggaaagggtcataggcgccacctactggccccacagcaggcctcctggctggctgccaggaaacctgtcacactacagcagtgagacacaaaagtggttcaaatttctcaaacagtgaaacagtgttggtacttgagccaccttctgtgaagttcaggaatctcacaaaatttccagtaaagaagagacaatgaaaagccaaccataaaacctggcctcctcgggcaaaggtgtggccttcactcactcaacaaaactgaagtaacatctccaagctagcctctgtgttgggcattgacagacaccgaagtcaatcagacatgaatcttgcctacaaggagctcttattctgagctggaggagggaaaatgaaacaagcgcacaaataagtgcactaagtatcacaggtgctcagagatgtttacacaggctcagggagcacaactcaccgccttgcaaagctcttgaatgatggagttcaaaagagctcacatttcttgagctgcctactacgcaacagatacttgacatttatgatctcatttgatcctctgaaagaagcccaagtcttacagagggtaaatgactgattaagattacaaggccaggctgggaacggtggttcacgcctgtaatcccagtactttgagaggccgaggtgggtggatcacaaggtcagaggttgaagaccagcctgaccaacatggtgaaaccctatctctactaaaaatacaaaaattagccaggcatggtggcaggcacctgtaatcccagctactcaggaggctgaggcaggagaatcacttgaacccgggaggcgtgggttgcagtaagccaagatcgcaccactgcactccagcctggcgacagagtgagactccgtctcaaaaaaaaagaaaaagaaagattacaaggccaataagtagcagccggggatgaagcccaagctctatggagccacactgccttccagggctcatatgcccaattcttcccttctttcccagatttagcatgcgtcagcacaccatagttgtctgatgggaccaatcagctgacagaaaataaggaaaagcctcaagtggaaaggagtttacttgaggggtgaagatactttctgtttagtcctgaagcttcctagaaccttctctcttggaagttctagttccttctagtcgcatgctgagaacattccaagcctatcctttcttctttctggtagtctccataccaccaccactactttcacatagtacatattcacatttcaaatattacaaattcacaagcaaatacaaagccttaaagtgtccttacctttaggttaaaacaagctctgcaaacaaatccaatcaaagggttacaggacagaagaagtcatggatctcagaaggctgggccgattacaagcttaacagaacctaggagtgtaacgcagctgccaagaaagccaatgcaaggtcgggccatattaatagaagtataaaatctttaacaaaggggatggttgccctgctcctcacaataatggtcatgccacactggaattcagagagggcaccaaaactttctagctgtttcattttaaaatgactaggatgaggaggagacttgaaaccacagtttagggaaccaaggctcatatagcttggagctctgtctcctaagagttaaaaatctggaacaggaaaaggaagccatgtagtcctagaagacagagctgggaccaagtgaggggagttgcaaagggagctaacacataatgacagcccatcatgtgccaagtgctatgccaggtgctttcacactattgcttcagagctcatcagaagataaaactgttttctactactaattacaaattgtctttacttacattactccaactgcccagaaagtctttctgcaaagctccttgtatacaaatacgacctatctccagacccaaactaaaggccaccttgcctgtgaagccctaacttttcacctgtactaactacaattctcttaccagaccgcaagttccttgaaagacaaaggtcatcatgatacatttttctccccctcaatgcctaataagaaattgctcataacaggccttaagaatgaataaatgccaaagaatggctgggtgcggtggctcacacctgtaatctcagcactttgggaggctgaggcaggcagatcacctgaggtcaggagttcgagacaagcctggccaacatagtgaaaccccgtctctaccaaaaatacaaaaattagccaggcatggtggcacgtgcctgtaatcccagctacttgggaggctgaggcagaagaatcgcttgaacccgggaggcagaggttggattgagccaagatcgcgccactgcattccagcctggatgacagagcaagactccgtctcaaaaaaaaaaaaaaaaaaaagaaaaaagaatgaataaatgccaaagaagatacagaaatggccaataagcacataaaaagatgctcacatcattagccattagggaaatgcaaatcaaaaccacaatgagataccactccacacacactaggtttgctgtaagtgatgacaacactgatgacaacaattgttggtgaggatgtggaaaaggtagaaccctcacacgttgcttttgggaatgtaaaatggtgaagccaccctggaaaatggttgggcagttcctcaaaatgttaaatgtacagttactctatggcccagcaattccactcctaggtatacactgaagagacatgaaaacatacattcacatagaaatctgtacacgaatgttcacagcagcattattcataatagctaaaaagtggaaacacaaatgtccatcaactgacaaatgacatcctgtatggatgtacatccaataaaatgtagtacatccatacagggaatattattcagccacaaaaaggaataaagtactgatatatgctacaacatagatgaaccttgaaaacattaagctcagtgaaagaagccagacacaaaaggccacatattgtataattccatttatatgaaatgttcagaacaggcaaatccagaaacagaaagcagattagtggttgcaacatctagggggagaggagaatggggagtaactactattggaaccagagttttctgagggtccggggtggggtgggagagtgatagaacattctggaattagtggtgctggttgcacaatcttataaatgttctaaaatccactaaattgtatatttttaaaggttgaattttatggtatgtgaattatacctcaaaagaaaaaagaatgaatgtatattcagtcagaatctgcctattcttcaggaggcagagagtgcctcatacctagaggcacccaaagagggctggatgttgaccatcagagaagctaaagtggggacctgaatactggaaaggaaatgaggctggagacaaaagtgcctgagatcctgtgtgacccatctaggggttgtgactgagcccctgatgtgtcctgggaaggatcctgcccctccccacccctgctggactcttgagcccttgggaattccgggggcctccctcaattgtttgtgctttacatcctgccccagtacactgtccatctgcaaaggctggtcaaacacacaggcttcgcaggaggcctgggtgctatcccttcaaacaaaagggcattgagatggaagcctcagcccagcctcaaagaggattcttatgcagccttcctgagccttccatccacatgaatggaggatcctggagaccagtcagcctgcccagctgctgcctagggctgtgctctcctgctggttagcctttggagaataaacaaggtttctatcaaccaatcaatcaacgggccagactccatctgtaccatgtgtcttctgagtgccagccagccttgtgtgacttactacggtgaaggcaggagaaggaggtgccatacaccttgctgtgacagggctcacagcctaggtcaggagaaatacataagaagcaactgaagagaaaagtgaagagatgaatcagtaaacatgacacagcaatggtgtgaggcaggtcaattatcatccctactttgcagatgaagaatctaaggttaaagatgttagacaacttttccaaggtcacagaactaaccaatggtcacagccaggattcaagccttgttttgtcagactccaaagtcctcaccactgcttcctgctaatgataagaaatccacttgaaggccaggtgcagtggctcatgcctgtaatcccagcactttgggaggctgaggcgggaggatcacgaggtcaggagttcaagaccagcctggccaacatggcgaaaccctgtctctactaaaaatacaaaaattagccgggtgtggtggcacacacctgtaatcccagctactctggaggctgagccaggagaatcgcttgaacccaggagtcagaggttgtaatgagctgagatcgtaccactgcactccaccctggtgacagagtgagactccatctccaaaaaaaaaaaaaaaaaagaaaagaaaagaaatccacttgtatttgcatccattgacagaatcacaaggagaggacgactgattgccttagaaggactttgggcctagggctcttgctcagaagggaggaacacaaaggaggcaggacatagtagagcctcaaagttcagaaactgaaattttctgaggttttttcaaaaaggcagacacagaacaggaagtacaaggcaagcagcttaagtgaatattagaagcccagtaacacactggcttgattgttttcaatattcttagattcatctctgttcctcagtttccaggaaaattccttgggagaaaaattccagttggttctggcggtgctgacatgaattgcgttatgattttgattaagctgggattttagaggagagatagcacttgggcgacataaatgatggtagggaggcagagcctgacaactgcccctgctgttaggccctgagcgattacagctttgtggcctacactgcctcaagaggcaggaccatgcccaagatgatgcctggcacatacaagcaggaaggcactcacattagttcctcatgttcctcagccatcagaatggctactgatcatattgatcccctctcaacccatctcagctgccactgccataaaaataaagacaaagcttcttcatgtggcctctgatgccctgtagggtctgcttgttctaggctcctggcaccttcctctagctggagtaccattggcctttttcagtccttcacactggccttgcttcctcctcatgcaggattcttgtaaataaaagttccttgtgctagagagctcttcccaaccttttccacctagataaactcttccttatccttcaattccaagctcaagcttcctctgaccaggggaaatctggctgtcacaggctctcctgattctctgtgtccttcctttgcagcatttgtactagttgtcatttcgcatttgtaggattcacgtctgacaaggctttgagctccatgaggcaaatcctgtacatgtctgactactgatctaccaagcacagtgccacacatagtaggcactatttgtttaatgaataaacgattgaactacttcatttttgtttgtcctctgtctacaggtttattatgactgtaatagctacacagtttgcttaatttttatcatttacaaaacacttttagccaggcgtggtggctcacacctgtaatcccagcactttgggagaccaaggcaggactgcttgagcccaggagttcaagaccagcctgtgcaacatgatgagatcttgtctcaattaaataaacaaacaaacaaaaacacaaaacgctttcaatggctgggcatggtggctcacgcctgtaatcccagtactttaggaggccgaggtgggcggatcaagaggtcaggagttcaagaccagccaacatggtgaaactccgtctctactaaaaatacaaaaattagctgggcgcagtagctgtcgcctgtaatcccagctactcgggaggctgaggcaggagaatggcttgaacccaggaggcagaggttgcagtgagccgagattgtgccactgcactccagcctgggcaacagagcaagactccatctcaggggaaaaaaaaaaaaactttcaataatattcagtgagtatttggtaactatttacatgcacagtgatgaacaacacagcaatggtctgctgccctccaaaactcacagtgttgtgagggagagaaggaaacagataacccatcccaacagaaggtggtaagtgctctcacttatatagtacagggtgctatgggaatccacagatactggtgttgtaggagttattaagaaactatttcaggcagataagagagggagaggtccttgggaaattttcgttttttaaagcatctccagaagtttctggtaaagccccgttcttagagccagtcggcaacctttgatatacaaatgaaggccattaaaaaaactgggtctacccagcagaacgcagtggctcacgcctgtaatcccagcactttgggaggccaaggcgggcggatcaccagaggtcgggagttcgggaccagcctggccaacatggagaaaccccatatgtactaaaaatacaaaattagccgggtgtggtggcgcatgcctgtaatcccagctactcaggacatggtgccctgcatttgcatattaaaatgctagggtgggaggaccagcttttttgcagggtacatgaatgacatacctagtcaaaccaatcccttgagtcctatgcaaatcagataccacctcctccagcctctgtatatacctggctggtatccatggcaggtggggttccctctcttggctttggagccccctccctctgtctctgtacaggggagcttcttccttctcccttccttcttgcccctccttccctactaaactctctgctccttaaaaccaatccacgtgtttccgtgtcatcttatctaattcgacatgagacaggagcactggtgtccctccactcatcagagccgtatcactgggggatcagggaaggctttcaggaagatgtgacagtgatgaccgaaggatgaggaattttccagacaaggactcacctgcctggaatgctcacaagatcctgggagagtgatgagacaagtatcatcaaagatactttacagtggaggcccccgaggaaactgagagactagcccaaggccacacagggctggctgtgctccttttcagtgacatgacccctccctccaggcccactgcgttaggccctggctgttctctgctcatggccaactgcctgcctctgcagggcttctgggcagttgaccacctgctcccacaactcacctacccatgaagttatagagaagctgctaatccaacctttcccaattgccttccatcaccagggaacaagcaatcagagcctcagcaagccacataccccagaaaagaagccaggcactacgccactctgtagaactgcttgagaggtacaaggtctacttgagcaagcctagggtttcagtgtgtgatctggacccttccagaaggactcagctttctctgaacactaggaaactggccgggcgtggtggctcacgcctgtaatcccagcactttgggaggccaaggcgggcggatcacgaggtcaggagatcgagaccatcttggctaacatggtgaaaccccacctctactaaaaatacaaaaaattggccgggcgtggtggcgggcgcctgtagtccagcaacttgggaggctgaggcaggagaatggcgtgaacccgagaggcggagcttgcagtgagtcgagattgtgccactgcactccagcctgggtgacagagcaagactccgtctcaaaaaaaaaaaaaaaaaaaaaaaaaactagggaactgtatttaaaaggtctcagtggggaccccatgaacaatacttggaagctaagacttagggtaggtcagtgacttattaatggtcacatagcttgttagtaactatgacaaaagtaaaacgaggtcttttaattctaaaactcttgtattctttctgtaacattatgctgcctttccaacattctggaaaggcattcaaaaaacctgtgtacaccctagcattcaaaaaactgtgtgatgatcttcagaagctctcactataagtatcaaattacaggagtgatgcccttgaggccttgacctttggtctaggataaagcttgtgtttcaatccactgcaagccacaaggatatttacatacttcctgattaagagagctggatgttttggttgctctgatgccatcattaatatcttcccatccagccaaaatgatacaacaatcaataaacagacagcctctctgaggccccgagacagccaaatgtatttaccagccagggttttgttaattagataaaatccctggatcaatgtgcaggacatttacctatgctgtaactaagtacattctggacacctcaatcctggcacatggacagcaagtgcctcaagccccaagctggggcatccagggacgagaaccaaaccaagccatcagtgcaaagctagaataaatatgtttacccctcaacaaagcccaaccctttcttttttcctgaactgtaaaccaaatcagatttttttccccaaagccatctagtaaaccagtttgggctagtatgaagttctttattttctaaagccataaaaccagaaatcaaaacaggacaccaaaagaatctcctaaatgataatttaagaggcaacatggcatgtatagtgggaagtcagaaagacccagaggttctagtgcctaaatgacatttccattggcatgttaaattcagcatgtttaaaactgaactcataatcttttccccaaacccagtgttcctcagggatccacatctcggtgaatggcaagagcatctacacagatgatcaagccagaaaactgaaattcattaagacccttttctccctaatcaaccatatccatttatattcattcatttattgaatacttactgtgtggcaggcactgtaccaggcattgtcctaaccatcaccaagtcctatctagtttacttcctccatctctgctgctgtcatcttagtccatgtcacatcttctctcatctggactactccagctacttttcaaccagtcttccagcatccaacacagatctctaccaatctgttctctaccaaacaaccagaatgatctttcaaaactgcagatctatatcatgtcacaatgtgtacctgttagtctttctcacacatacacatactggctgaaaattcctcaacggttgcccatgctcttaggacaaaaataaaaactgttaatatggcctacagacccagtgtggtatggtccctgcttaactcgccaacctcatttgacaccactctcccccttgctttctagggtccagccttattggccttctctcaattcctcaatttctccacatctttgagtcaggaccttccacctgctgttccctctaactgaactgtcttccgcctttctcttcatcattaagagttcacttcagtctcatttaccagaagctttgatctaggactttgatctctagaactgagaggaatacatttatgctgtttataaaccactcaatctgcggtattctgttatagcagcccaaacagacaaagacagtggccttcggtgactagcttttttcacttagcatattttcagggttcatccatgttgtagcacgtatcagtgcttcctttgaattgatgaataatattctgatgtactgttctatcatatttttatgcaaaatgtatcgggcccagagagacctgagtataggcgctcagccataaccccacacccttgccccatgcctgggggcaattgtttaaagccatttttttctttcttttctaccctgtagtttcctaactagctgcctcacccattattttcctgtagttcctggaatatgtgatacaaagaacaatgtatagccaaacaatagcttgttattttaatgtaaattcttggtaaacaacttggaaagtgcctcttctgcgtggtggctcaggcctgtaatcccagcacactttgggaggccgaggtgggcagatcacttgaggtcaggggttcgagatcagtctagccaacatggtgaaaccccatttctacttaaaaaaaaaacaaaaataccctgggcgtggtggctcacgcctgtaatcccagcactttgggaggccgaggcgggcggatcacgaggtcagaccatcctggctaacatggtgaaaccctgtctctttgtaaaatacaaaaaattagccgggcgcgttggcgggcacctgtagtcccagctactcgggaggctgaggcaggagaatggcatgaacccgggtggcggagtttgcagtgagccgagatcgcaccaccgcactccaacctgggggacagaatgagactccgtctcaaaaaaaacaaaacaaaacaaaaaaaaacacaaaaaaaaacttagccaggtgtggtggcatgcacctctaattccagctactcgggaagctgacgtatgaatatcacttgaactcaagaggcgcaggttgcagtgagccgagatcgtgccactgcactccagcttgggtgacggactgagattctgtctcaaaaacaacaaaaaagtgtctcttgtttttccctttaaaaacacacttgcaactgttgctaatctggagcatatatttatggcaacttgaatctagactcttgggttgcagtcctcaaacttggccccagtaaactctttctactaattttacagttgcataattagttatctgactcctagttagactgtgccaagagggcagggactgtgccaatcttgttcgttactgttaactgccacattcagcccaatgcctagctctgaatatgcactcgtaagtattggctgaatgaattaatcattttgttattagtaataatgactctgccactctgtggggttagttattatcatcttcatgttagttggaaggtaggtaatttgttccttgtttcactggctctcaatgtttgactcatgtccttcttcctcaccagagggcacacgagctcctctagggcagggactgtttctccttcctcattttgttgccacaaattcagctcagggctaggcacaaagcacaggctggacagatgggcgactgagggacaaacggagagtcaatcaatgttctccacgaccaggtcgctacctgtctccagtccctcctggcctcagactgtgatccagcaacaccgaacagcaagtgacttcccctctgcataccccccaggctgctccttgccttatgctaccacatatgctgccctttttgcctggaatggcttccccttctatttacaaagtccaactgatattttaagtctatgatcaggtgccatttcctctggaagtctttctcagatcctccaggctgtttgtcctctggtctcctgcagcccctgtagtttcctgtctcacagcactgaccaccctattgccacagtttaccccgactctgtcatcatgggcaggaaccatgactgcttaagtgttccctgtgccaagcagaggactcaggatatggcagatgctgtttgtcaaatgaataaataaatcctggagaaaaagggcaggcagtctgaggcccaagactgatcttgccaggcttcctttattagagactgcttgggctgatgaacaactgaggtaagcactcagcagaggcctagccccctgctgggagaagggagatgggtaggggtgttgtctttcacccactttgtgctgaaggaaatgtgatctccaccgggagaacaggaggcctcacttttcccagtcccagtcctgacaactcctcacatggcttggcctgagcctggacagatgtgcctctagtctgccttgtgccctaggtttcgggtgagcagttcctcaggctcaagtttggggtaagcccaggagcaggaccacctgctcacactgctgacaggtaggaggccaggcttccacttctgaggaaccagagatggatgaacttaagtgcctcaggggagaagggaggaaatggatgtcacacaggaagggagggagggagggagcgagggagggaggaaagagaagagacctggcctccctctgatatagccaaggggagtgtgaaagcctctggactgcttacttcaggtacactgaaaagtcaataaaaagcaaagaaagagtcacaaaaaacaagtaagtgccgctgtgctgtggaacagggtaaaagacggtagagaacacaaccttgtccctgcccttcaggaggtgcacaatccagcagtttcagatgaaatatagcccacagacttcttcatataaagaacagtgtggcaagtggcattcagctctacttctccaacctgacctccagcttctcttccacaaaaggagctccctcctgtgacaagctgccatggtcctttctagatcaccctcataccctcccagaccagaaggcaggtgtaggatcagagtggggggaagaggcaaaggaagatgagatcacacccagctgggaggaatccaagaaggctctgtaaggaaagcagcactagagctttgaaaggtgtaagcagaggataatgaatacagatggcagagggccatctgtggaggacccacatccagggcccatggactgaagattccagggtgtccttaaagaggaggatcgaatacctccccctgggagcagaagagcattaggctgctgcccttcactatccagaactttcccaagactctggggctaaggacaggagctgggggaggtcaagtagaggcagacacagtacagagccccagagaggtcaagtggggaagaagggtaaagcacgacattatttacgaggtctgagttttgctctaaatactgatattattgaccatatcaatcatatacacagtgacccaaccatgtgtaacctacagtcatgcgctacacaatgatgtgtttgttaacgatagactgcatgtatgaggtggtcttataagattataatgaagctgaaaaattcctatcctcttgtgacgttgtaactgtctcaacatcatagtgcaacaaatgaccttttctgtatttaggtatgtctagatacataaatacttaccattatgttacaattgcctacagtattcagggcaataacgtgctatacagattcctagcctaggagcaacaggctataccatatagattaggtgtgtggtaggctattaccatttaggtttgggtaagtatactctatgatgttcacactgtgatgaaattgcactactcagaatgtgtccctattgttaagcaaggcatgactgtatgtgtaaattcaaagaaataaatgagtatgggattctgtcctgctataggcaggtctgttgggcagagctaagagcccaggacattgaagaagaaataaagagcagcatgaaccacctgtacagagtctagggtacagaaaggctgaataaggacctactgtaggaattccagaaagtttccttctagcaaggatggtcaggctccctttacccccactgcccccagacctggctctgttcgcaggaagaactataactggtgggttacatgtctgtttccttgagaccagggcctgggtcaccatccccatcccccatctgcagtgcccagcagaggcccactcactctttcataatcaagagctgctttgggtgagggggagggaaggatgtcctcattcaggccctcatcatcttgaatctgtctttactgaaacagaaacagcctcttaacagatcggccctcagccttttcccaatgcagtccatccttcactcctctgcaagtcagccttaactgggtcattcccctgctcaaaaacttcccacgtctccccactgtgtacagagtaagagttcaaaactcctcaccctgggcatggcaggccttgcacattccagcttctctcagacaaccttccctcttttctgacaccctgtacaaatcccacctcaggagcatcaacatattccgcaggcccagcagccagccagcatctgcttcccgcctttgcttagcttgctcctggctctgtggtcttgtatgagatgggggctgagggcaggtctgtgcctcgctcatctctgatgtcctcacatggagtgaagggagattctgacagggtcatcctgaccaagtgaggtgggacaagaggaggcaggagaaaagcaggctagagcctggggacacacatgaaaagcccccccagacactatccacacgagaatgaatgttcagaaaaattgtctgaatcacacatacaccgttaagttcaattactttctgtatttttgggatgggtgtttaattgctattagaaaaacatgtatttgaaagaactaaataatcaatgcctggcagctcaatggaatatggtagtggcatcccctgggggatggaagagtggattcccaacattgctgctctgcaaatgccctgccaaaaggggaaagtcgcagcccggcagcccttcgcagtagccaacaggtgattccagggtcagcaagggtcagtttccatacccgtactcctgtactgcagcagaatgaagcaaagcacatctgtttctggaggaatgaagatgccacacacagcctgcagttatgaatggctcttataacaacaggatgacatctgtgcttggtttttaagatgcatcatcgcatgtttattaaactattgctccaacatatttatttggctacaaaacaactcccagcccatatttccaaaagtggtttattaaaaactaaggcttgaacattaatacccaaaagcacccttgagaatcaataataatgctgcagataaaatgaaagggaatcaaagcagtaagtcttggtggggtgggctgcttttcaacactttcttgtatgttcaggaagctaaggtggggaagaacaccaagggcctgtggcactgggtgtggaaatagccaccccaacacctgacttcctgtctaacatgcagacatgatggcaaggaaggggggtgtcctatggccacctagctctatataaatggccaagagaggccaaggttaggcccagtggggggcatagtttcaacaagaataagacctctgcccttaaccaacagccctgtaactgatgccccatgctggccccagtctgagcatccatcctggacacagactctgccctatacctggcactgggctgagccgagttgaatcttgcccttgccaaataataagcctcaaattcaacctgccagtggtcactggagactagctgagccagtgaagctacagaaatgcagtctgtccccgggcaaagccaggtatgggcccctggccctgcaggcaggcatttctagccccagaccttctggcagatggtctcttccagctctgtcccaaatccccaagcctttccatagatgccgacctgcaacctgtccaggcagcaagcagtaatacatggccattcccaaagaaatgagcacaaatcagaagattcagagaagaacccaaaggatatgggggctgaagggagtccaaaccaacccagtgaagaacaaaatagctgaaggatccagggatgtttgggagctgactccctaccgaaaatatccaaggggtgatctgggtaaaggaagcccaggtgactctgtgactacagagatgtcacaggggacagttcccagcttagggtaaggatttcctccaaagcaaagtcatcacacgagaagaggctcgccctgctcagcctctcctgtaggggagagcaaggcctggggttcaactcacctgctgacttcttgcatattgttggcacgggcagcttccaacagggctgcatctgaagagaaagggggcactggtcagatccgcggccaggacatacccatctcaggactgcgtggagggcccactaagacagtggcagtactttagaaacgtggactttgacaagcaaactgatgtcacaatatataatgagaaacgaatcattccctccccacatggtgtccactgttaacaacctgacttccacacctttctactacagagcccaaactcttcactcctctcatcatagagggaatgcaggtcaactgctagcaccacgtcttgcctatggtaaataatgtgctcttcataatctatgaagctctgcatatgctttatgttcctataagagttattactaaagattccctgatcttgtccactttctccctcaactccagttcttcaacccagttctgaatcttgatgtcaagtcataaacccaaaaggaaaggtagaatggagaggagcaagcagggtgtaggcctctctgaggatggagaggtctcaactaggagtctttgagatctagctccattccactcccactactcaccacgtgaccatgacagctcctctctctctcaaccacagctttcctgactgtaaaacatagacaaaactccttgccctgccagcttcacaaggatgtcaaggagatgaaatgacagttgagacgtctgcaaactccccagtgctgagcccagggaagggagacccaaagcagaggagacactaagcctaggagaaaagcaacgctagctaagtgcgtctggcctggtctgggcagcctgcaggctgttgccaccaccttgtggccataaagaaaattggactgactcagaaaaactcaaaagtcaacaggagaggcacaatcttttcaaatagctcaataccaggtacatggagccctctgtgcccagcctggttctgagctacactgctgggcagtgggcggattcatagccagccctgactcagggaactctcagtccagccaaaagactcactcatgagcaaatgcactggagtagagtgaaagagcaggatctggagacagtcagacctggggtctagcccagctctgtcgcttatttgctgtataacctagcccacctatctaacctcctgagccttagtttccttatctgtacaatacaccttatcatgcatatgaaagccagtcctgtggttcagacattgatgcctcctggcctagattccagggacaggtcctttctacttaccttaccggatgtacctaaagcacatacccaagcatggctcagacagccaccagctgggaggggatcaagccttccttagagatggctatatccactctcccttcactctgcagaaaaaaatgtggcttctacaaggttacagagtgaggaatgagctaagaaccagggcctcctggcttctaaaagggttcagtttctaccacactgcactgagggtcaaaactctaagtcaggggacagggtagctggcaagtcagttccagcaggaactggtcacggctttgaccattatctattttggtaaatagaccctggtattcttgctggagttcataggccataaagtccagttgggaacccccaggaacttcttaggcaagacctcaccaaatacactggactcagaacattccctgctcatgaaccttccataactctccactgcctacagaagaaattccaacaccctcacctaccccacccctgactggcatccaggccccactccatctgctctcatctaattccaaagaccttatcctccaaccaagctggctgctctgctggcccctgcacacaccatggtgccccgaaactgttatttccattccctgaagcctttgcatggaatataatccaactctcacacatttactgagcacctactaagttccagacactgtggtgggcaaatgatgtctaggtattcgggaaagttgctagtataacctgaaaaaacaaaagagaagatacatttcctgctctcatggggctcaaaagatcactcccctttccgtttctacttcatccttcagaactcaagttcaaatttcccatcctctggggtctccaatactccagaaaggctttcctgaccctactggccctctgatcccccaacgacacatagcaccactcaccagccctacattccaactgcctgcactgtccccttgactgattttgtgttaagttaggacttcccacacacctagcctaaaactagacacacagtgggtacccccaaaaatgctggaagttataggattacaacatgcctaagctcgatgcccttagtgtctatttcaaaaccctcattttgtagatgaggaaacagaggacccgtgaggagaagcaaaagtccaaattcacaatgagagttagacacagaaccaaaacaagatccccagtgttgtctctcccagaccaaagtccttcctttacaattggccacatcaaacgaatcaaagtcaaggcactccctactccccaactcttgctccaaattctcagagcttggggtgcatggaatctatggacaccatgcctcagtctttcttcttgaggaacaactaagaacctgaatggctggactcacataggtcatcagtctggctctctgtccactctctcagctgctgcttagctccccggatccaaatgagatgctaatcgggatcagccagtcccccagcagttgcccttgggcctccaggaatccaccttccttctcctgccaactatcccacatggcaagatcacctcacagcatgtgagaccagacacagcaaaatcctgagactgacagactcaggccgctgaactccaaaaagagtcaaaataacagtactgtaaaaatgttgggaaactatccttcactatataaataaagaaattggtcagacgcggtggctcacgcctgtaatcccagtactttgggaggccaaggcgggtggatcaggaggtcaagagatcgagaccatcctgaccaacaactaaaaatacaaaaattagctgggtgtggtggcccgcacctgtagtcccagctacttgggaggctaaggcaggagaatagcttgaacccgggaggcggaggttgcagtgggccgagattgcgccactgcactccagcttggcgacagagcaagactccatctcagaaataaataaataaataaataaataaataaataaataaataaataaataaattgaggtcaagctggcattagaaccgagtcaggttgttcctgactctggcacctttggtggcggggggtaggggggagcggtttggcaacttctctaaaccatctggcggttgcccttaaaacaccccataatttccgtttcctggagatctcaggaaagaggaattggaccaggcagaatatgagaaacataaggggaccatgctataatattagatgtttagtccaatatccccattgtacagatggataaaatgatgcccagagaggggaagcggatctatggtacgagattatacaactccgaggtgatgaggtctctagggcaacaccctgcccctgtaaccagatgatgtctgagtccctccaagacttaggctctaaggatctaaacctataagtacctcccaccctcctaagatacgaagttaggacaatcttcccgcctctcccttcctcaaacccagatctcataatcacccttgttggacggactcttgctgtagcaatgaaccaccagcgctgcggccagggcgcacatgcccagtccggccctgctggggaccccgttccagctgtcctgtcctgggagtgtttcttcgggaccaggaaggcgtccccaagtggcagccgcgaggcatttggtatcgaagcgtcctccctggcgccccccggtggctgccccacgtccggagaacaaggccggcgatgttccagggcgccccccggtggctaccctcagccactgcggctccccgagactcccagtagtcacattccggccggaagcacctccatggccccggagcgttggggacctgagcagccggaggagtagccgtggcgccagtgcttttctcctcaacaccagggaccccagcatcttgacagctgcttcgataaccccgtggtgccggcccctgtgctgaccacgtccaacatggctgccgcggcgcgttcgaagacgccgcgaacagggtggagttgcgcactacctcacgggagaggtagtccacagccctaagcctttccccagctggagaataaataaactacgtttcccagaaggctgtgggattgcgtcacaat

SEQ ID NO: 2447 - DNA, 142256 bp, Homo sapiens; identical to SEQ ID NO: 2446
  source 1..142256: mol_type = genomic DNA

SEQ ID NO: 2448 - DNA, 142256 bp, Homo sapiens; identical to SEQ ID NO: 2446
  source 1..142256: mol_type = genomic DNA

SEQ ID NO: 2449 - DNA, 142256 bp, Homo sapiens; identical to SEQ ID NO: 2446
  source 1..142256: mol_type = genomic DNA

SEQ ID NO: 2450 - DNA, 54978 bp, Homo sapiens
  source 1..54978: mol_type = genomic DNA
tatttactgatttttcaactatatgcatttattatttattgaaaacatgaatttaacacgcaaaaaagtacttattttaatcgaaggcacagtaatgtcactctacccaattattcttagcatatgacaagcaaaatattgtattgttaatgtaatcattgtatcattgtaatatatataaagtactattcttttatctgtatattacatgtaaaatatctagaacagtgacagtcacatggcaggtgctcaataaatattgctataattagcaaaagataaaaggctgcaatcaaaaacagaataagggagctacttgctttctatcattttcacagcagtttaggtcctcatatataccctatgaaaaacatgtgcttctttttttctttctttttttttgagatggagtctcactctgtcgcccaggctggagtgcggtggcgcgatctcagcttactgcaacctccgcctcccgggttcaagcaatcctctgcctcagcctccagagtagctgggattacaggcacccaccaccatgcccggctagctttttttttttttttccaatagtggatgtttattttgtaattaaaaattattactggaaggaagatatgtactttggtggggtgcctgcatgggtgaacaagaacatgagagtgtccaagaaataaatggccaagtcaagaagctctcatagagatttatttagtgtgagaaatatgagaacaatagttgtaaagaacaaatcaataacccgcagtgtgcattttggaaaaccaaataacttcttcaaatttctgagtacacagagggtacctgccttgaaatttaaatgtctaaggaaaatgggagatgattaagagttggtgtggcctagtcacaccaaaatgtatttattacatcctgctcctttctagttgacaggaaagaaagctgctgtggggaaaggagggataaatactgaagggatttactaaacaaatgtccatcacagagttttccttttttttttttttgagacagagtcttgctctgtcacccaggctggaatgaagtggtatgatctcagttgaatgcaacctccacctcctaggttcaagcgattctcatgcctcagcctcctgagcagctgggactataggcgcatgctaccatgccaggctaatttttatatttttattagagacggggtgttgccatgttggccaggcaggtctcgaactcctggcctcagatgatctgcccaccgtagcctcccaaagtgctgggattacaggtatgagccactccacccagcccagagttttcatttgttccttaaaataattaagctggaaaggcaaggacaattatgagcacaactgtagtcaagttgagaagacctcaaaaaagtcaagtttagaccttcggattttccatagaagagaaaaagatactaggttttagggtacagagagccagatctgaagagtagctgcagggggaaggtgctgttagaaggaggatatagacacattctctggggggaacatatggtgactgacccatgcacacaaagggggccttagcgaaactgcagaggactgatccttaaaccaatcacatctttgccaatctctgtcacctgtggaaaaacaaacaaaggaacaagttagagatttgtaagattgagaaccctagaaaatgtattccctatacccctcaatgggcacagtagacaggtattggggtgttcatcactgactggccaagagcagtggggagatgctctagctttctccagtgtcactgcctcagggagcaggggacaagcacaagaagaaaaaaaggaccaccatgtttctttctttttccccttcgctcaatatcctagatatatttattgaggacagtacttactgtggtgaccctgcagatttgacctttgaactcaggggaatagcaggccccactgagtggacacttttctactggctttccacggtagatgggccgatatgatgcagcacaaatgtcaaaggggttgtgcatgtcataattgagctggtaggcatctgtgggattcttctcacaggcagacaggatttttcgggtctaggggaaggaaggagtatttaggaggacagaaggctgcagacaacacctcaaaggatcccaacaccatggtttggtagttccgttgatgtgagacacaactgtactgcgtgaaaagaggtcccaacctctgtactggatgtatgtgaagggttaacaatcaccattcctattgtatcaaactttccccttctcaatacaaaagtggctccataatctagacccacattcctccaccaactctagagattatcagggtcaggtcctagaaagggttaaaacagacttccatcacccaaaaagaatgcatttggaggacacaagtaatgagatgtgtatgtgaagctttgtggtggttgtgatgggatatctggagcttaaggacaggactggggttactttcagctgcagtggagctattctaggttgcacggcactcttagacgagtgccatgtctcaataaactattaattttccaggaacaaaggaaacaccaagtcaggaagtaaacagagggtagcattctgttggctttttgttgaatgttgttatttattgctttgtttcagaggcaaggaccttggtctgctccctccatgtaagagctgatctggcttccctatggtcactgaaggagttccatctacctgttgggccacctcaggcttgggcccgagttctagtaggcgccgagcaaaggtggcagctgtcttgaagttcttgagcttgaagaacagattgagggctgtacgcagcaccaggatcatgtgcacaggctgcaggtttgagtgggtgaaataggctgccatctggtggacagaaaaaggaacacatgccaggttgatgctacacctggtagaagtcatttctaagctgctacacatgcataaaaaacacaacacaaaataggatgatgggctataaagctgagaggtcttctacctcctaggtatggaggactggtgagatgaggaagtaggatgaagaaatgtatcctcccctcatagaaatgaagggcctaaatttctcttcatccccactcagatctgggtttgaaattaaagaattcaaacctagtgaagggtgaagggaaggacgtctctgttgtgctcagggtcctatagatcttacctcacagatgcgcttctgctgttctagagtctctttgggcagcttcttcctttctgtctccacggacaaacccacaatgtactcacggcaaatggtgatgagctgctgggcctgtagagggggcagaaggtcaggatacagagacaagaatgtggaagtgcccagaactgggacagcggctagaccctcctacctctgcaatctcttgtttattgtccacaacaagaagtggcacactgagaaggatggaacggaatttttccacagcctcctcaaatttgccaactgtggtgagctggtagcacagctgcaaccgttggatgaggtcattaagcttcaggcccacagctggtacaccattcttcagccctgcatccttcctggaaagggaaaagtaggaagaagacaggatagtcagtaggcaactaggacccaatttccttttctggcaaacatcctcatagctaccctcctgtctcctgttaaagtagctggggaagaggatgacagcaggtgtaaaccaaccccatagagtaacaaaccaaagatctttttctactgggaaaccctagctctgagagaattctgactatgtcactgaggctaccatctgaaatatcgaccacaacttggaacagatgaaagcaaagagaaaagggccttaccagttgcgattaggatagccatacatggagggtaggcagggcagagcctgataggttgtgcggcctcgggcgtatgtctgtaggaacagttgcttgtaggggccaaactggattacccctacttggtcatgaaggagctggaacagaaggaaagaaacaaggattttggccctgctgcataaaaagctacttttccttgggcaaggtaattaatttctctgttcacgtttcctcatcagtaaaatacacttaattgtaagacctacctcatttaatgatacctattaaagtatttaggatagtgcctggcacacagtgaacattaaataaacgttagcagttattgcagtgttatcattattgttgttattataacaatactggcttagtgttcaaaacagacctctgcttggaaaggggtacttatctcactgatatgagccagaaagcaagctataaatgggtggaagatgactgaaggatatgccctaagagattactaggccaagtggaaggcagataacaggaaggcaagtgtacttaacaaagataaagagttttcatgaaaaatatacacctttccccttatgggtaggataatttcccttgattaaaatgagtcaaccatctcccggggaccctgggctaggcacactcaagaggaaaagccaaggttacttacccgcatggctgtttcgaaagagcctgccaggatgtgatcaactggaagctgagagttattacaccagatctaacaagaaacaaaaaaacccaagccaagtgaaactttgtcccttctctattctcctctgtaactatagtagaaaagtagccaacacctgttatataccaatcaagtattagccactcatccctgccgtgctaggtttcttcccgcttacctgagttggacttgttcccttggttgggggcacaaagaaaccatcttcagccccaccagctgccccaggggatatatcctaggggaaaaacaaaaattgagtattgagtaattttttttttttttttgagacagggtcacactctgtcacctagactggagtacagaggcatgatctcggcacactgcaacctctgcctcccatgctcaagcaatcctccaacctcagcttcccgagtagctgggactgcaggcatgagtcaccacacctggctaatttttgtatttttttgtagagatggggttttgccatgttgcccaggctggtctccaactcctgagttcaagtgatctgcctggctcagcctcccaaagtgctagcattacaggcgtgagccactgtgcccagccaaattgagtaattttttaagccattcaagcactttgttctgttgaatctagaacacaaccatttacattgttccctgcccccactgaggaagaggggtgatagttgtgggagaaggctgccaaaataggagccacctcaccagtgacaaaatgacatatcaaaaactccaattcagatgaaacagcttgctaccttctcataagctgctgctggcagaacgctgattacctcattcttctttctttcaaatgggagttaagcatcagattagagataagtcctacatcctctcctcttggagcatatcaggatagatggaagtgacaaggccactaactttgactctctcgttcttcctgcttcttttactttttaaaatagagacagggtcttgctatggtgcccaggctggtcttgaactcctgggctcaagcaattgtcctgccttagcctcccaaagtgctgggattacaggcatgagtcaccgtgcccagccatcttccttctttcaaatgggagataagcatcagactaggagggtctagtccccttcccagaagggctgaccttaggatagtggtaggggataggataggagacctgaggatagtggtaggggacaataaggcctctggcttccacagggagatacggagagaaccttctaagggtacaaattccacataccagctcaggagggagctccagatcttcttctacatcccagccacctccttcttcctgtcccttgccaagagcatcatcccccaaaccttctgtagcctccacaaacccatctgtaaggaaaattcaagctcaaaacagatttgggcagtggcataatcttagccaaaggaagtaaaatcaatcctagttcgtttcatggcctggaagtctgcagagctacccacaacccagtcccaatccaaggtgtccatcaccccagaacagtcttaaaacagcacttttaccttcatccaactgcagctctgcatcctctccccagccctctgtaccaacagtgtcaatgtcaatgtcagcagccagtgctcctcccttccctacagagggaaggaacagaacggaactggttatagtccagcaagtctgagatacggccttttctgtaggcaggttaaatcctttcaaaaacaggtgccaagcttctgcctacttactatttatttttgtgtattatttatttttgtggtatatatgttatgctaacttgcagtagctttcacagagggagggaatagaagacagatggaaggaactggccttcctgctaccaaaaactggctcttaaataatttgtacttaccagcctttggctaccaactcttgaatttcttcctgagcgctttgctaagctaccaccactacaatgtgtacagggcatcaggcatagggtagatagaggaggtggagaaaagagtggggtttggcacaaaatgctcaagagtctgtttaggctcttactcacgggaaatgaactaggagacccagaaaacaggaggaggttaagggtggaagtggtggagggtgatagcacacatctgcctatacccacataccggaattacaggtagttgaattagtacctttaagattgtatgtcatgaatgataaaatactgaacaaagaacatgactacatatatagtaaaacctaagaaaatacaccaaaatattaaccgaagttattgatggtagtagagggatccctttttttctccctattttccaaattttctttaatgacctgaaaatgctatcttaagtttttaagactgcaccataaatgactggcatttcaatattccattaggctccatgcagaaaaaaaggacaagttaaactaaatgctaatggtattctctaggacagttcttcacaaaacaaacaacaaaagtgctatgggagaaataggtacttacctttgctggcaatggtgccttcaaaaaatcctttggatacagtcaataaaggccaattggtatccaatggcatgataggtgcaggtggctggagcagcttggcattagggtcaatgtctgggatctgaatagtagaagaaaagaggctaaaaacaaatagcacttggaagtcacgtaaggaaagttatggagcctcctttgatctcatttgtttctctgcctctcctggtaaccaggtgggagagtgacattcataattttaaattgttctaagatcctagagttaatcctgtaataagagacaattatgtaaataaagactcactgtctccttctctgggtcaaatgtctcctttaggctctcagcttcttcatctaagccatgggtagcagctgtgagataggccagggactctgtagagaaaacagactttgtggtataggtacatttccaaatgcatgctgctgtggtaagcaacctctgaaatggccccccagtaatccctgactcctggtattcaagttgttgcaaaatacccacctcttaagtgtgggctggatttattaaatagcttctaatggatggaacatggcagatgtgatgggatgttacttcctagatctggttacaaagattgtggcttctatcttggggtgccctcttttgctcacttgctgtaagggaaactagctaccacgttacaaactcctatggagaggtcaacacgaaaagaaagtgatgtttcttagacaacagggagcaaggacatgggggctgccaatggccattgagtgagtgcagaagtagattctctccccggtgagtcttcagatatctgcagttctggccaacactttgactgtagcctcatgagagatcctaagccggaggcacctagctaagccatgccacaaattgtgaaataataaatgtttgtggttttaaactactaaatttggggataatttgttacacagaaatagagaactaatatagctgcttatctttgagacgtatccatccgtgctgagaaccttggatatccctgactcctctctgttacatctcaaatctagttaccgcaataaatcatgttgtttctaccttaaaatatatcctgaatctgaccactgctcacccctccactaatagcgccttggtccaaacctcatctttcaccttgcttgtttcctaatgtatcttaaatgctaatataatgcttggtatatagtgggttctcaaaaaatatcccttgactatatacatgaataaatgagtgaaacctccaaactgaaaataaagaataaaattctaatggcatccaaccaagtgcatttactagggcgtccactcaagaccttttaaaacctcctatctcccccatgaataactattctcctaagggtgtttggctggactgaatattctggctgcacctccctttggctttgaagaaaatcttctaagcacagtaggagcatgttgtctctcctaaaaaaatgcacaataaagagaaatccctcaccactatacacagattaactcaacaaaaacagaaaaatacttcctcagaccctgaaaaagctggcaagtctcggatacttactctgtccacagttcttcaggatccgcacacgctctgacacatcacccaggtatagggcattctgatagtggccactcatgtcctttctgatctcagctgcaccaagtaagagacaccaagttaggtcttttctcttaagttctctttctccttaattcaccttcctccttcccccaagaacccctcttcccatccttagtttgagggcctcaccaatcttcatcatcttgcgaagtttttctaagttgccagtgataagatacaggaaggaaagtttgtcaaagtttttggtacgctgatagcacatttccacaatctggtggttcccctgcagcagggccacttctcccagcttttcccagcagttcttgtcatccagtgctttggctgcttccagagcaatctaaagaatccccagggtcgtgttaacaggttgaaggacaatgtgactcaaaaccaaggactctgcaaagcatctgcatctatatagatttcctgaagaacttcctatactttcaattactcctagcttttagtctaattccattgaaaatcggctgggtgcggtggctcacatctgtaatcccagcactttgggaggccaaggcaggcggatcccgaggtcaagagctcgagaccatcctggccaacatggtgaaaccctgtctctactaaaaatacaaaaaaaattagctgggaatcatggtgcacgcctgtagtcccacctactcgggaagctgaggcaggagaatcgcttggacccaggaggcggaggttgcagtgagccgagatcatgccattgcactccagcctgggcaacaagagcgagactccgcctcaaaaaaaagaaaaaaaaaaaaagaaaatccagtgaacacataggacccctttggatacagagatggaaataattacatcgcattatcctcctcctcctcctcagaaatttacttttacaacaaaaccacctagcagttgctgattccatagagccagttcttgcttagctaccttacttcccacctgccaggtttgaagatccacaggggctttagcaaagacagaagaaatactactaggaagaagttcagaactggaaaacgttttcataagctcttttcgccttagaaaacaatgcctatacattctaggccccaacgcttagtaggtactctttcatctaagtagccagtcagcaagatcaagtgtcaaggaaataataagattttcaaattccatgccatcttgcttttatcctagaagttactgaattcacactaattgaggttgacaaaaatagaaatgcggtggcagaagcagaggcaggtaaaagtagagatgggcaaatagcaacaggaagatggctcaatgtaacaactaaaaaaaatcccaaatttcattattctggctaaagaagcaagcccagaataatgccctcccaatggcactctaactctctcacctctaagacaatatggggctgatgaccatattcctctcacctcaatgtttccacactccagtgccagactaaagcgagttttctcatccttgacaaaatgcagtgccacttcaggatagcccttcttctggagataagcaataatagactggccaactagtttggcattcctcaccatgtgcagtacctagacatttggggtggagtcgggcaagaagtagacatcacttacaggaaaagaaaaaaaaaaagagtgctgcctctcttaatactctagtttgcatcctcacttcatacctcatcatattttctgttgatcagggccagcttgaatttgaactcagtgggatcaatggtgagtacccggggacgacactccctgtctaggcagtatacattgttgcccttcacccgtgtgacatagatgggtaaatccagagttcgaatgatcccgtggtccctaagaacagagggcacagctttcagtaagtgagagggaaaatccatcctgtgaagaaacggaacaaacctaggaaacggtcttttgtcaagtgccatttgaacaatgatatagatgggaagtgattcaaaaaagagcagaactaaatgccaaatttatcatattctttctacgatggggtagatggcacgatctttatatgctattatcctagaagatgagtaacagatgtggctataggaatcagacctaaaagttaaatcttaagttctgatatataatcagtaggtgattatggacaggtaactcctttataatctataactgaaagtagaagagaggtagatgtgaagagttctgataaagaaataataaaaaacaaagtattttgaactgaataataataaatagattgcaaattgaagtttgtcaatatagctaatgcaacatttaacagataatttacagactgcattagaagaaatattaaaaattattgggttctacatgcatatattaggagaaactgaaaattaacaagcagtcatctcaaaaaatttactgttctttttaagccaaagaaagtacttagaagaaaataatgaagccaatagtagaaattaaataaaaaacaaaaactacagtagagaagttcaatgaaagcaaaacttgaataaaattgataagcctctcatgagggtaattcagagaaaagaaaacaataggaatgaaaaaggggatatcactacagatcttgcagaataaagatgtaactttttaagagaatcaaactggccaggtacagtggctcacatctataatcccagcactttgggaggccgaggcgggtagatcacatgaagccaggagttcaagaccagcctggccaacatggtgaaaccccgtctctactaaaaatacaaaaattagccaggagtggtggtgcatgtctgtaatcccaactactcggaaggctgaggcaggagagtcacttgaacccgagagacggaggttgccgtgagccgaggtcgtaccattgcactccagcctgggtgagactgggagtgagactccgactcaaaataaataaataaataaataaataaataaataaataaataaataaatagaaggatcaaactcctaaaaaataaaatttgccaaagttgaatcaaaaataaatagaaaacacctatagtcctataatggctaaataaactgaatcagatttttaaaatcctcccatagagaaagtcctatgtccatatgacttcaagggcaaattctaaccaatattcaaggaagaattaattccagttgtatgcaaactcattgagggaacagaaaaaatacattactttgctttatgaaattcacacaaccttgatactaaaacctaacaaggacagtaagaaaagggaaaattacaggtaatctcacttataaatatgtgaaaacataagtaaaatattagcaacctaaagctagcaatatttgaaaagggtaaaaatatcaagaccaagttaggtttacatcaggaatatagtgttgatttaacatttataaaaaatcagctgggcacagtggctcatgcctgtaatcccagcactttgggaggctgaggcaggcggatcacctgaggtcaggagttcaagaccaacctgaacaacacggcaaaacctcatctctattaaaaattcaaaattagccaggcgtaatggctcatgcctataatcccagctacttgggagactgatgcacaagaattgcttgaacccgggaggtggaggttgcagtgagctgaggtgcttgaacccgggaggtggaggttgcagtgagctgaggtcatgccactgtactccagcctggggtgagactctgtctcaaaaaaaataaaaaataaaaaaaaatcaatttaattcactacattaatcaatgaaaggagaaaaattgtatgactaccccaatgctggctgagcatcccaaacaggaaatctgaaatgctccaaaatccaaaactgagcactgaagtgacactcaaaggaaatgttcattggagcagtatggatttcagatttttggatgtgggatgttcaatcagtaacacaaatattccaaaatcagaaaaaaatcagaaatataaaataattctggtttcaagcatgtcaagtaagggacactcaacctgtatatgcagaaaagttatttaataaaattcaatatttaggccgggcatggtggctcatgcctgtaatctcaacactctgggaggccacggcaggccgactgcttgagcccaggagttcaagaccagcctgagcaacatggtgaaaccccatcactacaaaaaaaacaaaaatgagctgggcatggtggcatatgcctgtagtctcagctacttgggaggctgagctgggaggataacttgagcccaggaggcagaggttgcagtgagccaagattgtgccactacacaatgggcaacagagtgagactctctgccaaaaatagttaaattacattaatttaataaatagatataaataaataaattcaacatttaggttggtaaatgttgaattttaccaaggtaaaaaaaaaaactcttagcaaaaagaaatagcaaaattccttcatagaaaagggatatacattttaaaaatctactgtaagctcacataattctaacacactgaaagttcaccctttaagttaggaataagacaagaatgtttgctgtcatcatgttaattccacattgctggagatcctagtcagtgcagtaagcaagaaaaatatagtaatatataagtacttgaaagagaaactaaattgtcattacccacagatactatgattatttgtaaaggaaatagaaataaatcctggaattgataagagtctagcaagattcctaaaatcaattttaaattgattttattgtatttaaattgaattaactgtatttctaaatatcaacaaaattagaaaattaaaattttaaatagatattatccatttacaaacagaattttaaaaccatcaagtgtctaataaatctaaccaaagaaatgcaagatctctatagagaaaactataaaactttattgaaggatgtttcagaagacctaaatgaatgaagagctgctataccaagttcacagattaggaaactgaacactgtaaggactgtaaagatgacagttatcccccaactgatgtagagaattaatgcaattccaaacgaaaccacaaactttttttgtgtggaatttcacaagttactttttttttttttttttttttttgagatggagtctcactctgtcgcccaggttggagtgcagtggcgcgatctcagctcactgcaacctccgcctcccaggttcatgccattctcctgcatcagcctcctgagcagctgggactacaggcgcccaccaccacgcccagctagctttttgtatttttagtagagatggggtttcaccgtgttagccaggatggtctcgatctcctgacctcgtgatccacccgcctcagcctcccaaagtgctgggattacaggcgtgagcgaccgtgctgggcccggaatttcacaagttactttaaaaacttatatgaagggccgggcatggtggctaatgcctgcaatcccagcactttgggaagctgatgtgggaggatggcttgaggtcaggagttcgagaccagcctggccaatatggtgaaaccccatctctactcaaaatacaagtattagctgggtgtggtggcatgcgcctataataccagctactcaggaggctgaggcaggagaatcacttgaacctgggagacaggagaatcacttgaacctgggaagcagaggttgcagtgagccaagattacgccactgtactccagcctgggcaacagagtgagactccatctcaaaacagcaacaacaacaacaacaaaacttacgtgagaaggcaaaatttacttgaaaataccctaacgacttttaaaaaataaacaaaataggatcaaaggaaaagttgtaccagatgtgaagatttatcataaagctacattatttaagacagtgtggaattagagcagagatagacagaccacatttgaaaacatgatttatgtataacaaagacgagactgcagaacaatggagaaagaacggtcttttcaataatgctgctgggcaattgagtgtccttatggaaaaagtgggattgagctttctatacctcacaccatacataactatcaatgtcaggtagattatagacctagatataaaaagcaaagttacaatgtttttacagaagaatacagaagaatggctttatgatttgggagtcaataaatattttaaaaataggatgaaacctaatatccataaaagataaagattcataaactcaactacattgaaattaagactgttcattaaaggataccataaagaaaatcagaagacatgctacaaaagaggagatactaatatttgcaacatgtagctctgacaaaggactgacatgcaaaaaagaaagataatataaaatagattaaagatttgaacagaattcacataagaggaaatcctactggatggccagatgaaaaggtgctcaatctcattaggaaacagagaacagcaaaacaaaattacaaggagataccattacgcatccatcagatggacaaaaataagtctcaccaaacttgtcaagaagacaagaaaggaaattttttgttcttttttttttgagacagagtttcgctcgttgcccaggctggagtgcaatggtacgaccatggatcactgcagcctttgcctcctgggttcaagtgattctcctgcctcagcctccggagtagctgggattacaggcaccaccaccacacccagctaatttttttttatttttaggagagagggtttctccatgttgctcaggctggtcttgaactcctgacctccagtgatctgcctgcctcagcctcccaaagtgctgggattacagacgtgagccaccacgcccaacccaaaaggaaatttttataccaagctggtgggcatgcaaattggtacaatcactttgaaaagcagtttcacagctgggcgcggtggctcacgcctgtaatcccagcactttggggggccaaggtgggcagatcacaaggtcaagagctcaaaaccagcctggccaacatggtgaaaccctgtctctactaaaaatacaaaaattagctgggtgtggtggtgtgtgcctgtaatcccagctactcgggaggctgaggcaggagaatcacttgaacccaggaggcggaggttgcagtgagccaaggtcacaccactgcactccagcctgggcgagactccgtttcagaaaaaaaagaaaagcagtttcacattgcctaataaatgtgaagatatgcataatccatggcctagcaattctattctggggatacactctagagaaatgtatgtacatgtaccccagaaaacaggtaaaaaagaatgtttaagagcattgttcatacaagccaaaaactagaattcactcaaatattccttaagagtagaactgacaaactgtggcataatcatataattatacaaaaatgaaaataaatacattggagctacaagatggatgaatcttacaaacaaaatattgggcaaaatatgaaataatatattcagtatgatttcatttatatgaaggcaaaaccaggcaaaactaaatcatattaagaaacacagggcagtaaaattacaaagaaaagcaaggaagaaattactgtaaaaactagaatgttactgttggtggaaacagggagggttgtgaccacgtggcaaagggcttctggggtgccggaactgttctattttttgacttgggtggtagttatgctgatgttcactacataacttatttgttattctatttttttttaatgtaattgtctatatttgttttagatttctcaattttaaaaaagttgaaaaaagaatgttctgatgccccttgcacatatatgccaggtaaggcttttccatgaagaaaattcatggaggacttcagttacatctcaagacaagacagtgatttcaggaagctgtcttctcccattctgtatcccagataattaacttacccagtggtgacagcatatttgatgtggttgcttgtggtatagataaataccccactctcatcccaggccccactcttgacacgaatgttctcatgaatgttacataaagcatccagtttgcggttacagatcacaatggctgtaagaggcaaagggcatgagtgttctgttggatagggtaagtgccgtagactggcagggatcggggtggaagggaatggtctctaaatcagggtggatataatgaagactcaccgtgtttggctagtagtgctacatgtgacatgtctgctgaccagataacgtatttcactttagaaatcttcacagatgccagagtcctgagatagatagagatgtgcaaacatgaatggatctatttcccttgtctcaggctttgatctacatcaattgcaccctctaattaatgtaaaccccaatttcttaatgtaattctaattacataaaatacttaatgtaattcctacatagtagctcagtgacttaaacattttggctcacattgtgcacttaccccttcctcaaccccctctccctcatttccttgtattattagggaatctgtgtatgtctgttttcaccactggactgcaagctcccttaaatgtaggaactatgttattaatctctgtctctctctcattctaagctcggagaacacgctttgttcaggtaagtactgtaaaaacagataaataaccaagaatctcactgtaatgctagtgtggacgtgaagaatggagagtgatcacagaagggaaaagttactataaagagtcttggagcacaagaagtggccaagccacaagacaaactcacttggggaaaaaaggttcccactaaagatgtccactctccccaactacagggctgtctgcttaggggcacctgatatgttaccgcttctgctgtacgtcaaagagtgtgatagagtccgcatctcgaagcaggagattgcctgtgccagcatagaagatctcatcacagttgggcacctgtacctttttggtgatctcattcttcagattcttgatcagaagctgcaataagtattaaagatggggttaagagaagaaatgtgtatagatgatgatgacaactgatgatgttcctcagcaattgttccttagcttcaattaactaagtattttttgtcctgtccatgtcaattaccactgcagacagaccatgccaaccaagatcttctctaagggccttaatacattattttttctcctccaactaaaacatcctgagaagtcccaactaaagtctgaatttctcaatgaatgagagagagaaaacactgtttctggggcttaaattttgttaaatattttcttcagagtgctttatcttgtgctggacctattacatttcaagtaacaatggaggcagcagaaggagggaaatttcctcatccagcccactcacttcagatttgatgcgttttgggctcctgtagtcaagagtgactttagcttggttcttaaacccagagccacggcgatcatcaacccaatcaaatcagttttaatgccattcccccaagagggcttagtgtagggctagagacagaggtacagccaatacatgagaatcacggctgcccgggggagaacagaaaaaacaatggtctttattttgcaatacacaggccactgccaccacactccccaaattagtttctgcttttagtcttaactcaccgaatgcatccgatctaggacagcaaaccgatttcgagcgacccaaacggctgtcaggcctgaggatcgtttcccttcaggcgctgagaagaacaaaaccaaagggtgggagcatgtggtgagtcactggcaggtgacatagtcgggtgccatggagctgccagtcttgctggatgccatcttggctttgccagttgagctgcttcctaactaattcagccataacctggggctattattgagtgacttttccccaccagtcccctccaaacaccaaccaccacccctgccaaggctcttttctctaggccaagtggttgcatttcagccaacatcatgtactggcagaagggccgcccatcttgggagacagcacactccatcaagctaacgagcagggcctccctggccaagctgcggcaaagcaagcctgtgtcataggaccccctccacaggatgcagctgctctctgctgcttttaacatgcaaatgcagacttcctagtagggcagggtgaggcagagcactcccaactaaatcttgacaggagagcttggtgctgggcggtatttagaaccaagttgttgctctgtaaatgtcaactgaccattcttatcaccctgaagagagttacaaaatgttcctcagttcagtggcttattagaattttgaaatggacactccattctctgggaaacttgtagaaggataaacagaagggtgcatcaaaatactcttttacctattagaccagcagaaaactggagagaacatgctggccagtcttgcccctggcatctggagtggcaggcaatttatgaaactaattattatcaaaaccaacactcccgttttccaggggccaggaatctgcattattcaagcccatctctgttgcccaccactgggctgctcctttattattatctccctcaaaaaatgaagtacagaaaataaaagtggtaataaaacaaaacaaaatattttaaattctattaattgtaaacacagatggggaaaaaaaaaagcaaagagctagttgggaggtaccaaaccataagatttagtcagaaatggcttaactgactaatttataagggagactttgacttatggataccaaatacaaatatcttttctttctctcactatgaacacatttaaaagagaggagatcgattagcaacaataataacccaggggcacccacaaaagaaacagagctagcaaattatttcttaggaatctgttgatggggtctaaaatatcattaaaatatgccagtaagagtggggatctgcagaataaatctctgacctggtactagccataaacccgctggaagaagtgcacccaaaagaccataggcaatagtcaaatccattctgagaatgttttgtcagcaagttctaatcacaaggacatcaacaagggatagtggtaatggaagaggtaggcaggagtctcagctggatcctgggatcccaggtggggtgtggggctgttagcagcctcatctttttgacatgcaaaaggaagcaaatcggatctggatgtggataggacagtataaatccctagtcccaggatgaggcattataagattggaaccacatttttaaataaatgaaactaccagggtgaaagtcatatcaactgacaataaactaggataacatgctgtgctgaaagagagaatggagagtttctaataaccaaattataaaatatatatatctagctggggtaataaaatggaggaggaacatgaatatttcacaccatggtcgcctctgatgcaattgtcagcagcacctgccaacagacatgagtgatgtggccatggcttggggatggaatgtgaaaaacttgaagaggagttatgatgcgggtgaggagagctggaagcagagtggggtagacaaaaagaacacttaccatcaggattctgggagtcagcatctttagggatggtgtacaggtcataggtactattctctagattgctagctctctgtagaagaaaaggggaaattaaaatgttagtgagaagcacccaagataccagttttccaatttactctgacagagaaaacagttccattgcacagacaccaatctgaaaccatacttttcttacccttcacccagagggcatttgactgtttctacatctatgagttatagggctctttgccaaacacatcagcactgatgtcactttattttctttatcctccaaagatgcagatattatctgaatgaaagtaagaaatgctctctactccacaaattaacagactaggaccctgatattctggtaccccaccctgaggactcatcaactgagtactcaacctctggaaaggaaaaaaaaaagacatcaaagaaaagacactataggaatgcaaatgtttattggaaaaagaagaaaagaaaaaacactcaagaaaactcagagtatgggactactagatattaaagaagaacagattagacaatatagttatatgaggaaagacatttaacttcattccttttaacttggccacgagggcactaaaattagaatgtcatttcttttttttttttttttgcaaattctgttgcaagaaacagagaggagtcattgatgactctgaagccaaccccactgatatgaacttcctctcaaaataatagttcttctattttcacccaaaggaagggatcaaggtaaacattttctttccataggaaatatatatatatagtctaaacattctctcaaattatttctagtgatctgggtcattcattctgatgctccattaagttcagctttaggaaagataggcagttcacaaatgctcaatatgtttacgacaactgaaacctacctgatttgagtctctgagtgatcactgtgtcagctctcacaaaatgaccattaaatagtttctaagaagccattaaagattccctaagggcataagaaagagacctatggaaaatgaggagaacctaggagggctccacaggttacttactgtacaaagcaggactgcattttctgctggattgtatgacatattgaatactggaaacttggaaccactagagatatatatagaaaaaggagaaaacagggaagaggcataagaatagaaggaagaaaggaatcacccccacacctcctacttatccaatctttacactatatactcatcacttttataatcaggaataaaatgaataaatattgtattctcttcctttaaggcttggcaacttccctagctcagctttgaacaaacagttttaaaaagtaagccatagtagaagtcaaattattcaacagaaggtaggtagggttaacactcactgtagtgagtgggactggttctgcttggatacaaattcctacacgtaattgcagtggacaccacagagtaacataatgtgatttgtctctggctggtttctcctgtcccttggagtattcacataaacccatttttttattgtaatgatgctaaagggtggttatcaaaacctcattccaaattttgccaccatgaatgtttcagcatgctgatgcagctggcttttcaaaaggacaggtccttttgccaggcatcccagaggttattgtatcttcagaattaagagtttccagggacatatattctggttcagagttgtgcactttttgctggaaggcaagggagagttaaagaaaagaaatgccaaacaaaggcgaaaagttctgttaccagtttgggccattctctatcaagaaacttcctctggcttgcaagagacccagcaaattgtggcagaatgattttccatccacaaggtcactagcattctcaagaagggaactatcattctactcatgaccacttccttgcctccctcactcattgggtttaaactgagcgggctcatctaatggggattccatctgtgacagaatacgagatccaaaatgtcatttaaaagaagagtcttggttgggtgcggtggctcacgcctgcaatcccagaactttgggaggccgaggtgggcggatcacaaggtcaggagttcgaggccagcctgaccaacacagcgaaaccccgtctctactcaaaatacaaaattagccaggtgtggtggtgcacacctgtaatcccagctacttgggagactgaggcaggagaattgcttgaacccaggaggtggaggttgcagtgagctgaggttgcatcactgcgctccagcctgggtgacagagtgagactccatctcaaaaaaaaaaaatttaaaaataaataaataggctgggcgcggtggctcacgcctgtaatcccagcactttgggaggccaagccaggcagatcatgaggtcaggagattgagaccatcctggctaacatggtgaaaccgtctctactaaaaaatacaaaaaattagccaggcgtggtggcgggcgcctgtagtcccagtacttgggaggctgaggcaggagaatggtgtgaacccgggaggcggagcttgcagtgagccgagatcgcgccactgcactccagcctgggcgacaaagcgagactccgtctcaaaaaaaaattaaataaataaaataaataaatgaaagaaagaaaagaagagtcttgtttgtgggagttgtatcagggtgacagatgagagggtttggaggaaagaaacaagtccgatttacctccgcaactgcatcacagctacatctttggagctgttgaaatccagctgtcgtaagaatcggtccttgacatagtgtagcatattgccatgaacagcataggctggccgttcccgttccagcttaaacacaatcataccaccatcatggcctgggggacagggagaggaggagaaaaaattaagctgtaggcaagaaaaaaacctggaaattggagatacgtaaggatgaagattatatctgtaagacaagacacctgaatgcatcccttatttgcctaaattctcacaattcttggaatctttatttaaataattctctgtgaatcctttcctaatactattcacactgccacacttagtgtcactatccacactgcccttttctgtgttcccctaatgctttgtacaaacctccattacagtacttatcatcctgcactgtaatcatttaggtctatcacccacattgtaacatgaattccctgaaggcagaaattataatttccatccttccccagtctctagcatataaaaagagtataagaagtatttactgaaaaaatggatgttaaaaaccctttgtgattctgttttttaaaatgttttgctctttccctactagcaccatcatcccttagaaaacccttccactcttgttctcctactgtctgctctccaaatataaaccagatcatgtcactttcctgcccaaaaccttccaatggctttccatgtattcagaataaaatcttaagttctaaccatggcatagaaggcaatacacgatctggccagacctcacctgttactcagtcccttactcactgtgctccaactggcctctttggtgttccttagcatgtgatggtgacatgctaagcacctctcacaacacagtctctgcatttgctgttcccattgcctcataccctttcacttttctgaaccacccaatataaagcagcagtccccatactcatctgtctctatctgccttacctttaatttttcttcaaagcatttttcaccacacatcattttacgtacatataaagtggaagaaaaaaaggagaaaagcttcaactaagtggctctgagagtccttcttcttcttgtcatcctactatacatttactagagacaaagctaataatcactttcaagacttataaactttgaattaagcaaagaaaaaagagagaaaatggcccttacctgctgcaaagaggttaaggttagggtgagcagctaggacccagaaacgatcatggtctctgcggaaagtctgaaccccagtcctagaaaaggtacacaaaaagaaaaacattaatttcctaggaatcttcagcccatcctacacaagaatattaaatggtaagccagcaagctgattaaaatgtaaatcagggagagtaaactgcatatcctaagtaacagtagtcgtgataaattctaccaaggaacaaaaagaggagacttcaaaactgaccatattattatgatatatagatttccccttttcagcataattttatggctttcattctgcatttttttttttttgagacggagtctcgctctgttgcccaggctggagtgcagtggcgcgatctcggctcactgcaagctccacctcccaggttcatgccattcttctgcctcagcctcctgagtagctgggactacaggcgcccgccaccacgcccggctaattttttgtatttttagtagagacggggtttcattgtgttagccaggatggtctcaatctcctgacctcgtgatccacccgcctcagcctcccaagtgctgggattacaggcatgagccaccgcgcccggcctcattccgcatttcttacttctctagctacagaactggggaaagggggaagaagaaaacatgtttaaatttagaggcaaaaaataatatacatggagatttctatttgatggaaaatttgtaaatgttgactgatctctaggtctcttcaaattttcataatatatgatttgatttgtctacatgctgaagatgatgagagacataaagaagtattccaatctaattttaaaagagagagtaagagaaagttcacacaacactgaggactaccttaccgcttagacatatcccagactcgaatactcttgtcctcagaattgctgaggatcaactcttggcgagggtggaagacggcacaagatacattgttgtaatggccccggcaggtatcaacctcccatgcctttgattctgaaggacaaaaagaattaggtcatcacaattccctactactataactttaggatttggagatatgacatcctcttcatcaagaactaagtactattacagaatgctaaattgccaacttctttctaatatggcaatcttcttcatttaagtctcttaatctttacatgtcttggttctttcattctgaccctcttattgattataaaacctcttctcttggccagacatggtggctcacacctgtaatcccagaactttgggaggctaaggtagggggatcacttgagcctaggagttcgagatcagcctgggcaacatggtaaaaaaccccatctctacaaaaaatacaaaaattaactgggtgttgtggcgcacgtttgtagtcccagctactcaggaggctgagggggaggatcgcccaagcccaaaaggtcaagacggcagtgagccgtgaatgcaccaccaaactccaggctgggcaacagagcaagaccctgtctcaaaaaaacaaacacctctttttcatcattctccatccctttatcctgttttatctgtcctgataacaactgtcctagttggcctttcaatttttgttattttttctttttttcagggacctgccactttaggagttgccattttagaacaaatatgagctccttcagacaggggccttatctgttttagtcaccgctgtatctccagagccttaaacaaagtctagtacaaaggaggtactcaataaatatttgtcaaatgaatggatgaattctatgttcatactcctcaaaataagggtaccaccacaggaaaaaagggaaagaaggaatactttcagtttcaaaacagtggtatagaagcaagctggcttcactcccctccacagaaaacccaaaacaaatatacagtgctgagattttcatcagcaacaacccagaactcaaatatgacaatgagacagttcctggggccacagagagatgaaaaaactctgagcagatggtaagagcatctgatttccacatctgcaatggccctcccccaactcatggtttctacactggaaaaagtgagactgaggaggtcaactaccttccccatcttcctgggtgccctggcaggagatctaaccttgacttaacccatgggaagcatcacgactgcctgaaaggggaaatatccctgaggacaggcagagagaaagcggggaggcaagactatcacacccagccccagaaactctgctctgttacttggccaaaggagatgccaaatcagagtggctgctcagcagcactgcattgcaggaagtatattccacaggtctgcccatacacgaacctctagccagccttgacacacagctgggataatccctttgggacctccccattcaggacagacaatgctctggtcatttactaaagccaaggtgaacccggacttaaggtgtcacctaaagccaaagaggaggaagtgacctagcagtacagatttgctaagcaaatatatccaataaaaaccaaagcaagccaaacagagaaaactggaataagtaactaatctttcaatacaaagacataggtgtatacccaaaataaacaatagcaaacagggaaccataacctccccacaaggacaaagcaaaaatacaatgactgaccctaaaatgacagcaatttgtgatctctgaccaagaattaaaactggtagtttaaaggaaaccctgttatcgccaagagatggctgaaaaacaattaagaaatttaccagagaagtttaacaaagagattgaaacaatgaaaacaaatcaaacagaaatcttgaaacagaaacacatttgctgaaatgaagagctcattagagactctgaatagcagactggaccaagtggaggaaaaaaatcagtgagctcgaagactggctgtttgaaaaatacacagtcaggctgggcatggtggctcacacctataatcccagcactttgggaggccgaggtgggtggatcacaaggtcaggagttcgagaccagcctggccgacatagtgaaaccctgtttctactaaaaataccaaaattagccagacctggtggtggatgcctgtaataccagctacttgggaggctgaggcaggagaatcacttgaacccgggaggtggaggttgcagtgagctgagattgtaccattgcactccagcctgggtgacagagcaagaccctgtcttgaaaaaaaaagaagtcagaggaaaaaataaaaagaatgaaaaggaacaaagactacctacaagactacaagatacagaaaattgcctcaaaagaccaaatttaagaacaattggctggcgtggtggctcatgcctgtaatcatagcactttgggaggctgaggtgggcggatcatctaaggtcaggagtttgcaaccaccctaaccaacatggagaaaccctgtctctactaaaaatacaaaattagccgggtgtggtggtgcatgcctataatcccagctactcgggaggctgagggaggagaatcacttgaactcgggaggcggaggtcatggtgagctgagatcgcaccattgcactccagcctggccaacaagagcaaaattctgtctcaaaaaaaaaaaaaaagaatgattggttttcaagagggagctaagcaagagcaagcgtagaaagcttattcaaagaaataattacagaaaattttccaaaacttgaggaagaaatatccaggtacaggaaggcctgagaacaccaaacaggtccaacccaagtaagactaccctaaggcatataaaagtcaaactctcaaaagtcaaggacaaagaaaggatcctaaaatacacaacagaaaagaagcaaagaacacacaaaggagctccaatttgtctggcaatagatgtttcaatgcaaaccatacaggccaagagagagaggaatgacattttccaagtgctcaaagaaaaaacctgacatctaagaatactgtacccagcaagattattttattttccaaatatgaaggatagtatttcccatacaaacaaaaggtgagaatttaccaccaccagatccatcttacagtaagtgttaaaagtagttcttcgatctgaaagaaaaaaacactaatgtggtagcggaagttactgcagctgcggtgttgtgctgtggggaagggagaaggatttgtaaaccccggagtgaggttctgcttacccgaggccgctgctgtgcggagacccccgggtgaagccactgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggcgttccaatgaattcattcaggtttctctttgagggtcagagaattgctgataatcatactccaaaagaactgggaatggaggaagaagatgtgattgaagtttatcaggaacaaatggggggtcattcaacagtttagatattctttttattttttttcttttccctcaatcctttctcatttttaaaaatagttcttttgtaatgtggtgttaaaaacggaattgaaaactggcaccccatctctttgaaacatctggtaatctgaattctagtgctcattattcattattgtttattttcattgtgctgatttttggtgatcaagcctcagtccccttcatattaccctctcctttttaaaaattacgtgtgcacagagagcccacctttttcaggacattgcattttcaggcttgtggtgataaataagattgaccaatgcaagcgttcataataacttgcgaattggccctgatgttctagcatgtgattacttcactcctggactgtgactttcagtgggagatggaagtgtttcagagaactgaaactgtggaaaaatgacctttccttaacttcaagctactcttaaatttgagggtctggaccaaaagaagaggaatatcgggttgaagtcaagataactgataaggagagagtaatgactaactccaaagatggcttcattgaagaaaaggcattttaagattttttaaaaatcttgtcagaagatcccagaaaagttctaattttcattagcaattaataaagctatacatgcagaaatgaatacaacagaacactgctctttttgattttatttgtactttttggcctgggatatgggttttaaatggacattgtctgtaccagcttcattaaaataaacaatatttgtaaaaaaaaaaaaaaaaaaaaaaacaaaaaaaaaaaaaaaacactaatgtgcaaaaagaaaacttttcaagatataaaacccaagatgtaaaattaagttcatagacaaacccagaagactatattactataatggtggtacacaatccacttataactttactatgaagcccaaaagacaaatatatcaaaagcaataatagctatagcaacatgttaaagagatagtcaaaaaggcaggaacagaaatggagttaaatgtataatttctgagtgtgttttagcctttgtttttgttcttgtgtttgtgatataaaataagctgtcatctctttaaaataccttattctatctataagatttttttttgtgaatctcatggtaattacagcacaaaaactattaatatatactcactaaaaataaaaagcatcaaattaagacatattaccaaagaaaatcacttaaccacaaaagaagacagtaagaaaaggaagagagaagcctcaaaaaaaaacaaaacaaaaccagaaaacaagcaaaaaacagcagtaataagtccttgcttatcaataatatcactgaatgtaaatgctctcaattcttcaattaaaaggcatagagtggctaaacggataaagagagaagacctaactatatgctgccctcaagaaacccatttacctatacagacacacatagactgaaaacgaaggagtgggagatattccatgaaactggaaaccagaaaagagcaggcgtagctatacttacatgagataaaacagactaccaaacctaagattgtaaaaagagacaaagaaggtcactatataatgataaaggggtcaattcagcaagaggaaataacaattataagtatctgtgcacccaacaccaaagctcccaagtatataaagcaaacactaatagatccaaaaggagaggtagactacaatatgataatagtaggagagctaataccccactctcaaaaacagacagatcatccatacagtaaatcaacaaagaaacagtggagttaaactacatactagatctaataggcctaactgcaatttacagaacatttcacccaacggctacagaatattcttttcatcagcacatggaacactctccagaataaactatactttaggccacaaaacaagcttgaaaaaattgtaaaaaatagaaattatattaagtatcttttctgaacacaatagaactagaaatcaataacaagaggaacctcagaaaatacaaacacatgtaagttaaacaacatgttcctgaaagactaatggatcaatgaagaaattaagaaggaaatttaaaaattgcttgaaacgaatgaaaatggcaatacaatgtaacaaaatttatgggatatgacaaaagcagtactaagaatgaagtttataacataaacacctatgtcaaaaaaaaaaaaaaaaaaaggaaagactccaaatgaacaatctaatgatacacctcaaggacctagataataaaaaacaagccaaaccctaaattagtagaagaaaacaaacaataaagatcagagcagaaataaaattgagactaaaaaaaatacagactatcaatgaaacgaaacacttgctttttgaaaagatagtatcaacaaactgttagctagaccaactaaggaaaaaggagagaagatccaaataaataaaatcagaaatgagaaaggaaacataacaactgagacctcagaaatacaaagaatcattagaaactattacgagaatgacatgccaacatactagaaaacttacaagaaatggatatattcctagacacatacaacctacaaagattgaaccacgaggccagggatggtggcccacgtctgtaatcccagcactttgggaggtggagacaggtggatcacttgaggtcaggagttcaagaccagcctggacaacatggcaaaaccctgtctctactaaaaacataaaaattagctgggtatggtggcacagcctgtagtcccagctacttgggaggctgaggcaggagaattgtttgaacccaggaggtggaggctgcagtgagctaagattgccctgctgcactccagcctaggcaacacagcgagactccaactcaaaaaaaaaaaaaaaaaaaaaaaagattgaaccacgataaaatagaaaaacttctaaaaaccagtgcctagatcaaagccttaataaaaattctcccatcaaagaaaagcccaggacctgactgctttactgctgaattctaccaaacatttaaagaattaatgccaatcctattcaaactcttaaaaaaaaaaaaaaaaaaaaaaaaggaagaggagggaatattttcaaactcattctatgaggccagcattactctgataacaaaaccaggcaaggacaccacaaaaagagaaaactacaggccgatatcactgatgaacatagatgcaaaaatcctcaacaaaatattagcaaaccaaattcaatagtatactgataagatcatttactaagatcaagtgggattcatttcagggatgcaagaatggttcaatatacatcaataaacatgatatatcacattaacaaaatcaaaaataaaaaccatatgatagttaagcagatgctgaaaaaacattggataaaattcaacatccctttataacaaaagttattatcaacatgggtagagaaagagcatacctcaaaacaataaaggccatatatgataaacttacaactaatattacacttaatgggaaaaaattgaaggccttttctctacggaccagaaggcaaggatgcccacttttaccacttttattcgacaaaacactagaagtcctggccaggtcaagtaggtatgagaaacaaataaaggacaaacaaattggaaaaattacccttgttcacagatgacattatcatatacttagaaaaacctaagactcaaccaaaatgataaattcagtccagctgcgggatacaaaatcaacatacaaaaatcagtagcatgaccaggtgcagtggctcatgcctataaacccagcactttgggaggccaaggtgggcagatcacttgaggtcaagagttcgagaccagcttggccaacatggtgaaacctcgtctctaaaaaaagtacaaaaattagccaggtgtggtggtgtgcacctgtagtcccagctactcgagacgctgaagtatgagaatcacttgaacctgggagggggaggtttcagtaagccaagatcgagccactgtactccagcctgggcaatagagcgagatcctgtctcaaaatatcagtagcatttatatatgccaatagtgaataatctgaaaaaaaatcaagaaatcccatttatagtaactacaaaaaatataaaatgcccaggaatcactctaaccaaagaagtgaaagggccatacaaggaaaactataaaactctgatgaaaaaagttgaagaggacccccaaaaatggaaagatagtccatgcttgtgggttgaaagaatattgtaaaaatgatagggtaaattactacctaaagtaatttacagatttattgtattccccatcaaaatatcaaagacattcttcacagaaacagaaaaaaaatcctaaaatttatatggcagcacaaaagaccccaaatagccaaagcaattctgagcaaaaagaacaaagatggaggcatcacactacctgacttcaaaatttgctacaaagctagagtaaccaaaacactgtggtactggcacagaaacagacacataaaccaatggaacagaacagaggacccagatataaatccacaaatctatagctaactcatgtttaacaaaggtgccaagaacatacaataaagtgttgggaaaactgggtaactatatgcagaagaatgaaactcctatctctcaccacacacaaaaatcaaatcaaaaaaggattaaagacttaaatctaagaccagaaactatgaaactactagaagaaaacattggggaaatgtcccaggacattgtctgggcaaaatgctcatcaataattatcagagaaatgcaaatcaatgtgtccttaacacagaggctgaaatatatatacatatatatagaaaaaaagacatgcgaatcaaatccacaatgagatatcatttcaccacaggtaaaatggcttgtatcaaaaagacaggcaataacagatgctggcaagggtatggagaaaggggaaccctcctgcactgttggtgggaatgtaaattagtatagtcacaatggagaatagtatggaggttcctcaaaaaactaaaaatagaactaacatattatccagcaattccactactggctatatatccaaataaaggaaataaatatatcaaagcggtatctgcatccccatgtttgtttattgcagcactatttacaatagccaaaatacggaatcaacttaagtgctcatcaagggatgaataaagaaaattacatacgcgcacgtgcacacacacacacacacacacacacacaatggaatattattcagctataaaaaagaatgaaatcctgttatttgcagcaaaatggatggaactggaggccattatgttaagggaagaacaaagagacaaatatggcatgttctcactcacatgtggaagctaaaaagtggatattattaagatcgagagtagaatgggaaggagggtgaaggaggaaatggaggaaaacagaatataaatatatttattaccacttaactgtacacataaaaattgtaaagatgatatattttatttgtaaaataatttctatgctcctgggattagcattaattaatcacctaaggtagaaaaataggtcagagtccagaagacctggctactttaccttgctggctggcagtttcttagatatggcgataatgtaaccggttcactcaccattcatgcgccagatcttcacttgacgatcatctgccccagatacaataaggggcatagtggggtggaaggcagcccagtttactccacgatcgtgaccctgtagaaaagagtggttcttctaaaacatctttatagtcattactcaaagcaaaccaatgaatcaagctactcgttgtaaaaaatgtctctgatttattcttcatgtgaacagattcaagagactacgctgctctaaaattttgagcatcagaattaccatgtctgtcctccaatattaccccaaattctcatgtgaatttccaaatacatatttctaacccctaaactcagcctcatttgcatttaggatattctgctttgttttttacttgcctatttttatcttatttctacaaataattattaatatctccagacaaattttattttttattttttattgtttttagacggagtctcgctctgtcacccaggctggagtgcagtggcacgatctcagctcactgcaacctctgcctcccgggttcaagtaattctctgcctcagcctcccaagtagctgggattacaggcacccaccaccatacccggctaatttttttgtatttttagtagagatggggtttcaccatcttggccaggctggtcttgaactcccggcctcatgattcacttgcctcggcctcccacagtgctgggattacaggcgtgagccactgcgcccgcccgaaaacttttataacttaatgcagaaatctcagtctggtcttgaaggagctccaagattattttaagaagtttgcaaggtaaaaactattttcataatattactaagactttgtcttcttcattctttttttttttttttttttttttaagatgaggtcttgctgtgtcatccaggctggagtgtagtggtgcaatcatattaattgctccctgaagtctcaaacttccaggatcaagtgattctcctacctcggcctcccaaaggactacaagtgagcaccaccacgcccagctaattttttttttttttttttttggtagagacaaggtcttgctatgttgcctaggctggtttcaaactcctggcctcaagtaatcctctggcctcggtctcccaaagtgctgagattacaggtgtgacccactgcacccagcctatttatcttcttcattcttattctttcgtaagtatacaatagagtttcccagcacatgatatgtgatatcatcgctctgacagctaatagaatgtgtgctgatatatttcatgtttttaaaagttgttttaatctaaaatgtggtaaaaaattgacagatataacccacataaacaaaaactctttggggtcctcaataaattttaagagtataaagagatcttcagaccaaaaagtttaagaactgctgattttaagatactgtataccctatttatacagttatatggtatattgtgacagaatcctggataaggcagttttgaattagcagtattattgagatgtatcatgatgcagcgaaaagcacctgggttttggagtcagatcgaaattcaaatcttatttcttacatttatttactagatatatgtagattttggtagaccacttaatttctctaaatctcttttttttttttgtctgctaaatagggataataatatctacttcagtgggtagctatgaagattagataattttttagaacaaaaactagtttctttcccttatgcttttctgttttcccacctgcacaaaagttacacatggctggttctcgataactccgattaaatttcctgctgccctgccttacagaaagcttgagaatgggctctgctttgggatggtgatgaggtctacgcctggctttctccctttcccactgggtttataaggtaataagactctccctcaggtggcacataagcttcatttctctgttggttcacgcacaatttgatttctagtacctcaaacagtgcctggcacttaataagcactctgtaaatatttgttgaaggaatgaataaatgaacaacatactgtgactttcccaagatgacagcccatattcagcccctggctataaagataagtacctctagtacatgcttcaccactgcatctgtagttccaaatagatcaaccccagttattcctctcacatccgattccaccgcaccaggggacaggttttttttcctcagacctttgaagggataaggagtgggatgaaagatgtaaacataatattatctaaaacagcacagtatcagaaacacagaaattacagtgaaaaagaaaagaaaaagaaatggaaaagactgaagaaagaaaagagactcaagaattcctatttctaaaaatgttcaaaatattgaagtacattcaccgtcttctcttctgctcccttaacacttaaacagatccattactggaatttctttctagaggagggtaacccaaatttctggcacactttaacctcttcttccacaaatcttacctcaagaggtgtctgcttcagttaatgcccactttccattcttcagtgttcttgaaatgtggccccaaatggtaaacattcaatttctactctcaacttcataaaatttatagcagcttttccccgatcatttcagaaatttttttcttttttttaaagaatagtcaagtgcagtagtgagaatggggaaaagagtggaacaaggagttcaatctgtaactgactgtgaacaatcaactgagataactcactatcttcggactaggctcaagaaattttaaaggaaagccatttgaggttggcgtggtggttcacgcctataatcctagcactttgggaggctaaggcaggtggatcgcttgagcccaagagttaaagatcagcctgagcaacatggcaaaaccccgtctctccaaaaaatataaaaattagctaggtgcagtggcgcgagcctgtagtcccagctacttgggaggctgagagatagggggatggcttgagcccaggaagtcgaggctgcagtgagccatgatggcgccactgcactccagcctgggtgacattgagaccctatctcaaaaaagaaaagccatttgaagaagccacagtgcagtgtttctcaacttgaagcctttcgacagctgatgggggaagttccaaatgggttacagaaactaggcctattaagtacaaaacagctgtttggtagaagataacgtaaaaccataagccatgtaaaaagtgtactcatgcctactacttgactcttggacgaagaacaagataattaaaactgtcatgtcattttaagttcctgcttaaaaggctgattatagatttgaatacttggattttgccattaaaacctttggaggctagttttactgggaggaattatcctgtaacttaaaaacgatggaaaaagacaccagaataataatagtcttatttgtagaggacccacatatatggctcaagtaaatctatctttaaaagctatttgtgctatagtcagaaccaaaattatgatagcactgctactatctcacattcggaaagtactttgtggttttcagagagtatgttatgtaactggactctgataacaaacctttggaatgaacaagcaggtaaaattataacagtttgtagatgagaaaaaaagaattgagactaaaatcctatattttgaagtattttgggggaatagtggaagatgaaattacctagcacttgtaaatattttttaaaaagacagttatgtgtaatggaaaataaaaactctcattgaaaataaaacctaaaggctgggcgcagtggctcacgcctgtaatcctagcactttgggaggctgagacaggtgaaccaccgcaggtcaggagtttgaggtctgcctggctaacatggcaaaaccccgtctctactaaacatacaaaaattagtcgggcatgacggcgcatgcctgtaatcccagctgctagggaggctgaggcaggggaattgcttgaacccggggggcggggctggggggggcgcagcgcggaggttgcagtgagccaagattgcaccactttactccagcctgggcgaaagaacgaaactccgtctcaaattaaaaaaaaaggaggctgggcacggtggctcacacctgtaatcccagcactttgggaggccaaggcaggtggaacaactgaggtcaggagtttgagaccagcctggctcaaatggtgaaaccctgtctctactaaaaatacaaaaattagctgggtgtggtggtgcatgcctgtaatcccagctacctgggaggctgaggcaggagaatcacttgaacccgggagacggaggctgcgatgagctgagatcccgccactgcactccagcctgggcaacagagtgaaactccgtctcaaaaaaaggaaagaaaacctaagtcattttaagcctaaactttgccatctgtaggaaaatataagaacttaagtttaataactgcatttatatttattgttttaaaattataatatatctcttctgttatggtggcacctacatgttaacactggagaagcaagagcttagaaggccacaacaattttaattatcttgtcctctgtccaagatgagcatttagccagtaggtagagagaaataaagctgatgttttacaatatactctcccaaaggctcataaatactttatcgctgggatgcctcctttcacttatttcacttgtccctttaataagatctgtcaactttttctaacgagtctggtatatgaaacagattcaaaggaaaatacaaagatagacagctgtgagaaacttcacctccaataagcttcaacaaacacattaaaaggaaagccgtatgacagaatggaaggctttgttgcatttgcgtgtaatgatccgggaaaaggggaagggcaaaaacagacagatgaatggtgacaggcagtgaaaagatactcagagaagaaatatttgagccttcaacaagccgctcgctaggactgaacgacagatggaaaatttctacagcagctacccaaatccagagggaggagaggacactctcagaatggaccagtttgatgcacacctcccaatacggaccagggaaagcaggaaaaagagagggatgataacaggatttggcagcaaattaatacttttttagtagccttttcagagactgagcctgaattacatgggcttgacatgcaaaggtataagcatattaaaataatttaactgtcagtttacttagaagctcaagttaagaaagtaaccttttatatgtaggtttgtaaatacattcccttttaaacaaatagtttttgccagggtaacacaaaagattcaggttaagctaagccctgtggggttcaatccctatgggagaggtaccaagagataggttttcctttaaagatctctatattctcttactgcttaactaactcagagagtgtccctttcaaaaaaaaatagtcaaaaaaattagaactagtcctctaaatttgggagtattcatactctcattcagaactaacttctccctttcagaaatataagcactggtctttaacagatcggaaagctaattcctcttcctgttttcagacttatttgaacccaatagcaaaaaagaaccctgctgaaaaagaatatgctgatttctagagaaggaaagtataaaagtctaacccaaaagcttcttgcactttgttaaataccaaagcatctccttccactctggttaaggggttactggaagtcaagagttgtgggtaaagaacaacacttagaaatggtaaaaagagcattaacattagtacagcaagctagcacaaaattcttactatcacataaataaagtatagcaattgcaaggttattacatagtaatccatgcacttcacacattcaagagcaagtataaaccccatggggtcacactccctctcttctctgatctagggcccttaattttgatgtaaaaatgttctctgtctgcaaaaggtaaagaaaagtatttcatgccttgagcatttcatgaccaccaagaatccaaccacctgactgcccccaaactgcattggctagactgcagggaacatgcaaggctggcatcaggtggcacaaacattacttttacagtggagcccttctcaacccggcgttctggaaaagaattaagttttaatgcccgaaaggcatcagtttaggtatgtaacaaattctctatgaactagaatagcattagctatataccattcttagaagaactacgaaaacagccactgaaagtactttctatagcacttaattctctcacagaatccaggttgacaaaggatattctgaataattgccggccaggggcagtggctcgtgcttgtaatcccagcactttgggaggctgaggcagctggatcacttgaggtcaggagttcgagactagcctggccaaaatagtgaaaccctgtctctactaaaaacacacaaaaattagctgggcatggtggcatgcccttgtagtcccagctacttggaagactgaggcaggataattgcttgaacccaggaggtggaggttgtagtgagctgagatcatgccactgcactccagcctgggtaacagtgagactctgtccccaccgccaccccccccaaaaaaaaattgcccctgatcagctggaatagcatgaattgggatccaagcccatcaggctcctatatcctgagacagagagagtgctttgaatgtgtgcacagtgaaaaaccatggaaagccatagcaaggttactgggagagtagatgctaagctccctggtactggcagtgaggagaggacacaggttcacagtgcctgtgtctagctcctcctgttggcatggctggtcacatctgggtgtacttcaaaaaaccttgtcagtctgatgaaaaactgcaatggcaaagccctagggaaagagaatacaactgccctatctccaatacctcttgtttatactcctccctttcattctatgcctttgaaaactacaaagacagcattatctagaggttctactctacaattgtccccatctcctcttgtcttgtttctatgctacattaacctaaactgctattgcagtattccaaatgctgtatctcagaatccaaattttcagcttgctgttcattaatggtctataagaacaagtgccattattgccccagtcccccatgccacaatggagttgggaatagttatcacctcagctgtacaatgcagaggatgactcctttattacaaagaaccaaacaaagatctatgaggggggccttcctttcatagaatgaaacatgttttgtagtccagtcactgacatttcaaagaactcaaatctccaagaatttctaaggaaatgaatacaaagaaacaacaggctgggcatggtggctcgcgcctataatctcagcactctgggaggcaaaggtgggtggatcacctgagatcaggagctcgagaccagcctggccaacatggtgaaaccctgtctctactaaaaatacaaaaattagctgggcatggtggcacatggcaaaaataaataaataaaagttaaaaaaaaagaaagaaagaaacaacaaatactaactggtcagagaactacagcatttagtgtttgatttccctattccaacatgaagcgcttccataggtctcacaggtacagtccattctctacatttaaattctctaggtagcactttcttagatctcctctatataagactaaacatttaaatccttgtctcaaaataaagatatgtaaactgtaaaaggaggaattatcccaactatccataatctataaattatttaatttctagtcctaaatctgtccattaaaaggtattctgggctaggcacaggggctcatgtctgtaatcccagcactttgggaggctgaggcaggagaatcacctgaggtcaggagttcgagaccagcctggctaacatggtgaaaccctgtctctactaaaaatacaaaaattagctgtgcgtggtggcgtgcacctgtaatctcagttacttatgaggcacaagaaacgcttgaatccgggaggcagaggttgtagcgagccgagattgcgccactgcatttcagcatgggtgagacagagtgagactccatctcaaaaaaaaaaaaaaaaacaggccagccacggtggctcacacctgtagtcccagtactttgggaggccgaggcaggcagatcacaaggtcaggagtttgagaccagcctggccaatatggtgaaaccccatctctaattaagatacaaaaattagccaggtgtggtcacatgcatctgtagtcccagctactcaggaggctgagggagaattgcttgaacccgggaggtggaggttgcagtgagccaagatcatcacaccactgcgctccagcctgggcaacaaagcaagactccctctcagaaaaaaaaaaaaggtattctggacataaaagtcaccaactcctagaacccaaccatgctccccgcactagaagaaacgtaatagagagattttactatttttaaataaagcgatagggtccaagagtcttgtttccctgtattaatctattctcaaaatttctttttgtcatagatgtattttttcttatttgagtggaaagcatgattcttaatcaaatgttgcaacagtaaatagattttaacaaaagctgatgtaactagaaagttaaaatttcttcaaatcaaatgaattttctagagttacctcttttcttagagaagacttccaatatgaagaaccatcaaagcaaattcaacaacctcagaaacaaagatgctattataaaacagaatattctaaattttccagttctaagtcaactctcctcactattttaagcaattgcagttttgcaccagagatgaccaggttgtcctctgaacttgggcagctcaccagaaatatcccaaacgcgcacagtctggtccaggctggctgatactaccaagtcttctgtggggtggaactgagcacacatcacataatggttgtgccctgttaacacactgcaagaaaaaaaaaagacaataccaaattagaggtggaagtcaacagactcctaaactaaatacctttctccatattcaataaatgcttatccagttttacttttatggagacaaaggcaggtcatcctaccaattctgaactaataataataagcccagtcagctattttaacaatagttctcttcttgcctctaatgctttagtatttaaatattactaatttcaggaggactaagattacatagctcttctctcaaaaatattttaaaatatcaaaataaatgtaatctcagtaatccatactgtaaattatctgtgagattttagtagggtatcccttttaaaggccatcactttattttttattgttattatttttttgagatggaatttcactctgttgcccaggctggagtgcagtggcgcaatcttggctcactgcaacctctgcctccccagttcaagcgattctccgcctcagcctcccgagtagctgggactataggcacacgccaccgcgtccagcttatttttgtatttttagtagagacggggtttcaccatcttggccaggctggtctcgaacttctaacctcaggtgatttgcctgccttggcctcccaaagtgctgggattacaggcatgagccatggcgccgggccaaggccatcactttaaatggtccctaactcttcatggaaagttctatgtaaagctccagctccaaacacaaaataagacaaaggtctagaccttgactcaggttttatgggaaaataattgaaaaccagctaaaagttcttgttctaaaaggctatatgacttctcttcctggtaagaaattattggaagtccagattcatatatgggattgcctctacatttattattttgcacttaaaagcatcctacaaatacaatcagtaattaatcagccgacatagtccatttgagaagggagaagattgttctaagagaagctcattatgaaaaactaggaaaaatgaagactcttttcgagccctctgcctcctgctttaccaaacacaggttctagattgccagttccacactcggatggtctgatcatcggaggcactcagaatccagggatattcctgaaagatattccagacaaaggctttaaacattaaacaaatctgttctatcaggttcttgtaatcatttttctctaaagaactgcattgcttaacggctcagctacattagcaaaggggctgctgcttttgctatcaggttagctgtctccttttctctaccactctaacagcttttctcaacttcggcactttcacctataagacttaagaatggaagccagttagaggcacaatacattctcagaggcagatagtgaaacatacatttacatttacttctatatgtgtgtgtgtgtgtgtgtgtatttatatacagttaatcatgtaaattaagatcctgtgaaagactcttctacctttaactctaggatgggaatattattttattgtctgacttctttctgtccagtttcaaaaaattcccaggtctcagcaagcaaagcagaaagtaacatgtaaagacaatttagcctttttggagtctataagattgttgagaaaaggaagtatttcttatttacacttccttcttactacacttgctaagctttgtgttaaacactgaaaatagatggtatttctattttcaatagagatagtatctctaccttcagtatttagcacaaagcttagcaagtataaggcacacacatatttagtgagctggtaaaatgaaagaaaataaggtctttcgtaactttccaggtagatggcaacttgttctaggcaagggtcttcaggaagtcctttatggcaatgacaaataattcctacttaataagttatcttattgagtggttatcattctcaaatgtttaagctgtaattttctcattctctcctatcctagaattttttaattaaaaaaagaaataatatatactcaaccagtaaattgtttatttcatcatattctttctaacttaattaaagagacttaatttactggcaatcaaagaatagtgtaagttaatgctaatacacagaactataaggagatcctgtcagggtgcaactggattcagaggttgggagtctgtaatctgcacctcactatctaaatctactatgttacctggcagatcaaagaaagtagtaagcctggctaagggaacagcctccaccagacccaaaaatcctaggatagaggggtatgattgttaatacttcgaaacgtttgttagctgatcaaaatggcatcttagtctgaccttcttccagacacacctactacttactaataataccctacatgggattagctggcaaacttttgttttttggttcagcaaatctgaaatcaaatccctacttttccctacagagaaacaatgacttcccatagaatccactgaatccaataaaattaaattcagtataatcccaagtgcttccttttgcagaaagaaaaaaagcagaaaggacaataccacacagattgtagaagagccactccaaaaacaactctattattaaaacatgggttctcaaggatcaaataaagattactatggggaaactaagaatgctccaaaactagcgccaccatgactacttacatgatgaaaaaacgtggtgcgaatataatctaagtgcccaagcaatgtgaaaagacagcgccgaagcttgtaattccaaacctgcaaagacaaatcaaactaagaaacagaaatagttattgagcctctaaaaggctcagagaaattgatatctttacagagatagaaatatgtatataaatatagatttatatacattatttgtattttggcatttctaaataggtaggaaccttggtagaaagccttgtttaagatttgaggggaaaagaacaagaatgaaaatataggtcagataaacaacatggggttggggtaggattagggaaaagctaaagataaaattattgaagtttttcaggctgggcgtggtcactcatgcctgtaatcccagcactttgggaggtcgaggcgggtggatcacaaggtcaggagatcgagaccatcctggctaacatagtgaaaccctgtctctactaaaaatacaaaaaattagccaggcgtggtggcatgtgcctgtagtcccagctactcgggaggctgaggcaggagaatcgcttgaactcaggatacaagaggttgcagtgagccgaaatcatgccattgtactccagcctgggtaacagagcgagactcagtctcaaaaaaaaaaaaaaaaaaaaaaagtttttctttctttgggaagaagccatctgcatttaatagcaggagatatttatccagggcttgatttgcaactcttttttctactgcaaaattgtgctcttggcttgaatatagaccccttaagtgctttacccatcacttttaaaaagtatgacaggctgggcacgatggctcatacctgtaatcccagcactttgggaggtcaaggcagggggatcacctgaggtcaggagtttgggaccggcctggccaacatggggaaaccctgtctctacaaaaatacaaaaaaaaattagccggatgtgatcccagctacttgggaggctgcggcagcaggatcacttgaacctgggaggcggcgtttgcagtgagttgagatcgctccactgcactccagcctgggcgacagagagaggctcggtctcaaaaaaaaaaaaaaaagtaggacagatagataccatgactccaagggaaacaataatatagggcatcagcttcttaggctcctaacttgatggcaaacaacgcccatacatgtgtggtctgtactcacctgtcaagcaaacagaccttaacttattacatggaaaatactacattgctcagtaagcctgagctaagcagagaaacaatatcatattcagatgtgaagttgagtcaactaccaaagtactaggcatcaatgaacacaactgaagacatgaaaaccaggatcataaatataaaatagcttatcttcctcattcagaaaatcccctaaaatgtacaaaaataagagaccagatgcatttttcttcttatttaatttttttaaatttctttttaatatttgtttataatcaatctgggccagcttgttactatttctaatttttaacttttcttcagtaaattataaaaatttcatttcctataacaagtccagacaatccaaaagtatgatcttccaaacaagaatgctgagttccttaaaggcagggttcttgtccatcatgctcaacactatacccttaccacctaacacagtgcctgacattaggtaagtgctcagtaagcattatgtatggaaataagaataacatgaaaagttaaggtattccaatacctttgcctctatctattcaatcagctacatataaatacacatgtacacagtagagtttcacataaaaattagaccataccataaacactattctttaactgacttttttccccttatagagttcagtgttttaaactttcatatttctagtttcaaaatgtcttgactcctttaatggcctaagtcaagctccaaaactgtaaatccttaaaaacttataggggttttagatgaatactctgaccatttgctgggctccttgtcttactctttgtcaacgaggattataactaatgctacatttatctggatatagcaagcaataagatggtccacagacatgacttttctagataatccccctttttatggaaaaatgttcaagtttattagtcatcagagaaattaattaaaaccaccgaatgggccgggtgcggtggctcacgcctgtaatcccagcactttgggaggccgaggcaggaagacgacccgaggtcgggagttcaagaccagcctgaccaacatggagaaaccccatctctactaaaaatacaaaattagccgggcttggtggcgcatgcctgtaattccagctactcgggaggctgaggcaggagaaccacttgaacccgggaggtggaggctgcagtgagccgagatcacgccactgcactccagcctgggcaacagaacaagactccatcgcaaaaaacaaacaaacaaacaaacaaacaaacaaaaaacaaaccaaaaaaacccaccaaatgatagcactacacacctaccagctaataaagaattcctttgttttaataacagctttattgagatacagttcaaataccatacaatttattcatataaagtataaaactcaatggcttttaatatattcacagttgtgcaaccatccattttagaacatttttattcactcccctaagaaattcatacccattagctgtcacttctcatttcctcccaacccctccaaccctagacaatcactaacctactttctgtctctatagatttacctattctggacatttcataagtggaagataatttcttttccaaaatattagtcattttgggaaaactttttcttaattaacacccagtttttcctttttaaacagattataagaatcccaagttaaccattcttgatactcaatgttcatcactataaataacaaatacaaaaatactataatgaggtgatatccttatgggcttttgagatctgtcaggtggtttgagttttgattgccccaggatgtggtgcctaaaaactagaaaacagaaagaaatgtccttcctataattctaatagctcttttctctgtaggcagctgtcactctttactcccatcacctaagttctgcggtataatcacaatatataacttcttgaagttgcttatgaaaagactttacctttttatgaattaaatttcactggttcggtttgacacatagacttaatgaaaacaactaaaggaagtaaacagaggaaattttgatttatttttataggttgctagtctctggctctaacttttgctattatgatagtcagttgtctttaaagaattgcctatattctgtctgcttcctcatttcacactaaggccttccaaattaagcaattcaaaggttatttctcaatcttgatcttattctgaacactttctccttcccaaaattctcttcttccttggcatccaagaggcttcttctccctcttggttcatctcgaacccctcgaatcactgtttcccatactaactctacttcctctctctcccttaaatgatggtctgtcttcttattcaacgtactccttgagcaatatcttctactgcttctcctttggctcctcccttcatgacgacaaatcacaaatatatttctagcacagacacctcaactagactgtcccttaggtccctcaaaatcaccagagacaagatggaattcattatccattctcttccactccagaaaactatctcctcctgattttcctttcctagttaatgacaccccctttacccagtgacctaaactagaagcctgaaagtcagctcatttatttctccttattggcccttatttctccttattggccatctcatttatttctccttattggccatcacccaacagacacactgattcatttccttaaattctcacatccatctccttctctccatttcaaatgctactacctaagctcaggtttcctaactggtatttttgcctcctgtcttgcccaaatcatccaatcttttctttaattaccaccaagtaatcattttaaaaacatataaatctggtatcactcctgtatttaagttcctcaaatggctcctagttatctgcatgataacatctaaactcctgagcgccacaaacaggtactccatgatctggcccctctcatcttctgccccttctctcaccatttctccaggttttctccatacaaaaccaataacagctgccctgtatctagctgtgtcatgctttttgtctttgcacctatactgctctttcctatttcactgtgaatatctctctattatattgcttaccaaactgtacatgctattacttggatatatgtttatcttctgtattagaataaaagctccttgaaaacagaagccatttcttatttatttttgaattccctaaaaagaaaacagtgtctggtacacagtaagcattcaataaatgtttgctgagtaagttctccggataatgttgtcaaaggcctgagctctgtatgaatgaaatttcctgtctttcagttcctttcatgattcccaaaccttcccacatcctctttcctttattctcagttatgacagaccctctgtaccttaatcttatagtcatctcctccagagacgaacagtggctgctgcttatggaagtcaatgcctcgcactggacctggtggagaaggcaggcaatgtatgttagacagagctatcctttctaatctctaaggtgattcctattcaggatttttcagttctatcatttccacattctttaatcatagaggaatccatgtcaaacaaggcttaaaataccccaggatattataaatacttatactcctttaacttcctcctagaaatatctcaccatcatgttcatcaaacttgtcaatgagagtgcacatccgatagtcccataactggatgaccccattatgtaaactagtcaggatccaaggtcttttggggtgaaagctgagccctgaaaaaaatagaaaatgatacaatgagctaactaagccccatgatgtcaccttctgtcaattctgataagaaaaagaaacatcaaggttaatcctaggttcattcattcgacatgcttgatgattttttactggatgccagacatcgtgaattttatgtttggtactagatttttgtcatattcctttacatattcttgggctttgctctaggatacaattaagttacttggaatcagttgatcctttcaaggcttgcttttaggttttattacagaggggctacagcagccttcattctaggcttaatctggaaccactattaaagcaatagccatctgaggtctctatttgaagccctgtaatattaggaagtctttcctttctggcaagtaggaacacaaactagtcccagttcactagtgtgaactctggggattgctctgccttctcctttccagtggtcctttttcaggttttgaatagttttctcacatgcagatcagtactcaaacaaagacctgagaagacatcctgcagatctctagtgctctctctctgcagccccctcttctccggtattttgcccaacaaaatctagccatctttgcttccccacactctaaatttatgtctcctcagaaagaccaagggattcccctcttcactgaagcctaaaaactctctaggcagtaatctacgacaatcacaggactcaccttgtttatttgccttctctggagaattattttcctgcactgcctgttgcccaacatctgtgagcaatgtatgaacctttgtttcatacattttgttcagttgtatagttaaggtgggaaggtaaatctggctcttgttattctatcatgactggaaatggaagtccccagaggtaacaactactaacagtttgaagtgtatcctttcagatttttaatgcagttacacatagacataggctttagtattttatgaaagtggggatcacgttatgatgttgttctgcaaacttcttcctcacttaactatataatatggatctcatggaagtacatataaacataacctcattctttttaactacaagggacaaatgtactacacttatattattctaacaggcattttgtccgccaatttttggctatcagaagagcctactgaagatacttctacacataatctagcctatttgcattattactgccctaggctaaagacctgtgagattgctcaggaatagaatatgtgcacttaacattttagtacatatagtttaaatgtaaaaacactgtatcaatatacagtctcatgaagtttatggaggtgcccattttgcacacaggctgctatcagctatttgttgttttgttttataaatctaagaccctccccccaaaaaagtaacttaactttttttttcttgcatttctttcattactagtgaggtggaactattttaattatttattgaacatttacaatttttcttctaaattgtctatttttccattaggttcttttttttaattatgatatataagtacactcaacaatggatgtttgccctcaaatattatgacatctttgtttttccttctgtactgcccagcaagaaattaggagcagaaaagaaaactgaaagattatgaagacccatttcacatttcacctatacaggtctcagaaattcttaatggtacccatctttcaaggtcaagtttcccaagagacttagaaactgctcagaatatattcacacattgataacaacctccagtttttgagctactgagtctacaccaggcgctgtaataaatacactccatatactttctcattttaatactctctataaaagacgattttacagatgaggaaatacagacttagagacattaagtaagtcatccaagtcacagcttgttagtggatgtctcaggattccaaggcaagcccatctgacttcaaagaccaagttcctaaccactttgttacgctgcatctcactaaatattctagatactattttttccaggtcttcggagaccttacttctctgactttcacattctaacgttctgaggctaatactgcgatctcagtatttgccctccacccccaacgacccacactcgagctctagagctgccgtacttagcaaataaaaatacgagatttccagataaatttgaacttctggtaagcaacgacagactaaaaaactattcattgtttacctgaaattcaaatttaactgggtatcctgcattttatctggcaactctatcaagttgagactttattggggttataagcctcaagtactatttccgggtagtaaataaagccgaatggaggcactgatgttgagatgctgcagccaaggcctccttaagtgaggttgccactactcgtctccaaaaaggctactgactcgggtgcgagtaacagagatcgagactcagttcccagggccactccatataacacagtcatcaaaaagccaacagatcacagggcctttggagcagaacaacacaaatcgggagcacagccaagagagaaagggggaagaaagaatagggagggggtctaaggaatcccctgcagtgtgggagccactttataggtaaatcgaagcccaaggacacaccaaagaagaggggactggagaaccgctagccaggcccaacctctctcccaccctccgtcttcctccgggtccgtctggtgggcccatttcgaccaacacctctacccattttctcttccccggtgtcagcgccgctcctgacatccaacctccatgttcccccttttattctccactacctttgacccgcgcgctcttggtctcgaatttggttaacatctctcaggtctccgactccgatgtcttaatccgagccccgacacaccctgctgcccttcggacgcctccacgtcagcgaccctctcccgcggtttccggaagcgcctggaaacacgaacttccggtctcttaggctccgggccacagagacggtgtcagtggtagcctagagaggccgctaacagacaggagccgaacgggggcttccgctcagcagagaggcaagatggctacggcagggggtggctctggggctgacccgggaagtcggggtctccttcgccttctgtctttctgcgtcctactagcaggtgaggcctccccgcccgtgagctccgttctctaaggggaactctcggatcggccccgccgcgaccgccactgtctcccttct

SEQ ID NO: 2451 - DNA, 54978 bp, Homo sapiens; identical to SEQ ID NO: 2450
  source 1..54978: mol_type = genomic DNA

SEQ ID NO: 2452 - DNA, 41136 bp, Homo sapiens
  source 1..41136: mol_type = genomic DNA
ctctgaagggagctactcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 2453 - DNA, 27258 bp, Homo sapiens
  source 1..27258: mol_type = genomic DNA
ctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcatgcctgtcatcccagcactttgggaggttgaggcatgtggatcatctgaggtcagaggttcgagaccagcctggccaacgtggtgaaaccccatctctgctaaaaatacaaaaaattagctgggtgtggtggtgtacgcctgaaatcccagtgactcgggaggctggggcagtagaacggcttgaacccagggggcggaggttgcagtgagccgagatcgcaccactgcactccagcctgggtgacagagcgagactccatctcaaaagaaaaaagaaggtagagaggagaggcagaaatagagacaagagacagaggcagagaaagatggagggagagagatggaggagagagagaggaatgtagaagagaatgaggagacacaaaagagagggaaacaggcagacagactgacagaaacaaaggcagacacacagacagagaaacagagagagggagggagaaaagggagaaggaaagagagagacacgagacacagatggagaaacagagacagataaacaacaaacataaagacccaggcgggggccggtcgcggtgactcacatctgtcatcccagcactttgggaggccgaggcgggtggatcacttgaggtcgggagttcgagaccagcctgaccaacctgaagaaacctcgtctctactaaaattgcaaaaattagccaggtgtggtggcgcacacctgtaatcccacctactctggaggctgaggcaggagaatcacttgaacccaggaggcggaggctgcagtgagccgagatcgcaccattgcactctaacctgggcaacagagcaaaactctctatcaaaaacaaaacaaaacaaaaaaatcatccccagcagggagaggagagagacagagaggaacagaggcacagagaggggagagagacaaagacagagagacacagagaaagacacagaaaaagagagagagagggagaaggagacatagagacagggacaaagagaaaaagacggacagagagagaaacagagagacataggtggacacagagaggggagagagagagagagacagaaagagacagagagcaagggatgggagtggaagagagagacagatggaggaaaaagacagagagggaggcagataaaagacacacagagacaccgagagagacagggaagacagaggagtcggacttagtctcagcgagagcccagagagggtgaacaagggcgaggaaccatgtgacctgcaccctgagaccccattggcgctcctctcccacccacctctctccggctcagggactgcgtcttatgttgcagtaggctggcaggctggaaagtcaggccagggctgatgctgcatcccagaggcagaactgtcctgcattctcagagtgggagatgaaatttttaaaaaggaaataaaactcttgtcggggaacctcagcttttatcctttagacgtttgactgattagaccaggcccactcttctcctttacactttcggctgattgaatgaggcccacccttccccctttacaccttcgactgattagatgaggcccaccattcccctttagaccttcgactgatcagatgaagcccacccttcccctttagaccttcagcttattagataaggcccacccttaccctttagactttcaactgattaaatgaggcccactctccccgtttagacctttgactgattagatgaagcccacgcttctcctttggaccttcaactgattagatgaggcccacccttcccccttcagcctttcgactgattagatgaggcccaccctcccctttataccttcgactgattagatgaggcccaccctcccctttataccttcgactgattagatgaggcccaccctcccctttataccttcgactgattagatgaggcccgtccttcccccatttagatcttcaactgattagatgaggcccacctttccctttttagacctttgactgattagatgaggcctacccttctccctttagacctttgactgattagatgaggcctacccttctccctttagacctttgactgattagatgagacccacccttcccatttagaccttcaactcattagatgaagcccacccttccccccttcccctttagaccttcagcttattaattagacaaggcccaccccctttagaccttcaactgattagatgaggcccacccctcttcagaccttcaactgattagatgaggcccaccccctttagacctttgactgattagataaggcccacccacattctccagtccaatctcttttcctggaaatcagctgattgtggacttgacatctacaaagccccttcgtagcagccgctgagtcatggtttcattcaataactggggactgtagcctagtcacggggacacgtcattggtgccgggtatcagagacgaaggccaagagatgaaagagaaacagagactgaacccaaaagaggcagacacacaggaagatggagatagagacccagagatgggggtggaagaaggtgagagggggaggaaagagagacagagagggagacagagaaaagaggcagagagaccgagagagaggctgaacagcaagaccccagagagggtgactaagggtgagagacttgcgtgacccacatcccaagaccccgtgggtggccctctcccacccacctctctccagctcaggggctgtgtcttcctcccatggggaactccagttgcagcccagggttgcccccagcgccctcttctctgccacataggtaacatcctcctggttgccacttgcacacccccatcctagacctggccatctgtcattccattaccttccacccccacgccagcctcctccccggcccccgctttccactgacccccaggggtcccccacatcgaggtgccaggatgacggcttcaggcttcaaccttcccttctctgagctccatcagctccaggggcttagcacctgctgtaccctgcccaggtttcatgctcacaagctcttccaaagaccaccctgttcatcgtcaactatgaggtcccatgggtggatctgtctcagatctttaccccaggaaaaacccatggccaggtgcagtggctcatgcctgtcatcccagcactttgggaggccgaggcgagtggatcacctcgaggtcaggagtttgagaccagcctggccaacatggtaaaaccccatctccactgaaagtacaaaatttagctggtggcggctaaagggggaaaggtgggcctcatctaatcagtcgaaggtctaaagggggaagagtgggcctcatctgatcagtcaaatttgtggtggcgggcgcctgtaatcccagctactcaggaggctgaggcaggagaatcgcttgaacccgggaggccgaggttgcagtgagctgagatgacaccactgcactccagcctgggcaatagaatgagactccgtctcgagggagaaaaagaaaataaacacagcccactgagtcccaggctgagctcgtgaagatctgacagcctgaaccctcctttttctcagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagcactttgggaggccaaggcaggcggatcacctgaggtcaggagttcaagaccagcctgcccaacatggtgaaaccccatctggactaaaaatgcagaaatttacccaggcacggcggcggacgcccatcatcccagctacttgggaggctgaggcaggagaattgcttgaacccgtgaggcggaggttgtagtgagccaagatcgcaccattgcacaccaacctgcgtgacagagcaagattgcatctcaaaacaaacaataataataaataataaaaacctgatatttggctgggc

SEQ ID NO: 2454 - DNA, 37019 bp, Homo sapiens
  source 1..37019: mol_type = genomic DNA
ctctgaagggagctactcagaagcgggagtctccgagagaagaaaagcaggtggaaggagaggaagcggatgccgtgggggtaagctaagttctttccttctgtggtctttgagcatgtcgagtcacccgggtacatgtttctgctgtgtctgtcgatagaaaagaaagagactgaactggaacataagatttcaaacgttggctcgagccgaagtggggacagcggcccagaagactgagagccaaggaaccttgcatatgagttgtcttctgcctttgttatatgcaggtttttaaaggcaaaattaaaaaaataaaataaaataaaaagagggaggtgttgttggaggacagggagggggcttctgtgaagctgtttgctgggaattctcgttggtttacagaaaaaaacaattgattaatgattggctgtacattgctaagctacagggcgttggggtgtagtatctagcacggaattatcacgtgaattcacagctatctgtggcatccggaagccgtttcgagagatgaacgcggccgggcgtggtggctcacgcctgtaatcccagcactttgggagactgaggcgggtggatcacctgaggtcgacagttcgagaccatcctggccaacatggagaaaccccgtctctactaaaaatacaaaattagccgggcatggtggtggcaggcacctgtaatcccacctactcaggaggctgaggcaggagaatcgtttgaacccgggaggcggagcttgcagtgagctgagattgcaccactgcactccagcctgggcaacaagacgagattctgtctcaaaaaaaagaaaaagaaaaaaaaagagatgaaaagagatgaacgcagagctgaaagggggagggagtgtgatggtgttactagttactagaaaggggtcctgatccagacttcaagaacgggttctgggatcttgcccaagaaagaactggaggcaagttcacattgcaaactgaaagcaagcttattaagatagtaaaggggggccgggcacggtggctcatgcctgtaatcccaacacttttggaggctgaggcgggcggatcacctgagctcaggagttcgagatcagcttggccaacatggcaaaaccacacctttattaaaaatagaaaaaattagctaggtgtggcagtgtgtgcctgtaatcccagctacttgggaggctgaggcaggagaatcgcttgaacccgggaggcggaggttgcagtgagcccagattgcaccgttgcactccagcctgggcaacaagagcaaaactctgtccccaaaaaaagataactaaaagaaaaaagtcgtggggagagatgctccactacaagggtgactgataaaggattcatctttgtcatgactatcttttgcagtaatcaatattgtatatatacatattatatattttttattattattattttgagatcatctggctgtgtcatccaggctggagggcagtggtgcaatcacagctgactgctgtcttgaattcctgggctcaagcaatcctcccatctcggcctcccgagtagctgggtcaaaggcaaatgccaccattcctggcaaatatttgtatttttgtagggacgagggtttcactgtgtttcccgggctggtcttgaactcctagactcaatctatcttcctgccccagcctcccaaagtggtgggatgacaggtgtgggccaccgcgcctggcccaatattatcatttttaaagcaaaacggattctcacactatgaaagcttttgttctgaagatatcaacacatcaggaggtttctgtgtctgttcagtcctcggtctgtttagtaaacagtattgatctgttcacatatcttgcgtcaggaatggctgacctccagggaatgctgcccagcctgtcccagcctccctgttcccagcccctattctagatggagtccctctaagctgggcgtggtgtaatcccaggactttgggaggctgaggtgggcggatcacctgaggtcaggagttcgagaccagcctggccaacagggtgaaaccccatctctactaaaaatacccaaaattagccggggcgtggtggcgggcgcctgtaatcccaatattttggaaggctgaggtgacagaggattgcttgaggccacagcaattccagaccagcccggggcaacatcgtaagattcccccatccctcgtgtataaaaaaaagattaaattattacaaattttaaaaaagacagaaatgaagcatcttaagttaccacccagattggggtactaagagtctggatttggacagcttgttgcgcgttttataggtgtgctaaatcacatttcactctttttgttgagacagagtctcgtgctgtcgcccaggctggagggcagtggcgcgatctctgctcaccgcaacctccgcctcctgggttcaagcaattctcctgcctcagcctcctgagtagctgggattacaggcacctgccaccacgcccggctaatttttgtattttttttttttttttttttttttggagacagcgtcttgctctgtcgcccaggctggagtgcagtggtgcaatctccgctcactgcaacctccacctcccgggttcaagcaattctcctgcattagcctcctgagtagctaggattacaggcacgtgccaccatgcccagctaatttttgaatttatttatttatttttttggagacagtatcttgctctgttgcccaggctggagtgcagtggtgcgatctcggctcactgtaacctccgcctcccgggttcaagtgattctcctgcctcagcctcctgggtagctgggattacaggtgtgtgctaccatgcccggctaatttttgtatttttagtagggatggtgtttcaccatgttggccaggctggtctggaactcctgacttcaaatgatccgctcaccttgacctcccaaagggctgggattacagacatgaaccacggagcccggccggatttcactctttagatttttggtttaaactcgagaagctcttctcgagggctgaaagctcttggtcccctgtaggtttgctgtagatgacagacatgaggcagattgattaataagagaaaagacatgcactttttttttcttttttttttttgagacggagtctcgctctgtcaccgaggctggagtgcactggcatgatctcggctcactgcaacctccaccttccaggttcaactgattctcctgcctcagcctctccagtagctgggattacaggcgtgtgctaccatgcctggctaatttttctatttttagtagagacagggttgttccatattggtcaggctggtctcgaacacctgacctcaggtgatccgcctgcctcggcctcccagtgtgctaggattacaggcgtgaaccactgtacccagccagatttacacatttatagaatgtgtatacacaagattcttcagaatgaggactccaccccacaatgaggttcagaagctagtacaccacattgagactacagaaggataggggattggatcctggtacaaaaaaaaaaaggttatagggttggggggaaagaggaattctattgaggagcaatatataatttctactgcggactgaactctgatttttttctttattttattttattttattttatttttttgagacagcatctcactctgccgcccaggctggagtgcagtggtgcgatctcagctcactgcaacctccacctcctgggttcacccgattttcctgcctcagcctcccgagtagctgcgattacaggcacccgccactacgcccagctaattttctttgtatttttagtagagacggggtttcaccatgttggccaggctggtcttgaactcctgacctcaggtgatccaacctcctcggcctcccaaagtgctgggattatacgcatgagccactgcacctagcttcttctttttctttttttttttctttctttttttcttttttttttttagatggagtctaactttgtcgcccagactggagtacagtggcacaatctcagctcaccacagcctccacctcccaaggtcaagcaattctcctgcctcagcctcccaagtagctgagattacaggcacgtaccactactgcctgagtaatttttgtgtttttagtagagacaacatttcaccaggttggccaggctggtctcgaactcctgacctcaagtgatccacacgcctcagcctcccaaagtgctaggattataggcaccagccaccacaccgggcctctgactttttttatcttgcccaaattcctatctaagaggtctgaggaggcaagccctacaaaccataaattctcatcaaatgggatttattgaaccctgtatatcgtgacttactttccaacctgactctggcaaacgttacaagacagagaaaaaaaacaacatatgttgccccaaaatatgtttcttagttgtattttttttttcttttaagatggtctcattctgtttccaaggctggagtgcagtggtgcaatcttggctccctgcaacctccgtcttctaggttcaagcgattctcctgcctcctcagccttccaaatagctggcgtaatatgcatgagccatcgtgcccagataattgttttttgttttttgttttttttttagtagagatggggtttcactgtgatggccaggctggtcttgaactcctgacctcaggtgatccaaccgcctcggcctcccaaagtgctgggattataggcgtgaaccactgctcccggctggagtacaggggcataatcttggctcactgcagcctctgcttcccaggttcaagtgattctcctgcctcagtctcccgagtagctgggactacaggcgcccgccaccacgcccagctaatttttttttttttttttgtattttttttttttagtagagatggggtttcactgtgtttgccaggatggtctcgatctcctggcctcatgatctgcccgcctcggcctcccgaagtgctgggatgacaggcgtgagtcaccgcgcccggcatgaaagggtttttcattaaaaatccttgttataccgtggagccctgtgttggggtaaaatatcatgatttccctcactctccatcattcttgctttgaatctgagaaggaagcttggcggcctctattttaggatcagccgaaaatttccagaaaggggaaagaaaactcattctgtaaacacaaaaaagaagaagagaaaaaagtataagcggtacagacaaaacgcaaagatgttgcataattttccgtgagtgcaaaatgtcctgtaaaccaaaaaagaggtatctgagacaggtctcagtccatttagaaagttcattttgccgaggttaaggacgcctgcccatgacagagcctcaggaaatcgcgatgacaggtgctgtggatacacagggcacaatttgctttcatacatttttttggcggggagggagctggggatccagtcttgttctgtcacccaggctgcagtgcaatggtgcaatctcagctcactatcactgtaacctccgcctcccgtgttcaagctattctcctgccacagccttctgagtagctgggattataggcacccactaccgcgcccagctaatttttgtatttttagtagagacggggtttcaccatgttggccaggatggtctcgaactcctggcctcaaatgatccacctgcctcggcctcccaaagtgctgggattataggcgtgagccatggcgcccagccctggtatgtaatttttaaaacctttgtagtaccttatttacgaataaaatgcgaggcaggtttgcctaagacagtttccactataacctttcatgattttggggtcctgagacttatttacctttcacagtttacagcaggaaaatccgtggagacagcagatccgagaagcggcgatgtttgcgtagaaccctgtacgtgcttccttcggcctgtcggtaatgtggttggggattttcttttttttaagtgaagtctaaagaactgaaatgttttgctccataatgatgaaccaggatagaagtgagaactcagggcagaagaatctgaatgaggaactgtctgacctatgacaaatttaacatgtcacgttccctctgagacagtacacatcctcctgaagcagcgtgacaaggcacatcctcctgaagggtctccaggcagaagagacgcatgaacctgtcaaaaaaaaaaaaaaaaagagccggccgggcgcagtggctcaagcctgtaatcccagcactgtgggaggctgaggcggggggatcatgaggtcaggagttccagaccagcctggccaacatggtgaaaccccatctctgctaaaaatacaaaaattagccgggtgtagtggcagttgcctctagtcccagctactccggaggccgaggcaggagaatcgcttgaacccaggaggcgtaggttgcagtgagccaagatcgcgccactgcactccagcctgggcaacagagcgacagtccgtcccaaacactgcaaaatatttaaagagatttattctgagccaaatatgagtgagcaagaaggcccagggaaaatagtctaaagagatcctgagaacacgtatccaagctggttgagcggcagtttggttttatatgtttttgtttgtttacttattttactttattttatttatttatttatttattttgagatgaagccttgctcagtctgttaggctggagtgcagtggcgcgatctcggctcactgcaacctccgcctcccgggttcacgccattctcctgcctcagcctcccgagtagctgggactacaggcgcccaccaccatgcccagctaattttttgtatttttagtagagaaggggtttcaccgtgttagccaggatggtctcgatctcctgacttcgtgatccgcccgcctcagcctcccaaagtgttgggattacaggcacccgccaccacgcccggccaatttttgtatttttagtagcgacggggtttcaccatgttggccaggctggtctcaaacttgtgacctcacatgatctgctcacctcggcctcccaaagtgctgggattacaggcgtaagccacagcgtccagctattttattttatttgttttattttttgtgacagagtctcactctgtcgcccaggctggagtgcagtggagcgatctcagctcactgcaacctctgcctccggagctgaagcaattctcccgcctcagcctcccaagtagctggcattacagaggtacgccaccacgcctggctaaattttgtttgtttgtttgtttgtttgtttgtttgtttttgtttttcagtagacacagggtttcactatgttggccaggctggtctcgaactcctgacctcacatgatctgcctgcctcagcctccagaagtactgggattacagccgtgagccacctcacccagccagcagcttggttttatgtttgtttatatatttatttatttatttatttttaatttttggagacggagtcttgctctgttgcctgggctggagtgcagtggcatgatcttggctcacggcaacctctgcctttcgagttccagtgattctcctgcctcagcctcgcgagtagctgggagtacaggcgcccgccatcacacccggctagtatttgtatttttagtagagagagggtttcaccgtattgtccaggctggtcttgaactcctgtcctcaagtgatccacccacctgagcctctcaaagtgctgggattgcaggcgtgagcctctgtggccagccaacagacagttttgcaggaccatttcaaaatatgtcaagtaaatatattttggggtgaaatgtattttaaagtggcatatactgatttcccacagtcttgtctggggaggcatatcctggcctcctagaaagcatacacagtagcagacaggtgtggtggctcacgcctgcaatcccagccctttgggaggccgaggcaggtggatcacaaggtcaggagatcgagaccatcctggccaacatggtgaaatgctatctctactaaaaatacaaaaattagctgggcgtggtggtgcatgcctgtaatcccagctactcgagaggctgaggcaggaggaccacttgaacctggcaggtggaggttgcagtgagctgagatcacgccactgcactccagcctgggagacagagcgaggctccgtctctaaataaataaataaagcttacgcagtagctgagaagacagggaaaagaggtgaagaaatgacagaaagcttagaagtcgctcattataaccccttcctaccccatctcatgcttcccttaaagcataaacgaagggtgcttgtgttacaggaaaggggttcggatccagcccccaagagggggttcttggatctcacgcaagaaagaattcagggcggccgggcgctgtggctcacacctgtaatcccagcaccttgggaggcagaggcgggcggatcacgaggtcaggagttcgagaccagcctgaccaacatggtgaaaccccatctctactaaaaatacaaaaattagccaggtgtggtggtgcgtgcctgtagtcccagctactcgggagacagaggcaagagaatggcgtgaacccgggaggcgatgcttgcagtgagtggagatcatgccactacactccagcctgggcgatagagtaagtccatctcaaaaaaaaaaaaaaaaaaaaaaaattcggggtgagtcagcagtgcaaagccaaagcaaatttattacaaaagtaaaacagtgaaagaatagctactccagaggccgggcgcagtggctcatgcctgtaatcccagcactttgggaggtggaggtgggcagatcacctgaggtcaggagttcgagaccagcctgaccaacatggtgaaaccccatctctactaaaaatacaaaaattagccaggcatggtggtgcgtgcctgtagtcccagctactcgggaggctgaggcagtagaattgcttcaacttgggagacggaggttgcagtgagccgagatggcaccactgcactccagcctgggcaacagaatgagactcagtctcaaaaaaaaaaaaaaaaatttcagggcgagcaagtttattatgaaagtaaaatagtgaaagactaggtactccagaggccaggcgcagtggctcatgcctataatcccagcactttgggagcccgaggcaggtggatcacctgaggtcaggagttcgagaccagcctcgccaacatggtgaaaccccatctctactaaaaatacaaaaattagccaggcatggtggtgcgtgcctgtagtcccagctacttggaggctgaggcagtagaattgcttcaacttgggagacggaggttgcagtgagccaagatggcaccactgcactccagcctgggcgacagaatgagactcagtctcaaaaaaacaaaagatttcagggcgagcaagtttattatgaaagtaaagtagtggaagactagctactccagaggccaggtgcagtggctcatgcctataatcccagcactttgggagcccgaggcaggtggatcacctgaggtcaggatttcgagaccagcctcgccaacatggtgaaaccccatctctactaaaaatacaaaaattagccaggcgtgttggtgcgtgcctgtagtcccagctactcggaggctgaggcagtagaattgcttcaacttgggagacggaggttgcagtgagccgagatggcaccactgcactccagcctgggtgacagaatgagactcagtctaaaaaaaaaaaaaattcagggcaagcaagtttattatgaaagtaaaatagtgaaagactaggtaatccagaggctgggtgcagtggctcatgcctataatcccagcactttgggagcccaaggcatgtggatcacctgaggtcagaagttcgagaccagcctggccaacatggtgaaaccccatctctactaaaaatacaaaaattagccaggcgtgttggtgcgtgcctgtagtcccagctactcggaggctgaggcagtagaatcacttgaacctaggagacagaggttgcagtgagccgagatggcgccactgtactccagcctgggcgacagagtgagactccatctccaaaaaataaataaataagtcaaccaagaaggccgtacgtacagtggctcacacctgtcatcccatcactttgggaggccgaggcagggggattacttgagatcaggagtttgagaccagcctggccaacatggtgaaaccccgtctctactaaaaatacaaaaattagccaggcgtgttggtgcgtgcctgtagtcccagctactcggaggctgaggcagtagaatggcttcaacttgggagacggaggttgcagtgagccgagatggcaccactgcactccagcctgggcgacagagcaagaccgtctacaaaataataataataattaataataataataataactagtgcaagagaagtacacaaatatcccaaacatttagtgactcagcagagggggccagtctcaaggaacaggacttctacacctgttaccaccacctggggagttgtatctgaatctcaaggtcaggcccacccagacagaacatgcatctctagggtgccacaggagagtctgtccagtgcccagaaacacctgcaagacccagaagcaggctccaagaagcggggtgccacagtccagtgggggaagcggccacatccctgtcatgtgggctacagatgagttggggggcaggggcaggagaagaagaaacaggtgtggcctacatgcttttacttcctcttagcaagcgaggttcctcttgcagaggaacggtctgagagacacaaccgttttttttttttgtttgtttgcttttccttgagacagagtctccctctgtcacccaggctggagggcagtggcgcgatctcggctcactgcagcctccacctcctgggttcaagcgattctcctgcctcaacctcccgagtagctgggattacaggcacccaccaccccacccggctaatttttgtatttctagtatagatgaggtttcaccgtattagccaagctggtcccgaactcctgacctcaggcgatccgcctgccttggcctcccaaagtgctgggattacaggcgtgagccactgtgcccggccgagagacgcaatctttcagagaggaggtttggagcaggaacctcagggtggacagatgggtcccaccaggtgcagatgcttgaactaaagatgctacaaaggccgggtgcagtggttcatgcctgtaattccagcagtttgagaagctgaggcaggcagatcatctgaggtcaggagttcgagcccagcctggccaacatggcaaaacagcgtctctactaaaaatgcaaaattagcctggcataatggcgggcgcctataatcccagctacttgggaggccgaggcaggagaatcgcttgaacccgggaggcggaggttgcagtgagccaagattgcaccactgcactccagcctgggtgacaagagtgaaactccgtctcaaaaaaaaaaaaaaaaaaagaagaagaagaaaagaaatacattagtttggtccataaaggcgggacaactcaaagtgggggcttccaggctataaatgaatttaaacattttctggttgacaattggttgagtttgtagctcctcctccttctcttcttcctcctccttctccccccttcctcctcttcctcctcttcctcctcctccttcttcttctcttctttcttcttcttctctttccccttcttcttcttcttcctcctccttctcctcctcctttttcttcttcttccttatgggcttggatagaagtatattgacatggatccaccatttgtagaatcataccgagtagcttcttttctcctccttcctctccttctcctcctcctcctcctccttctcctgctccttctcctcctcctcctcctgctccttctcctcctcctcctccttctcctcctcctcctcctgcttctcctcctcctccttctcctcctcctgcttctcctcctcctccttctcctcctcctccttctcctcctcctccttctcctcctcctcattctcctcctgctccccttctcctcctccttctcctcctcctccttctcctcctgctccccttctcctcctccttctcctcctcctcctcctcctgctcctcctcctccagctccccttctcctcctactcctccttctcctccttctccttctcctccttctcctactcctccttctcctactcctccttctcctactcctccttctcctcttccttcttctcctcctcctgctccttctcctcctcttcctcctactcctccttctcttccttctcctcctcctccttctcctcctcctccttctcctcttcctccttctcctcctcctccttctcctcctcctccctctcctcctcctccgccttctcctactcctccttctcctcctccttcttctcctcctcctgctccttctcctcctcctccttctcctcctgctccttctcctcctcttcctcctactcctccttctcttccttctcctcctcctccttctcctcctcctgcacctttcctcctcctccttctttttccttttttgcataaagaagtatcaaataagagtagtttcactgccctaaacatcctctgaggtccatgtattcatccctccatctgcccaacgccaaccaactccggatctttttactgtttccatgattttgtcttttccacagtgtccaagtgttagaatgactcagtctgcagccatctcaaagtggattctttcccttagtcataagtatttaaacttcattcatgtcgttttatgtactcaccctttttttcttcctcttcttttttttttttttttcactttccttttatagctgttgcaaaagtcaagattttttaaaaaatataaaagagcagggccgggcacggtggctcacgcctgtaatcccagcactttgggaggccgaggcaggtggatcacgaggtcaggagatggagaccatcctggctaacacggtgaaagcctgtttctactaaaaaaaaaaaaaaaaaaaaaaaattagctgggtgtggtggcaggcgcctgtagtcccagctacttgggaagctgaggcaggagaatggtgtgaacctgggatgtggaggttgcagtgagccgagatcgcgccactgcactccagcctgggtgacagagcgtgactttgtctcaaaaaagaaaaaaaaagtacaaaagagcaaaacaaaacaaaagttatgaaaatgaaaacctgagccatcgtttatcttatttccccaaatccactaattattaacagaaagtaaaagctatgaaaaatgaatgaaagtgactgcaatttccttgaagtgtgttagaacctgcctttagtgtcagctatgggttccctcatgaaggtcagctgagccatgacccatgaaccatggaagcttgactctagattgaccatcttgagatgccaaagatgtccacgtcctaatcccatgtgggagacagaataatggccctgcagaccttcccagctggccatgacccctcatttgaccaggtcagcggctgaccaccatcctgggtttgtttccccaaatcacctccctggggtcccctgccaggaatgtcctgggagaggcaaccttctcactgtgtgatattttctctcctgcagctcttcccttctctctgaccagcaccatgcttctcctggtgacaagccttctgctctgtgagttaccacacccagcattcctcctgatcccagagaaatcgggtaagtatggaaacctggctgaaccttctccgcggcccctgtttagatgtcctgcatctggagacccatctggatacctgggtccatctgcatttcatctctaatgtttatgagggacccaataagcaccagccaacccaccagaagctcagagctcctcttgttctcacctccttttctgctgttaattcccatccacccattctacagatgagaaaacggaggctcagatacctccacagtttaacccaacgaccatccaggtagtgatggggccaggatgaggacccatgtctgcatggggccaaagtgttccttccttccttcgttccttcgttccttcgttccttccttccttccttccttccttccttcgttccttccttcgttccttccttccttccttccttccttccctcccttgcttccttctcttcctcctgccctccctctttccatccttccttctctccttccttccatccttctctccctcctgattcatttcttctctttctttctcttccttccttccctccttccctttctctctttcttccttccattgtttccttctttccttccttcttccgtccctcccttctttctttctctttcttccttccctccttccctctctctctttcttccttccattgtttttctttctttccttccttccctccctccctccctctctctctctctttctttctttctttctcctttttttttctccttctttgtttctttcttcctctttcttctttctttctttctttctttccttctttctttttctttcttttcagagtctccctcttgttgcccaggctggagtgcaatggctcaatctcagctcactgcaaactcagcctcccgggttcaagcgattctcctgcctcagcctcccgagtagctgggattacaggcgcctgccaccaggcccagctaatttttttgtatttttagtagagatggggttttgtcatgttggccaggctggtctcaatctcctggcctcaggtgatcccgtgcctcggcctcccaaagtgctaggattacagctatgagccgccacacccagcctcttgtttgttgacttcttaatagcagccattgtgactggcgtggaatgatagctcattgtggttttgatttgcgtttccgggagggaccctcttgactgagggtgtcagggcctctgcttcaggaaagtatttccaggtttttgtgacctggttcagggaagacagacaaagacagctttctgtttctgcaattttctcaaattccttcagctttatattaaactgccaaggttccataatttgggaagtgtgttcagagccacatcactctggataaagagcctttgcctgttctcattcaagcggttttctttctctgtctctcttttttttttttttttttttttttttgagacaggatctcgctctgtctcccaggctggagtgcagtggcgtgatctcggctcactgcagcctcagctttctgggatcaagtatcctcccactccagcctcccaagtagctgggactgcagaaatacaccaccatgccaagctaatttaaattttttttttaattttatagaggagatcttgctatgttgccaagactagtttttgatttttttttttttttgagatggagtcttactctgtcacccaggctggagtgcagtggcgcgatctcggctcactgcagcctcagctttctgggatcaagtatcctcccactccagcctcccaagtagctgggactgcagaaatacaccaccatgccaagctaatttaaatttttttttttttaaattttatagacgagatcttgctatgttgccaagactagtttttgattttttttttttttttttttttgagatggagtcttactctgtctcccaggctggagtgcagtggcgcgatctcggctcattgcaacctccacctcccgggttcaaccgattctcctgcctcagcctcctgagtagctgggattacaggtacccgccaccatgtccacctaatttttttgtatttttagtagagacagggtttcaccacattggccaggctggtctcgaactgctgacctcaggtgatccgcccacctcagcctaccaaagtgctgggattgcaggcatgagccaccgcgcctggccagtttttgatgatttctgcagtaaacatctccatgtggagaaggagcaagctgggaccacagatgtgcaccatcacacctgcctaatttaaatttttaaaaaaaaattttttttaaagagatgcgatcttgctatgttgcccaggcgggatctgaacctactgggctcaagtcagctttttgcctcagcctcccaaggtgctgggattagaggcgtgagccaccacccccagtcttcagatgatttttgaatatttctgcagtagaaatctcctttttcagaaacagccagggggctgtgaaaaggagggaagatggacaagggaggaacagatacctgaggatgtgggacgtcctggggccatgtgggtgacagaggaaaatcagcaggcttcagccctgaacttcacctcccagagccgggtgggaggacagaaaacagggccggccgggcacggtggctcacgcctgttatcccagcacttcgggaggctgaggcaggcggatcacctgaggtcggcagttcgagaccagcctgaccaacatggtgaaacccccatctctactaaaaatacaaaaattagctgggcatggtggtcggcgcctgtcatcccagctactcgggaggctgaggcaggagaatcatttgaacccgggtggtggagcttgcagcttgcagtgacctgagatcacagcactgcactccagcctgggagacaaagccagactccgtctcaaaaaaaaaaaaaaaaaaaaaaaaaaaaaaggaaaagaaaagaggaaattctgaacccagtgcccgctccttgcagatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccagggtgagacgaatttcccattctcaacccctgtcctttacacacccctttctgagttaaaagcaacagggccggctgggcgcggcggctcacgcctgtcatcccagcactttgggaggctgaggtgggcggatcacctgaggtcgggagttcaagaccagcctgaccaacatggtgaaaccccgtctctactacaaatacaaaattagccgggcgtgctggtgcatgcctgtagtcccagctactcaggaggctgagggcagaagaattactcgaacccgggaggtggaagttgcagtgagtcgagctcgtgccattgcactccagcctgggtgacagagcgagactctgtctcataaaatgcaataaggccgggtgtggtggctcacgcttgtcatcccagcactctgggaggccgaggcaggtggatcacctgaggtcaggagttcaagaccaggctgaccaacatggtgaaaccccatctctactaaaaatacaaaaattagtcgggcatggtggcaggcatctgtaatcccagctactcgggaggctgaggcaggagaattactgaaactcgggaggcggaggttgcggtgagccgagatggtgccattgcactccagcctgggcaacaagagcaaaactctgtctccaaaaaaaaaaaaaaataataaattcaattaaataaaagcgagagggccacagacacaaacaacacaagtgtggtatttggagaaatgtcacagccataatctcacgggaaccgggaaagtgctgttagctcatgtccacaatgtgtaccagagcctgattccctgaggcagagcctatgttaccgtattttaccccaagagaagagaaatcctggcaaatgcagttggatgtgcccctgggtctgtggtggaagcaggacggagaaaagtaaagtgtcagtcacgttgtcagtgtgtcaccgtcctggttccccaagggattaaggtcagggtttttggaacacaggagacagagacagaagagcggggagaggggagggaaggagggagaaacacagagaaaggatagaaggaggagggagaggaagagagaaatatggatgatcgatagataggtgatagatgatttattgactgataggtgataatagatgattggaagattgataatcaattctataggtagatgctacacggagggatgggtggtcttgctatgttaccccagatgacatactttttttttttttttttttttttgagatggagtttccctcttgttgcccaggctggagtacactggtgtgatcttggctcactgcaacctccacctcctgggttcaagcgattctcctatctcagcctcctgagtagctgggattacaggtgcgtgccaccacgcctggctaatttttgtatttttagtagagacggggtttcaccatgttggccaggctggtctccaactcctgacctcgtgatccaccctccttggcctcccaaagtgctggcattacaggtgtgagccaccgtgtccgacctttattttttgggatggagtctcgctctgtcgcccaggctggagtgcactggcgtgatctcagctccctgcaacctgtgcctcctgggttcaagagattctcctgcctcagcctcctgagtagctgggattacaggtgcccaccaccacacctggctaatttttgtatttttagtagagacggggtttcaccatgttggccaggctgatcttgaactcctgacctcaagtgatccacccgcctcggcctcccagagtgctggcattacaggtgtgagccactatgtccgaccctttttttggggggatggagtctctgtctgtcacccaggctggagtgcactggcgtgatctcagctcactgcaacctgtgcctcctgggttcaagagagtctcctgcctcagcctcccgagtagcagggattacaggtgcctgccaccacacctggctaatttttgtatttttagtagagacggggtttcaccatgttggccaggctggtcttgaactcctgacctcaagtgatccacccgccttggcctcccagagtgctgggattacaggtgtgagccacggcacctggcctctagtctggtactttcagcactgctagagtataagattgagttttcacctgcaagctggtattcagcgtatccactcagagccctcggaggaagcttagggggatgatttcacaaagggaggcaggtgcgtgtcgccaaatccaggtaaaaaccaataccatggccgggcatggtggctcacgcctgtaatcccagcactttgggaggccgaggcgggtggatcacctgaggtcaggagtttgagaccagcctggccaacatggtgaaaccctgtctctactacaaatacacaaattagcagggtgtggtggcgggtgtctgtaatccgagctactcgggaggctgaggcgggagaattgcttgaacctggaaggcggaggttgtagtgagccgagatcacgccactgcactccagcctgggagactgtaggagacagaaggttgtttcctaatcggctctgtctggttgcaattcttcagctcagtaacaacgaatgttcgtgcacatttcgtgaaatttgtctgcatgaaggagtcacatttgaggttcacgtgaatactagtcaaagaggatttcaacagaaactgctttatccaaattcaggtaagcaagacagctcagggatccgtttacagcactggccccaccaccccgccagcatcaaagtacatcccgttgaacttcggagtgaaaattattttgtttctacctcttcccaggaagggagggtaccgctgctcagaatttctcctgtttcatctacaatgcggatttaatgaactgtacctgggcgaggggtccgacggccccccgtgacgtccagtattttttgtacatacgaaactcaaagtaagtgttcacctcatgtgaagaattatgaggaatgcagggatgggagaaaaaatcatgctggttttctttttttcctttttctttttttaagacatggtcttgctctgttgcccaggctgcaatgcaatggtgccacctcggctcactgcaacctcgacctcctgggttcaagcaattttcctgcctcagcttcccaggtagctgggattacaggcgcccgccaccacaccaggccacatctatgtatttagagacagagtcttgctctgtcgcccaggctggagtgtagtgatgtgatctcagctccctgcaacctgcgcctccctccagggttcaagtgattctcctgcctcagcctcccaagtagctgggactacaggtgcactccaccacacctgtctaatttttgtatttttagtagagacagggtttcaccatgctggccaggctggtctccaactcctgacctcaagtgatctgcctgcctcaacctccccaaagtgctgggattacaggcgtgagccactgcacctggcctgtttttttggttgttgttttgttttgtgttttttgttttgttttgtgtttctttttgttttgccttgtgtttttgtgttcttgttttgttttgtgtttctgtgtttttcttttgtttttgtgtttttttggtttcacgtttttgtggtgttttgtgtttttgtgtttttgttttttgtgtttgtttttgttttgttttgtgttttgttttgtgtttgtttttgttttgttttgtggtttttgttttgtgttgtgtttgtttttgttttgtgtttttttgtttgtgttttggtgtttttgttttgtggttttcttttgtgtttgtttttgttttgtgtttttgtgtttttgtttcattttgttttgttttgtgtttttgtgttttgttttgttttgtgtttgtttttgttttgttttgtgtttttgtgtttttgttttgtgttttgtgtttttgtgttttgttttgttttgtgtttttgtgttttgtttttgtgttttgttttgttttgtgtttttgtgttttgttttgtgtttgtttttgttttgttttgtgtttttgtgtttttgttttgtgttttgtgttttgttttgtgtttttgtgttttgttttgttttgtgtttttgttttgttttgtgtttttgatttgtgtttttgtgttttgttttgtgtttgtttttgttttgtgttttgtgtttttatgttttgttttgtgtttgttttcgttttgttttgtgtttttgttttgtgttttgtgtttttgtgggttttttttgttttgtgtttttgttttgtgtttttgtgttttgtgtttttgtgttttgttttgtgtttgtttttgttttgttttgtgtttttgtgttttgttttgttttcctgattgctctctgagcactttctaatctttcaggagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaataggtgagaataacacatatgattttcctattgtttataggtgaaatggaatttgccttaaaatctgtgtaactgaggccacgtgcggtgtctcacacctgtaatctcagcactttgggaggccgaggcgggccgatcacctgagatcgggtgttcaaaaccagcctgaccaacatggggaaaccccatctctactaaaaatacaaaaattagccgggcatggtggcgcgtgcctgtaatcccagctactcggaaggctgaggagaatcactcaaacctaggaggcggacgttgcaatgaggtgagattgtgccactgcactccagcttgagcgacagagcaagactctgtctcaaaaacaaacaaacaaaaatctgtgtaactttggtgctgtaacaaattagaactgagctgatttaactttcctttttttgagatagagtctcgctctgtcacccaggctggagtgcagtggtgcaatctcagctcactgcaacctctgcctcccaggttcaagcgattcttctgtcttagtctccttagtagcttggattacaggtgcacaccaccacgctcggctaatttttgtatttttagtagaggcagtgtttcaccatcttggccgggctagtctcgaactcctgacctcagatgatccacctgcctcagcctcccaaagtgctgggattacaggcgtcagccactgcacctgacctccctctttacctccttccttctttccttcctccctgcctttctgcctttcttcttttttcttccttccttccttccttccctccctccctcctttccttccttccttcctccttccctcccttcttccttccctccctccctctctccctcccttcttcattccttccttcttcctctccttccttctccttcactcatttcctccttccttcctctttttcttcatttcttcctcaccagcacctcttcgtgtcccagtgccctgctcctggctggcctcttggagccagtcccatatgcccacacgctctcctcttcccaagcccaccgcatcccacccgtggactccttcatcccgttggacgttcccagcctcttcaggcttaggactctcacagaagtgtgactcctgcccaccaagcccatccccacctcccaccctggaacccctgccccagtgggtatctctcctgtacatggtagctgccccacctccacttggacccagtgtagacaggaggagaccctgtaccacctccacctggacccagtgtagacaaagaggtgtccctactccacgtccacctggatccagtgtagacaggaggagactgcaccacctccacctggacccagtgtagtcaaagagatgtccctactccacgtccacctggacccagtgtagacaggaggagaccctgtaccacctccactttacccagtgtagacagaaggagaccctgcaccacctccacctggacccagtgtagacaaagaggtgtccctactccacatttacctggacacagtgtagacaggaggagactgcaccacctccacttggacccagtgtagacaggagaccctgcaccacctccacctggacccagtgtagacaaagaggtgtccctactccacgtccacctggacccagtgtagacaggaggagactgcaccacctccacctggacccagtgtagacaaagaggtgtccctactccacatttacgtggacacagtgtagacaggaggagaccctgccccacctctacctggacccagtgtgaaggcgaccagcccttccacacatgtgggtatttctcgtcaggtgggacgagagactgagaaaagaaataagacacagagacaaagtatagagaaagaacagtgagcccaggggaccggcgctcagcatacggaggacctgcaccggtctctgagttctctcagtatttattgcttactattttcactatcttggcaaggggaatgtggcaggaggacagggtgatagtggggagaaggtcagcaggaagacatatgagcaaaggaatctgtgtcacaaataagttcaagggaagctactatgcctggatgcacacgcaggccagatttatgcttctctccacacaaacatcagtgtagcaaagagtcacagagcagtattgccaccagcatatctcgcctccagccacagggcggttttctcctgtctcagaatagaacgaatgtacgatcgggttttacacggagacattccattcccaggggcaggcaggagacggagggcttcctcttatctcaaccgcgagaggacttcctcctcggcacagaccctttatggatgtcgggctgggggacggtcaggtctttttcccttcccacgaggccatatctcagactgtctcagtggggggaaccctcagacaatacccgggctctctcgggcagaggtccctgcggctttccgcagtgcatggtgtccctggttaatagagaatggagaatggcgatgacttttaccaagcatgctgcctgcaaacctattgttaacaagacacagcacatgtttctgtgagcacagtgttggggctacagttacagcttaacagcatctcaaggcaaaacagtggttcaacatacagatcacaatggagtttcttaccttcctttctacatagacacagtaacagtctgatctttctttttgtttgtttgtttgtttttctgagacagagtctcactctgtcgcccacccaggctggagggcagtggcgggatctcggctcactgcaacctccgcctcccgggttcacgccattctcctgcctcagcctcccgagtagctgggactacaggcacccgccaccacgcccggctaatttttttggatttttagtagagacggggtttcaccgtgttagccaggatggtctcgacctcctgacctcgtgatcctcccgcctcggcctcccaaagtgctgggattacaggcgtgagccaccgcgcccagccccctgatctctctttcttttccctacacagagtagacaaagaggtgtccctactccacatttacctggacccagtgtagacaggaggagaccctgccccacctccacctggacccagcgtagacaaagaggtgtttctactccatatctacctggacccagtgtagatgggaggagaccctgccccatctccacctggacccagtgtagacaaagaggtgtccctagtccacatccacctggaccgagtgtagacaggaggagaccctgccccacctccacctggacccagtgtagacaggagaagactctgcaccacctccacctggacccagtgtagacaggaggagaccctgccccacctccacctggacccagtgtagacaggagaagactctgccccatctccacctggacccagcgtagacaaagaggtgtttctactccatatctacctggacccagtgtagatgggaggagaccctgccccacctccacctggacccagtgtagacaggagaagactgcaccacctccacctggaccgagtgtagacaggaggagaccctgccccacctctacctggacccagtgtagacaggaggagaccctgccccatctccacctggacccagtgtagtcaaagaggtgtccctactccacctccacctggacccagtgtagacaggacctactccacctccacctggacccagtgtagacaggaggagactctgcaccacctccacctggacccagtgtagacaggacctctcgggttcaggggtgtgtcctgcgccctcgttacagaacgattcaaccctcccagcaatgtcaccgtacgttgcaacacgacgcactgcctcgtacggtggaaacagcccaggacctatcagaagctgtcgtacctggactttcagtaccagctggacgtccacagaaaggtcggtgagagctccccggggctgggcaccaggagggaggcgtacgggacacgcccgcacaggagcctgggaatcccggggaagtggcctgggggaaggatgcgtgggtggtgagcggtgactctggggtgaacgcacttcgggtagcggaggaagaggtgaagggtctgtggcctgtggagccaccttgaaagaggttgcagggagggtggacaaggatgatcctgcaaccatggaaccaggaagtggaccgggaggtgtgggggacgatgccacaagcaaggagagcctctgctccacctccagctggacgcagtgtagacagaaggagaccctgccccatgtctacctggacccagtgtagataggaggacacccgaccccacctccacctacacccagtgtagacaggaggagaccctgctccacctccatggagacccagtgtagacaggaggagttcttgtcccacaactacctggacccagtgtagacagggagagagactgcctcacgtccacctcgatccagtgtagacaagaggagatcttgtctcacaacctcctggacccagtgtagacaagaagagaccctgccccatgtccacctcgagccagtgtagacaagaggagatcttgtcccacaaccacctggacccagtgtagacaagaaggagagcctgctccatgtctacctggacgacaggagaacaccctgccccaaggccagtgggacctttctggatgggttacaggaagatatctggccaggaagacttctgtgtttgcagctcctcatcctacctgtcttgtagattcggggtttgtggagggagacctgcctgccactccgcagggactccttcccattcggtgcccacaccaggggagacactgtgtgaaccatctacagtgttttagaaatggaaacagtgagccttgtgttgtgttttgttttgtttctagaatacccagcctggcacggaaaacctactggtaagtgaaaccacagaccctactgacaaccctcagcgtaaccctacggtcccctactcaccacacctagtgtaactctacagtcccctactcatgacccctacagtcccctaccgacgacctccagcgtaaccctacggtcccctactcaccacacctagtgtaactctacagtcccctactcatgacccctacagtcccctactgacgacctccagcgtaaccctacagtcccctactcaccacacctagtgtaaggaggaggagaccctgccccacctccacagagacccagtatagacaggaggagctcttgtcccacaaccacctggaccccgtgtagacaggaagagaccctgccccacgtccacctagcttaatcctacagtcccctactcaccacacctaatgtaactctacagtcccctactcatgacccctacagtcccctaccgatgacctccagcgtaaccctacagtcccctactcaccacatctagtgtaactctacagtcccctactcacgacccccggagtaatcctacagtctcctactcacgacgcctacagttccctattcatgacccctagcgtaaccatacagtcccctacccatgagccctggcataaccctacaatcccctactcaccacacctagcataaacctacagtcccctacccatgacccctggagtaaccctacagtcccctagtcactacacctagtgtaactaaccatacagttccctatccatgacctctggcggaaccctacactcccctactcacaacccctagtgtaaccctacagtctcctacccatgacccctggcggaactgtacagtcccctactcacgacccctacactctcctacccatgacccctggcggaaccctacagtcccctactcacgacccgtacagtctcctacccatgacccctggcagaaccctacagtcccctactcacgacccctacactctcctacccatgacccctggcagaaccgtacagtcccctactcacgacccctacagtctcctacccatgacccctggcggaactgtacagtcccctactcacgacccctacagtctcctacccatgacccctggcggaactgtacagtcccctactcacgacccctacactctcctacccatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccatgacccctggcggaaccgtacagtcccctactcacgacccctacagtctcctacccatgacccctggcggaaccgtacagtcccctactcacgacccctacactctcctacccaagacccctggcggaaccctacagtcccctactcacgacccctacactttcctacccatgacccctggcggaaccctacagtcccctactcacgacccctacactctcctacccatgacccctggcggaaccctacagtcccctactcacgacccctacagtctcctacacatgacccctggcggaaccctacagtcccctactcacgacccctacagtctcctacccatgacccctggaggaaccctacagtcccctactcacgacccctacagtctcctacccatgacccctggcggaactgtacagtcccctactcacgacccctacagtctcctacccatgacccctggcggaaccctacagtcccctactcacgacccgtacagtctcctacccatgacccctggcagaaccctacagtcccctactcacgacccctacactctcctacccataacccctggcggaaccgtacagtcccctactcacgacccctacagtctcctacccatgacccctggcggaaccctacagtcccctactcacgacccctacagtctcctacccatgacccctggaggaaccctacagtcccctactcacgacccctacagtctcctactcatgacccctggagtaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacccctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctacactctcctacccatgacccctggcggaaccctacagtcccctactcacgacccctacagtctcctacccatgacccctggcagaaccctacagtcccctactcacgacccctacactctcctacccatgacccctggcagaaccctacagtcccctactcacgacccctacagtctcctactcatgacccctggagtaaccctacagtcccctattcaggagccgtagtgtgaccctacaatcccctactcacaacccccggtggaaccctacagtcccctacccatgacctctggtggaaccctacagtcccctactcacgacccctacactctcctacccatgacccctggtggaaccctacagtcccctactcacgacccctacactctcctacccatgacctctggtggaaccctacagtcccctactcacgacccctagtgtaaccccacatgacccccagtgtaaccctatagtcccctacccacgacctatgtctgcctagacccagtgtgatcaggaggagaccccacctcacctccccctagacccagtgtagacaagaaggagagcctgccccacgtctacctggatccagtgtagacaggagaatactctgcccgacatacagttgaaccactcacaaccctagcgtcaccctacagtctccacgaaccctacagtcttggtttatgggactcttagtgccagtgtggcccaggggtggacacggtggatcctgaaccagaggatgcagatctcacacgggtgagggccccctcatagttctcactgggcagggtctgctcttggcctcaaccttcgtgtcccaatggttggaatatttatgctcagcctgttctactgattttcccattttattcctctttcctctacgtgggttaagaatatattctagtgactgtctaaggagattatgtctccctctaaaatgcttttagagtgagtactgttgccgggtatttaccaagtctcgcggccactctgaccctcggtatcctcctctgtccgatgagtatgctagacttggggatcttaatatcccttgctaaactatccgtctgaaggtctgttaatatcagttgttgatcctgaatcatttatttatgtatgtatttatttttgagacggagtctcgctctgtcccccaggctggagtgcagtggtgcgatctcggctcactgcaagctccacctcccagcgattgtcctgcctcagcctccctacagagattctacagtctcagcctgtagctgggactacaggcacccacccccacacctggccaacaatttctgtttcagaaaataaaattttagccaggcacggtggctcacgcctgtcatcccagcaccttgggaggctgaggtgggcggatcacttgaggtcagcagttcaagaccagcctgggcaacatggagaaaccccatctctactaaaaatacaaaacgtacccatgcgtggtggcgggcgcctgtaatcccagctacgtgggaggctgaggcaggagaatggcgtgaacccgggaagcggaggttgcggtgagcccagatcatgccattgcactccagcctgggcgacagagcgagagtgtctcaaataaaataaaataaaagaggccgggcgtggtggctcatgcctgtaatcccagcactttgtgaggccgaggcggtcggatcacgaggtgaggagatcgagaccatcctggccaacatggtgaaaccccgtctccactaaaaatacaacaaaaattagccgggcgtggtggtgggcacctgtagtcccaactactggggaggctgaggcaggagaatggtgtgaaccctggaggtggaggttgtagtgagccaagatcgcgccactgcactgcagcctgggtgacagagggagactccgtctcaaaaaataaataaataaaataaaataaaaaagcttaaagcctacatcacccaaattttcccaacttgtctcccatcgaaatactaacgaggcttgactctgcttagcttcgaagacccgatcagaccaagtgcattcagagtggtagaaaaaaaagaagaaaaagaaaaaaagaaaaggagaaaaaaacttaaaagacaaaagaacgaaaaaaggcaaccttttcctccacacagaagacgcctatctctaactttcttttttcctccaaagattaatgtttctggtgatttggaaaatagatacaactttccaagctctgagcccagagcaaaacacagtgtgaagatcagagctgcagacgtccgcatcttgaattggagctcctggagtgaagccattgaatttggtaagcgttgggcggaggtaagggatgtttgtgccgtctgcggccaccctgcagcaggcacagaggtcaggtgctctgtcctgggcgctgagatcgagttgagcacgtcgctgggagtagtgtcaggctctgagcttatcgctgaggctcaaaagaaggaggtggtctcgtacttggtcccgcaacattgctttgctgatgttttttcaggacggatgagttggctcccttaataaccagagaagggccaggtgcagcggttcacgcctgtaatcccagcaatttgggaggctgaggccggcggatcaccggaggtcaggagtttgagaccagcctggccaacatggtgaaaccccgtctctactaaaaatacaaaattagcccagcattgtggcaggtgcctgtaatcccagctactcgggaggctgaggcaggagaatcacttgaacccaggaggcggaggttgcactgagctgggatcacgccattgcactccagcctgggtgacagcgtgagactccgtctcaaaaaaaaaaagaaaaaaaaatacaaaaactaaccaggattggtggcacattcctgtaatcccagctactcaggaggctgagggcaggagaatgacttgaacccgggaggtggaggttgcagtgagctggggtcacgccattgcactccagcctgggtgacagagtgagactctgtctcaaaaaaaaaaaaaaaaaaaaaaagaaaaagtagaaggaggtggtctcatactcatacggggtcatgcaacattgctttgctggtgtttttttcagggtggatgagctagaatcccttaatagccagagaaggaccccactgatagccctcctaaagtcccacctccctctgctccactgggaaacaatcagtcagtctttgtccggtcaaaccgtcaccattccggctccctggccaaggggaagctctctccctctttttttcttttttttttttttttttttgagacggcgtttcgctcttgtcgcaggctggagtccagtggcgcaatctcggctcactgcaagctccacctcctgggttcacgccattctcctgcctcagcctccccagtagctgggactacaggtgcccatcaccacgcctggctaattttttgtatttttttttttttagtagagacagggtttcactgttttttagccaggatggtctcgatctcctgacctcgtgatccgcccacctcggcctcccaaagtgctgggattacaggcgtgagccaccgtgcccggccctccctcttttttttttttttttttttttagatggcgtttcgctcttgttgcccaggctggagtgcagtggtgccatctcggctcaccgcgatctccgcctcccaggttcaagcaattctccagcctcagtctcccgagtagctgggattacaggcgcccgccaccacacccggctaattttgtatttttagtagagacggggtttcaccatgttggtcaggctgttcttgaactcctgacctcaggtgatctgcccacctcgccctcccaaagtgctgcaatgacaggcgtgagccaccctgcccgtccggggaagctctcttcaaagccaggtctcggctgcccaggagacaggtctatgcttttctctgaagatgattttgagggctccaaattgaaaaggggaaggggcaggatattgagaagtatgcggttttcacctcaacaaagggtacagaagaaaaattgtgagctgcagtgcagtggtgcacctctacctcccagatcacacagacaaaatggggtacagggatgatcagaggtgcattcgtgtctggtgggccggggtgactgcacctgtaagaaattttttttgtttatttattttttgttatttgagacggactctcgctctgtcacccaggctggagtgcaatggcacgatctcagctcactacaacctctgcctcctgggttcaagcgattctcctgcctcagcctcccgagtagctgggattacattagacatgcatcacgcttggccaatttttgtatttttctttttatttatttatttatttattttgagatggagtttcgctgtgtcacccaggctggagttcaatggcacgatcttggctcactgcaacctccgtctcccaggctcaagcgattctcctgcctcagcctcctgagtagctacgattacagacatgcatcatgcttggccattttttaaatatttttatttatttatttattttgagacagggtctcactctgtcacccaggctggagtgcaatggcacgatctcggctcactgcaacctccgcctcccgggttcaagcgattctcctgcctcagcctcccgagtagctgggattacagacatgcatcacgcttggccaatttttgtatttttatttttatttatttatttatttattttgagatggagtttcgctgtgtcacccaggctggagtgcaatggcacgatcttggctcactgcaacctccgtctcccaggctcaagcgattctcctgcctcagcctcctgagtagctgggattacagacatgcatcatgcttggccattttttaaatatttttatttatttatttattttgacacagggtctcactctgtcacccaggctggagtgcaatggcacaatctcggctcactgcaacctccgtctcccaggctcaagcgattctcctgcctcagactcccaggtagataggattacaggcacccaccaccatgcctggctaattttgtattttttttttagcagagatgaggtttcaccatgttagtgaggcttgtctcgaactcctgacctcagatgatgcgcccgcctcggcctcccaaagtgctgggatgacaggtgtgagccaccgtgcctggcccaatttttgtatttttggtagagacggggtttcaccatgttggtcaggctggtctcgaactcccaacctcaggtgatcctcccgtgtcggcctcccaaagtgctgggatgacaggcgtgagccaccgcatccggcccatggtggcaaagttttaacagctcaccagaaatttccttgtgggcaaaacatagggcaggcaggttgctttcatctcagagccatcttagttaagaaccaaaaacagggaggcaggtttgctgggcccagttctcagcttgactgttccctttggctaaatgcatttggacacccgaagagatttaatttcctttcacatgtccgtcaacgattcaccgcagacgcaaacctgtgtgtctctccaggttctgacgacgggaacctcggctctgtgtacatttatgtgctcctaatcgtgggaacccttgtctgtggcatcgtcctcggcttcctctttaaaaggtaacctgtgaaacacctgggcctccccaatgaaaacaggccaggccgggaggaaagcgctttgtccagtctctgtctctgtctctgagaaagagaaacacagccttggccgggcgtgttggctcatgcctgtaatcccagcactctgggaggccgaggcgggtggatcacgaggtcaggagatcgagaccatcctggctaacacagtgaaaccccgtctctactaaaaaattagcccggcgtggtcgcgggcgcctgtagtcccagctactcgggaggctgaggcaggagaatcgcttgaacccgggaggtggaggttgcagtgagccgagattgcaccactgcactccagcctgggcgacagggcgagactccatctcaaaacaaacaaaagaacggagaaaacgggagatcctacaggaatacacagtgatgctcacagggaatctttctagaatcttccctcagcccctcgggcacagggatgggaatggaacaggcagtcagctgtgggcagcttcagggagtctgaagtcactgctgttgaagggctgagctccagaggggaaacgcctgccttgatcccactagccttgaagagcgtggtttctgggttggaggtgggtttttttttgtttgtttgtttttttgttttttgttttgagacagacttttgctcttgttgcccaggctggagtgcagtgttgcaatctcggctcactgcaacctccacctcccgggttcacgccattctcctgcctcagcctcccgagtagctgggattacaggcatgcaccacgatgctcacctaatttttgtatttttagtagagatggggtttcaccacgttggccaggctggtctctaactcttgacctcaggtgatccacccgccttcgcctcccaaagtgctgggattacaggtgtgagccaccatgcctggcctagttccttaagatgtttgtcatttggtgatttttttttgtttttttgagatggagtctcactctgtcacccaggctggagtgcagtggtgcaatctcggctcactgcaacctccacctcccaggttcaagcaattctcctgcctcagcctcctgaatagctgggattacaggcaagcaccacgatactcagctaatttttgtatttttagtagagacggggtttcaccacgttggccaggctggtctcaaacctcaagtgatccacccgcctcggcctcccaaagtgctgggattacaggtgtgagccactgcacccggcctagttccttaagattttcgtcacttggtgattcttagtgaagttttgcatagttgagcgcagacaccccgcacgcagcatccctcggcacagggcgttgatggaaggaactctggtgacccggggttcattctcttcacactttttctctgtgtctcaggttccttaggatacagcggctgttcccgccagttccacagatcaaagacaaactgaatgataaccatgaggtggaagacgaggtaggcaggggtgggcggagcagtgacctgggatggaaggtggggagtggggagcgtgggacacggcctctgggtgtcgaccatcttgcttctccaccagatgggaccgcagcgtcaccaccggtgtggctggaatctgtatcccactcctgggccttctcccgggtcggggtcttctccaaggttggggtcagagtcatctctgtgagctccatcaggagaaactgaggcagggtggtggtcaagaaaaggaggagaagacggtagagagggccaggcacggtggctcat

SEQ ID NO: 2455 - DNA, 41136 bp, Homo sapiens; identical to SEQ ID NO: 2452
  source 1..41136: mol_type = genomic DNA

SEQ ID NO: 2456 - DNA, 41136 bp, Homo sapiens; identical to SEQ ID NO: 2452
  source 1..41136: mol_type = genomic DNA

SEQ ID NO: 2457 - DNA, 41136 bp, Homo sapiens; identical to SEQ ID NO: 2452
  source 1..41136: mol_type = genomic DNA

SEQ ID NO: 2458 - DNA, 41136 bp, Homo sapiens; identical to SEQ ID NO: 2452
  source 1..41136: mol_type = genomic DNA

SEQ ID NO: 2459 - DNA, 27258 bp, Homo sapiens; identical to SEQ ID NO: 2453
  source 1..27258: mol_type = genomic DNA

SEQ ID NO: 2460 - DNA, 41136 bp, Homo sapiens; identical to SEQ ID NO: 2452
  source 1..41136: mol_type = genomic DNA

SEQ ID NO: 2461 - DNA, 41136 bp, Homo sapiens; identical to SEQ ID NO: 2452
  source 1..41136: mol_type = genomic DNA

SEQ ID NO: 2462 - DNA, 26805 bp, Homo sapiens
  source 1..26805: mol_type = genomic DNA
gcctagaggctccagaagaagactggtctctcccaccacacagaggtatggcccggcgtccaggagcagggctgaggggtggggtcagagcaggggggaatgtggggagtccaggatgaaaaaggacagggggagcctggggggcgtcctgtgggtagctgtgccctggggacttggaggagttagggcttggcctcttaggatgacctgagcccagactcctagggcggccagtggatggggaggcagccaggggtgccaagctgcttgggtgttgtaggagagctctggggaggactcagcctcgctagcgggatctggttggtcctggtgggaaggacgcctagtggggtgaagagagctcaggcctgggagtcaggcacctatagtctgtcttcgctttgtcactaagatgctggtggtagtgagagcaccccctgtccaccctgggcttctgtctcctcatctgtggaatggggagcatggatagtccctgacatcttggtttagaaagagagagaacgcatgctcgtgtgtttgcccgtgtgtgcatttgtgtgtgtgcctgtgtgtgtatgtgcatgtgcggatgtctggggatgcaggagtgcagagagactaagaggcagagggtgaaacctggaagcttgctgcgctgaggcccagagctgggtgcggtgtggcttgagaagctcactttgaacttgagaaagagcccagcactttgcccagagacataccaggcactatccagcaatctctctctctctctctctctctctcagtctctctctctgtctgtctgtctttttagttatgacactctgccctgctgatttgggttgctgatttgggttggggcccaggtgtgtgtgttctgtacccaagtatgctggctgggtgggtgggtatctggggtgcctgcttcagggtgtgtgcaggtgtgtgtactggccctgagaatgaaagggcaggtgtttcactgggaccttgtcagacaggtgctagcgacaagctgcatatgtgcaatttttagtcttcaaaaaccctgctgttatatttttgtacagcccaattctaatttttttctatcatctttcctgctttgtaatcattttataatgagtaaacatttcctattagcttttggtcactctttttttcatccagcagttttatttatattgttccagtatacagatataccaacaccacaggataattcatgagttgtataaggaatgtatttaatgctaaacaagcaactacacagaaacctaccttcatgaaaattagaataatctagaattatgtagcacaagagacaaagtccccagcaatttcttttccctagttccatagcttattcttttcaccacatgtattcttccagaacattttctaagcatgatacaagcatatagtttttcttttcctgtttgttttttgttttgttttgttttgtttttgtgacagagttttactcttgtcgcccaggctggaatgcagtggtgcaatcttggctcactgcaacctctgcctcccgggttcaggtgattctcctgcctcagcctcctgagtagccgggattacaggcatgagccaccacacgtggctaatttttgtatttttagtagagacagggtttcaccatattggccaggctggtctcgaactcctgacctcagatgatccgcctgtctcagcctcccaaaatgctgggattacaggcttgagccactgtgccaggatggtagtttttctttttacagaaatgggattattttatttatatatatatatatatattcctaattttttcacttaatattgtattttggaatatttccaaatttctacaataatacatacagatttaactcgttaagtaaccctaagaaatatgtggcatttattaggatgggtacaccacaattcatctaatctcacgttgatcgacacctagattgtttctaatttttccacatctgtgaaagtgtttctgtagcctaaattactaaatgcagaattgctgtgcagaggttgtgcgttagaaattataataggtattgtcaaatcagcctcaaagtagctgagctaagctgacgtccccaaggtagtgcataaagggtccaatttacctttagagaaattatcaatcttctaattttgtccaatattatgtatggaaattctcaatgtcgcgtgatttttttctttccctgattatgggtgaagttgtacattttctatatgtggattggccttttggatttcatttatgatgaatgtggagaaatttttgttcatctcctgttgaattctcttttacatcttaacttttggagtgactcatttattacgtgtattaataatccatttatatatgttgaaaatatattctcccaggttatgacttatctttttctttaccatgtttaagatgtcttatgtcatataaaaatgttttcattgttaagtcaaacctgtcattactttttactttatggtttctgattttggtgtcttgtaaacctctaagatcacaggtgtcttgtaaacctctttttactttatggtttctggtttggtgtcttgaaacctctaagattacagaaagagttttaataattttactattttggttttgactttgagatttttagcccacctagaatttagagaagtgagtaatgtgtaaagtaacttttaaaaataattaccatctaattgtcttaacattgctaattatgagtgtgtgatttctcctctcttcaatgatttgaagtgcccctattacatcctaggcttctatacatacttcgttattttctttattgttttctcttccatttggctgtcactacattccttattatttttctaacgaatggagcaagtctctcatctctggtttgttataatttagaatcagtttgccaaggccaggcacagtggctcatgcctataatcccagcactttgggaggctgaggcaggcagatcccttgaagttggacgttcaagaccagcctggccaacacggtgaaaccccatgtctactaaaaatacgaaaaattagccgggtttggtggtgtgcacctgtaatcccagctacttgggatgctgaagtgggagaactgcttgaacccaggaggcaaagtttgcagtgagccgagatcacgccactgcactccagcctgggcaacagagtgagactccaactcaaaaataaaaataaaaatcagtttgccaagcccattaaattcctttttggaattttcatgttgattgcattgaatttagagatgatctgagggacattgaccactggaagtaaagacaatagtgagagcctcctgtgtgaggctttgacaggaggacactaacgtgcccccttgactctgtcatcgcctttggtttctggcagactttcagtgatgccaacgtttccgccactgcttcatttgccagggtttgtttgttcatttaaccagaaatgtcttgtttattattaaatatttaggagtgtctgtcaagatcagcttatccttttttcccttttaatccgttcatctgtttgtttgaatcataaataggtttcttaagggttctccttccatgtatggagtaccctctacttggccatgatgtcttcttcttttaaaagtctttgtcaggttgacctatgaaattgtttttgtctggagtgaatttgtattttgcttttcccccctagtttttatccctgccattcaatttcttcataagcttgggaatgtttatccctgccattcaatttcttcatgagcttgggaatgtaatatgtgcatgtttattttgagtaagaaggtgtttggtttttctcttctcttttctctctcttcctttctctgtccctcccatcccttctctgtcatcctcctgtccccatgcttactcttcattcttagtgatttttaatctttatgtttttagggatttaaaatgtattgaacttatattttctgggtcgggcacagtggctcacgcctgtaatcccagcactttgggaggccaaggtgggcagatcacttgaggccaggagttgagaccaacctggccaacatggtgaaacccagcctctactaaagatacaaaaactagccaggcgtggtggtgcatgcctgtagtcccagctacttgggaggctaagtcacaagagtcgcttgaaccccggaggcagagattgcagtgagccgagatcatgccattgcactccagcctgggtgatggggtgagattctgtctcaaaaaaaaaaaatagtattttttttaaagaaaccatatttgctaccagcatttgggtttatttagcacatatatgatcttccaaaacaagaggagatctttagcaagttttcagttctcttccattctccaccccagcctcacagcaaactcccacattaaaatcatctgagttttagttcaatattcttctttaacttatctgtaagtgttacaggtttatttacctcagtatttcagctttcttggatttttttttcctgaaatataacctagagtaatttctttcagaaaagatctgaaaaactttctttgtccttacatactcaaaattttttgtgtcctttaaatgtcaaagaaaacttggcattttgtgattctaggtttaagcataattttcccttggtattttcaagacatctatttaaagttcagagtctcttatgtgaaatctttagccaatctgacccttgttgcattcaaagtatcctatttgttttcttctggaagcatttctgggatcatcctcatattcttgcaagacgaaaagtttaccagtgagaactaggcatggctttattaaaaggaatcttgggagttaaccctgatctctgtcccctactacaaaacctcatcgtagtagcctccccccttgaatacagattccttactgtctttgaaaaatattttaaaaaggagtcttgttctttattgagtggcctcttgtctccttgaaagccctgtgaagctttccccatttgctgttgtatctgtttggctgcacatggaaaatccctaagcaacagaggcttaacaacatagaagtttctttttcccagcatataaaagatgcccagaggtagcagtttcaggctagtatggttgctccagagtgagagtgggaatccagcttcctctctttctgttgcatcatcttcacatatggcttccatcctcaaggtaacctcatggtccaaaatagctgctgaagctccagctatcacctccaagttgcaggctggaagaaggaagaaagacagagggacaaaaatgaacccctcccacctaagtcaactgccattgagcagccttttttggaagacatacacaatgtttctattctcatctccttggatcacgtttagtcacttgactgcacctagtggcaacggagtataggaaggaaatagacctttttattctgtgtagcaataaactcagctaaaaccttggcttctgttgccaggaggaaagggacacggtcttccattgtctttcagactaggtagctgacattgtctgccatacctgctcttaattctctccaccccctgcttctgaatgctggaatttttgaatttctttcccaaacctaaagttttctctaagacttttcatctccttgactatttgctctattttatatatctatctttttcatttgtggtatccattctgtggtttggcccactattgattgttgttgtttttttgtttgtttgtttttttgagacagagtctcaggctggagtgccatggcaacggtctcagctcactgcaacctccacctcccaggttcaagcaattctcctgcctcagcctccagaatagttgggattacagacgtgcgccaccatggccagctatttttttttttttttgcgtttttagtaaagacggggttctaccacgttggccaggctggtctcaaactcctgacctcaagtgatctgcccaccttggcctcccaaagtgctgggattacaggcgtgagccaccgcgcccaggctttgattgatttttttttaaattatggatctcatatcttcaaattccaagaactctgttctttgcatagaagtgtcttcttttaaatggctatgattctcaaatctccctgaggatgctgatttagatgtcttaatgtactcttttatttttgctgtatctgtacatgtctgtagaagtgtctgctgggttagcatatgtcagaatagatgtgcgctgttttgacatttgggaaactgaatcactattggcatagaggtcagggacagagtctagaggcagcccactgcgggctcgaatctcaacctgttccttaccaaccgtgtgactgtcgaccaattacataacatcccacccctgttttctcatctacgaagtggagcttctagtggtaacctatacatagatgtattcatatccgtaaaaccttttgaataatgcctggctcatggaaaacactgcaatattgtcagccactatcatgaattctctctgtgtatgtgagtattgtttgtgctctttgatgatattgatttgttttaaccttttaaagtaaaagacactaacctgtcctccataattctggttggtatggtctatatgttgaagtgcacccaagtttatgttgcaacctaatccccaatgtgagaatatctggaggtagtgcctgtggcaccctataaaataccccagcgagctcccttgcttattccatgtgagattatagggagaagactgcaaggaacaggccctcaccagatagtgaatctgcccgcaccttgatcttgaacttcccagcctccagaactatgagaaataaactttgttactagtaagccactccatctatggtatgttgttacagtagcctaacggatgagtacattggtgcaaagattttctgtttgcactccgtcctttccttttatggttcagtcagtttgacaaattacagaagatttcacttttatgtacttctgccagcctttgtctctgtgatgtctcctatgcttttaagcttaaagagttcaaaggcattcactcctctggtttgcagctttcataggatgtaacattttacatttaaatttataattaacttgttatttggggaatggtgtaaaatggggttttagataggcatttttatgttgttaatcaatgattttagcatttttttaaatttaatatttcatcgcttcacattgattcctgattccttctcagtctggggtcaagtagagtttgtttccagccagcatgtccattgatagattctgtgtgtgtgtatgtgtgtctgtgcatgtatctgtatgtgtgtgtgtatgtctgtgtgtaggtggtatatgcgagtgtgtatgtgtgtgtgtgttgtgcatgtatgtgtatgtgtgtctgtgtatgtgtgcctctgtgtgtgaatttctgtgtatgtgtgaatgtgtgtgcatgtttgtgtgtatatgtgtatatatgtgtatatacatgtatgtatctgtgttgttcatgtgtgtatgtgtgtctgtgtctctgtgtgtgtgtttgtatgtgtgtgtgcatgtttgtgtgtgtatatgtgtgtatattgtatgtatctgtgtgtgtctgtgtctgcctctgtgtgtgtgtctgtgtgtgcatttgtgtgtatacatgtgggtatgtgtgtgcatgttttgtgtgtacgtgtatatatgtatgtatctgtgtgtgtctgtgtgttgtgcgtgtgtgtgcctgcgtgtgtccgtgtgcttgtgtgtgtgtgtgtgtttgcatgggcatcttgagtgaagcttccaacaatctaacagaagaaaaggagccacacttgtctgttctgctctcttgggtacttcccagaccagtgaaatgaaagggaggaaacccccggcctccgaggagaaaagggaactggcaagcagagggtggggggatgacggtaaaaggagcaggggtggggagagcacaggccctgtggaagtgaggacatgtgtgtgtacatgtgttcatgtccaggggatgacactgtggcatccaacagccgtggaccagcagcccacggggagcttagtaggagtcaaatcctaggcccctgtctcagctgctctgctgtctagcgcattgtgcagtggtaggtgtcagtgatccaagtggggacccagtccctcaggccacacagcgcatgtccattgccttcatgccgcaggagactgagaggtcatgcatgagggccacttctctgggttgtccccacaacacgggcggtgtccctgggacacgtggaaggggaggggcagctcactgctgacatctccttctgcaggcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaaggtgagtcccgtggctcccacccacttccctgtccctgtcctcactgctgcaccctgggggagggccgcagcgtatcctcaggatcctgcccgccagccctcctcctgctcccctccctctgtctctccccctggccttccctgggcctcccccgcttccctcctcctgcacattcctgctcatcctgtcttggaaagtccagctgagcgtgtctggcttccttgcccacatttctcagggcggcactcccggcccctaggctccaggatggctgctctggccgtttccctgcccctccttccccagcagacactctctgtgcctcagtggttcccacctccgggactttgctcctgcagggccttggctggggttctctccctgcttcagccgctagcaccctccttgtgcctgaagcccgcactgggatgctcctgggctcttgaggtgaaatggcccctcccaagggctcccagagacctggcttctgtgataatgctgggaccacagtccccttaacaaataccaggctcctgaggacggggactagagaggaggtgggaggttgcagggtagaactctgccacgctgcatcccagggctgagtgtgtgccccctcccaggctgcacagtcggtccaggggccaggcctgtgcttgatgcatgtccctgtcctggggtggggggaggggaccgtgcccaggaacagcacactgcggaggcccagaaaccatgctgagaaccaacagaatgtcttgcttctgccaggagaggagggtccgcaaccaggagcccaccccggcagacatgaacacatgtacatgtgcctggccacctggtgcctctgcagggacctgggagacccctccccagagcgggacatcccaaagcagctgggggtgatggtgacaagggtccctgcaggaaagagaggtgacccccttctacccctcttgtcagaaaccatcccgctgcagaccctgcgctgctacaacgactacaccagccacatcacctgcaggtgggcagacacccaggatgcccagcggctcgtcaacgtgaccctcattcgccgggtgaatgagtgagtgatgctgggggcaggggccacgggcaggggctacgacgtcccctgtgcctggcatggggcgacagtgtagagagggacctgtcaggtcagcctcggggtgggagtggacagaggacagaggaggagggaggccctgcaagagctcctgctccgccaggcacctgcgaggccgggtgctgccgtctgacctggggtttctgcggagtgcctcctacactgatgttggtgacaatggtggtggtggcaatggtgaaaatcttctcttgtttcatcacaatttaacacaattgccccacatgacctatcttagttcctcctcactgtgaggtgggcagggccaggccacgaagccccagctgtgccactgcctgcctgtccagagtagaccaaggagagatggcgctagcctgggagttcacagatgggaaaactgaggccctggaggtgaggtgccagccctggccacggggtagacagtggcagagcaagctgtgtggacgtgtctgggagggggctccgcgctctcccaggccccccctccgtatgtgggctgccacctctcccacccaagctctcctgggcacgtgccacaagggaaggggaccagaatcgctctggggtgttggccagggtctaaatcagccataaattaagtaattaaatagctggaaccagagaggcagatgacaacccattggaggtcaccccagcgttggggggcggggccggctctgccacccccacccctccaccgccttcagttctccagggcgtctctgtcggaccttctccattctcctcaaagaccatcctgcccctccctgtgacctgcttcctgctgctctgacacaacaggggaccagggagaagctccccacccaccccacactcacactccccaccccctttgcccaccgccggggcctgggcctggaccagggctcctgtctgaggcctgagacacgatgctgtctggtcctgttgctcaggaacatcacggcccccaagtccccactctgccctgtgccacccaccatgccctctcccaggatctttcccaattgccttgcaaacctgccccaaccccctctcagatgcccacaggagtgcagcgcctgggcatctcctgacctggcaaccctgcggcccctctttctctgcttcctttgacagcagcattccctaaagagttgtccacattcaccacgtccagtgtctttccagccatttcctcctgggcccactcccctaggatgctgcccccaccaggccacccaaactgctctggtccaagtcagcaaatgtcccagggagcaggatctcatggttgggcctccgccttcttcctacttgaccaggggcagcccctgacaaggaggaccaccgcggcctccctgcagtttctcttgcacctgactctgcccacagctcacccagtgcccccggggccctgcccatcctcctctttctccttgtctgctgcctcctgatggcaagacacccaggcccagtccatggacctcctctctgctgtatccactctgcagagaccccctcaggcccctggggcatctcccaaaggtgacctcaagcccacaattcccctaagctccagccctccaggcgtactggcctctccacctgtcacttagacaacaggtgtctccgactccaaacgtcctcaaccaaagtcccgctctcacccgagctgcgctgctgcctctgtcttccccatctccctttctaaatgggagctcctagtggctcaaactaaacaacagggaggattttgttttgtttttaagtctcttttgtcaccattccttcctgactgctacatccctccaccagcaaatgctgccaaccttatctcaagcagaacatgaatctcacccacgccagcctgaccaccctgttgcacgccacttcctgtcacctgaatattccagaagcctcgtaactgggctccctgcttccaacattgccacattcccacctcagtctattcgcaaccgaggaccctcaggaatcctttcaaagcatttatcaaaatctacaacacctctgctcatgactgtttcccactcactcgcagtgagatccaatcccatcatgtagatggatgggtctcctagacctccctatcacacgctctactccctgcgcactggttttaggccaagccacgcagcacaccaaactctgcctgtcccagggcctttgcacgtgctgttcccatttcctgaaatcctcacaatttgcacagtccctccctcaatgcctttaacattctgcccccaggtcacctccttagagaagcctgcttgtcccatatttcaaattgcctccctggcccagcccttcctccctcctcacctgcttcttgctttatttttccacatgaagttctctccactgcacacgctacacactttgttccatgcgggtccccttctcccaggatggcagctccgtgggcaggatttttgtgtgttttatcactgctggcccctgattctgaacagagccaggcatgtggtgagcactcgaggaacctttcgtgagtcagtgatacccatacaccctgggctaagccgtgtcctctcccaacagggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatggtgaggggctgggggccctgcccggggcttggtttcctgtgtggacagcgggggcaccaggggtggtccagggagtcttcaaggcagaaggctgtggcttggggttgggtgagggtttcttgagggatgagggtatggtctggttacatggagacttcagagcagaggggcccctgacaaaggcttctcctgtgcccctggctgctaccacctcccactaagccatgggcttccagcactgcaggcttgtcttgaagaaaaccgttctcaccactcacttagaaacctaccaagttagaaaactctgtccgcttagttgtttcatctcatctctgaagcaacccatttcctggatgtggcccttgaggcccaggaggtcagatgcctcctctgaagtcccacagctgagcagtaatgacagagatggggtcagccttcccgggggcttcctgcatggtagacagggagcttgtctcctcgctgccctggaggaggggccccggtgtgggccgaaatcccacagtggtccatgaagccatctgtggtctagggtggggtagatgattattttatgtagttaggttttatttgcctctatattagaaagaaatataacctgcacttcgaagtcctggattcaaggaaatggttgcttagaatgaagctaaacctgaaaagggacacgttttatgaaagttttcgttgacgtggcaaaaacccatgctggtggcaggctggtaggaggtactgcaggctgtcattgggagtctcagaaccacggcaggcttggtgctgttattggtgcctttggctgctgctgaaacggagacagagggaggtgactagtccaaggcctctctactgctgctggcagagctgagatccagtgcaggatggtctgagtccccggtcctaaccaccgaaccacctggtgctctttgcaagggtcacacggaaggggctctgaccatggcttcctgcccttttttgccacaacatcataaagccactgccagaggaggggatcagttaggccaccaggagtccatcagaagcaacatttccacacatgggtttgatggacacgagagtcccttccttcccgaatggagctcagggggcccaggctggagggaggggaaacactgtatgccgtccaccgtgagaacttactgacagtggcgggtgggtgcctcatgcagggggtaaagggcagggcccctgggagatcagaacaggcttcccagagggaagagctttgcaactcagatctgaagggtagacaggaggggagggcagtaagagcctctctggcagggtaacagctgtgcagaggctgggggatcagaagggcatgggcagctggggaacctgctcaccattgtgtccagggagcatcagcttcaagggctggacagcggtgggaagaagcaggagacacaggtaaggacctgtccctggagaggcttctgtctcctgcagtctcaggtagaggggaccctctaggcatggagagcactgaggggaaatgacatgatcagatgtggatgtgagaatgctggggacaggggacttacagggtagattggaggagcattagttgggaaagaagttgaaattcaggctgtggcctaaagcactcattcctagaaatgatgaggacacaactggctaggagatggggacatgagggcatgcaaatcatagttcagatatacacacaattcattcattcaaccttctttccttgagcgcctacataagccaacgaagcagtcaacaaaccagccagcaaccctgcccttggagcttacagcctggaaacaaggaaggtttctaaggcgatggagacaacttagatatagggagagaagtgtggcccttggcctcctggagcctgtgttgagtagcgaggtagggtccagcctaatgcagattagcaatgaatcaaggatgctgggaggtactgggcaggcgacaggcatgcatctgatctgctctgagtctccatgtttggagaccttggacattttacttcctctatgagtttctccgtctgtgaaatgagctggtggactcaagaggtttctcttgagttggctgagcaggtttctgatggggctcccagtctgcgcagtttgtggcagcttccgagagggctctgccgggaagagctccccctccatgacagcctcgggggctgggagtgcagtgacccatgagggacgcctgtcctggctgtgggtgaggaggggcggttcccctgctgtgtgtctgccgttctgggttgatggttcctgacatgctctagcatgccataacccatgtccagcagagagcacttacatcctatgtgtgaggatgttttcgtttgaaagccatccctcagcaagcagacaccagaaaccagaaatcaggtgccgtgtcttcattctgcattttcttgaacaacccagagttcccaggagatagatgcttgccttgtggctgcaaggatttcatgagaagccccaaagttgcttacgcgtatttgttcattcattcactcattcaccttgccccataattcactgagaagccgcatctcagcctggaggtagggaagggggtcaggaccaatcccacccacccccatctcctcacaccttaggggaggcagacacagaagcataggaatccctcagctgtggtaaggccctggtggagggaattccactgagctatggtgaaatgagagaaggaatgagggattccgcctggagatgcagatccgaggatgttcctagagccggaggcatttgcccggggcactgacaacaggaaggaccctgggcaggaggaagggagcttggacagcaggaggggggaggccgctgaaccgcaggcccctctgctagcaggagccacccaggccgcagcgtgggcagtggggagcctcaggacagaggaggctccaatgagtttcctcgccagcgctttttatggagttcgggtcacgtgcgcattgcaatctgcacggctttccattgctttcatgttgaaaccctacagttttgcagatgaagggctgaggctcacagaggagacgggtcttgctcaaggtccctcagctgctgggggcaggggtggcctggaaccccctgtgtccacacaaaaggccatgcaggccctgactgccccccagcggtccagcccttaggtgcccttcacttcctcccctccagtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggtaggaaccacggccagctctgccccagcccgaagggatgggcagcacccctcctccagcacccactgtctcctgacaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggtaatgttgccagagcccaggaaatgccccgtggtgggagggcaggctcatcaggagctcctggcacagcagggttcctgggctccacctgggggcttcccagatctcctgctgccatctttccagtagcgtccctgggccgtcccacctctactgtgaccactgaccagtaggactctgcatctgttcactttgggtttccagttttctgcacgttctctgccaatggcaattacaataataacaacaacagtgctattagcagctgtgtgttaatggaggctacaggatgctcagggcttacccacatttttcagttcaatccccaaacactgaaacttagatactatttccattctcccgggagggcgtgcaggtgcacagaactctctctctctctctcggagctgttggacacacagctggcaggttcaggctgaagtttcagccctggtcttttggccccagagctcatgacctctgtgtgatgaatcacacggtgggcacccactgagagctatgggagggatgaatgacggagtacatgaggacctgtctccaacccaggggatgaggcccagccccagaacctggagtgcttctttgacggggccgccgtgctcagctgctcctgggaggtgaggaaggaggtggccagctcggtctcctttggcctattctacaagcccagcccagatgcagggtgagcatcttttttctccatcccctcccctcctcttggccttgctctctccaagcttcctcctgtccctggggccccagcagaagccacagcccaccctaagctctcctccctcccgtgtgccctccctctccctgccctcagctctgctgtgctcctcagggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacagtgagtttgctcctagcccgctgtggggatggtctgggaccagcacaccctcattgtgtaacccgaatcagttcagggttcctcctggccccgtcttcatgtttgtcactttcaaagagatgcagtccagtgaccaaaagtgaacagagaagcaatgaaaccacgacggcagtggccaaaaacaggagcagatctttaaaacctctgatctcttgtccttttcttctgcttccctctcccatcctgcagctctctaaatctccactgctagccacaccctcctggtcctgtcaccaaaaccttccctttcattcctcattggattttcctctttctgatatccgaaattccccaccgactgatattctatctttaatgtaattgatctatgatgtacttttcaactggagcctgtggtgtgtacaaatagtgttgatccttggaggttaacatccctcgtttctgtgatgtaacaaggaccccagtgcaatggaacctctcacgttgtttcatgatgaccaagttcttccatccagtctttagcatatgtgaagggcagaggccaatttgtcttaattacctgggtttgaatttaccattaactctcttgggatcctcactggaaaaaggaattctgattgttcaaaagcacaggatatattaagggcctcatataatgcctggcacataagagacctcagcaaattacgggcattcatattatgtttatacagtgaaggcatcaaggttataagcattctcttttttcttttgggtagactgaagctcagagaggttgagtggcttacttaaagctgcacagctattagtaggcagatcaagattagagttcagaacttctcactccctgcccagtttctgctttctttaccctttgcctctttcaagttgtgggtctgccggccaggtgggaggtgctgtctgcaaagggcttccctttctctttggccactatctggctggggagaggcctcacctagatgttgttgaaggcctgttacagccgctttattggggattttctggcgatgagaacgtgtgaatgtcctggcctttagtcaactccctacacctctgagagtgtcagacaagagagcccatcacactggtgggattgcaatctttgcctctaccactgcttagctgcctttccttagggcaagttacttaatggttctgtgactcagtttccctgtttgtgaaaagtgaaggttaatagtacccaccatatagggctgttagaatggagtggaataattcatgtagaataagtatgtataacagtggctaaaacatagtcaggctgggcgcggtggctcacgcctgtaatcccagcactttgggaggccaaggcatgtggatcacgtgaggtcaggagctcaagaccagcctggccaacatggtgaaaccccgtctccactgaaaatacaaaaattagctgggcttggtggcgggtgcctgtaatcccagctactcgggaggctgaggcaggagaatcacttgaacccaggaggcagaggttgcagttagccaagatcacaccactgcactccagcctgggcaacagagtgagactccgtctcaaaaaaaaaaaaaaaaaaaatagccagttgcctagaatagaaccaactaacagtggttttatttttactgcaaaaaataaaaataaaaataggagtagtgcaagcactgggccacatcactacaaaacaagtgtatctcagcatctcccacgagaataccactcaggtcaaaacatgatatagtgaagtggggatgaaaaggatccaaccatgggcagaacctggggtctggtgccagtggagacagccccagtgtctagcatgagacacggggaatgttccgttggagggtgggtatgatgactctcctgaaagcttccctccctccagtccagatggcccctccatccctcaacgtgaccaaggatggagacagctacagcctgcgctgggaaacaatgaaaatgcgatacgaacacatagaccacacatttgagatccagtacaggaaagacacggccacgtggaaggtgagggcctttgcccagggaggggagaaacactggggagggcgggagaagggaaagcaaccagaggcattccacctgcaaggcgtcgggcccttggcaggtgaccagtgagaggtagccactgggacgtggtgatcactaggctgtgtggtcagcaggtcactgtcctgtctcttggtgaagtaactgaggtttggaaaagtggcgtggcttggccaacgtgaacagctgaccctgagtccccaggcaacagaagaccctctgggcagggaggggttgaaaggccactgggaagaaggttttcaaaagtcatgaaagtttggggttatttcctcagaggaatctcatctggacacacatggaggctcagacagagctgcttctaatgagtcgggggtgcgcccaggccagggctcggtcccctgcctccacagagcccagaacagaaaccacagaaccaaccccacaccttcagtctagaaatggggcaactgaggctaggagggaggtgggccagtggtggagccaggagcgggccctggggtcctgaacccccattctcagggtccagagtccagtcggcctgcactgcgttcctaaaaaggccacaatatgggtgcaagctgccccagaagggctgggagctgagaaggctcaaaatagggtgggacaggtggcttcagggttctgggcctcagtgttgtcaatgtcaggggctgcactgacaggtggagtccccggtgccatccgaagtgctgtccgtgggtgggccctcagggaggatccacggtggtgagagagaagccgcagcaggcctggggtatggcaggagctaggagccagcgaagccgagggtccaggtgggagggatttgcagctgctcccacgggcaccgggccaggcctcaccctcagtgccaacccacaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcgggtaggtgaaggctggagtccagagcttctggccaggaccagctcatagtttctcactgccagaaaatccccaatgcagcagccgtagcaggcctgcaacaacttgtaggtgagccgtctccccgattagatggtggccaaagagaaagggaaggcctttgcagagagcacctcccacctggtcatcagacccgcaagttgaaagaggcaaagagtaaagcaggcagaaactgggcgtggagtcagaagttctccacccactcttcatgagacagcacagctgggcagaggatgccacatctctgggtgggcacagagatgtggggctccagaccccactccactcaggcctccttccctcccttggaccactagtcgttggaaagtgacacctggtgttcagtacagactgcaagtgaggacttgagggagcagaggagagcaggtctcatgatcgctcctcctttaaactgggacttaggcttctgttaatatggcccttggtttcttagcttttgggactaccaagtttttgtggttgctcagcccgagtttcctgttaccatggaagcaagaaaatctagagccacagactgggtccttggattggaaggttttgctgtgattccttcatcttcccacctccctgcacttgctgcgtgcactgacccctcacctttcaccacagtgaccaccaggcgactcccgcagaacaagacaagtccaaggggtggtttcagagagagtaaggatacaggagatattgggagcaacccaagtccccagccaggcttggtagcggcaggggcccagggagagggccacaaccaggtagaaaggaggccggaccaatgggcccaagagaggaggaagaggggagtcctggaggaacctggcctgggagctcagggctgggcagcaggtgggatcaggggcctctggaggggcctttgctcctgctggtgcctctgccactatgcctttccccatctccacctctaatccttcctattactggaggcccagctaatatgccacctccttcaggaagtcccctgtgattgccatgaacagtggttcttgccctccctgtagcacctcctgtgctatagatcctggaaaggatctgaccctcctgtgtcctcccagcactttgaacactgtgggggttcagaccaatgcccttcccagcatggatctggcctctctcccctaatcccccaaggcagtaagttccagagccctgggcctgcacagagcggggtcttaaggaatactgcaccaaccccactccctgccctgaggtcgatttcccgcccagatgctgacattcctctttctccccggctgctggaagtgctgcctatgtgggtgctggccctcatcgtgatcttcctcaccatcgctgtgctcctggccctccgcttctgtggcatctacgggtacaggtgaggggactctgtggggctggaggtggcagccgagaccccagagggcactggggaatcccacccagctccctccaggccctgctctgccgctcccttcctgggcctcagtttcccctctgggcatgagcatgggagcagctggccatgaggtctctgatggctgtcacctccgtggtgtcttccaggctgcgcagaaagtgggaggagaagatccccaaccccagcaagagccacctgttccaggtaggaactggctgcgaggggcggagtgggggcttctctgttcctgcctctcttgtctctgtccccacctcctccttcccttcctgtgggctttgggtggtagggatgtaggtggactgggctttgggagctttgggagtggggccagcacttggaaattcattcccgggattccctggagtgcccacacctggccctgcctgccagagctctgcatggagcccagtggagagaactgagtgtggggatgcctgggacagggtgggctcacagagggggttcctgctaccaggatggatggggtgtcaggaggcagaagggctccccaaggacaagatacctgggctgagctttgagggtcccagtggtgccaggtggcaaaagttgctctggctcagggcatcttgagggtggagacagaaacccttcaggaagggagctgaaggggtgggacaggaggctgggggccatgttgggaggctgagatgaccatggggaagacaccagcgtgtgggtgatgggagccctatagtcaggcaggcagggccagctttgcctgtggaggggtctcttggctggtgtggaggagaaatgggggtgagcatggagacaggcactccaggttagaaaaatcacaggaaaagggccctgtcctcaggtagcagggacatgggggaagtccccgcccctctctgggcctcactttgctggtgtcaaaaggccgtggccagtcctgaagaagtggagattcttctcttgtctgggggctccttgaatcctcctgcacccccgtcaccctctgccttgcccccacctcggacctcctgatgctcaccggcccaaatgtctctgctcttgcagaacgggagcgcagagctttggcccccaggcagcatgtcggccttcactagcgggagtcccccacaccaggggccgtggggcagccgcttccctgagctggaggggtgagtgggctcgtggatcactcctgacctttggggttcatacggggggctgactccattgtggaaatcagggactcaagtgaggctgcctgtggctcactgtgaagggatccaagggagctggtttgcactaaagcaggaggcacctgggggggatgtgaggaagaacttcctctttccaggtaaggaagtgccagacaaggggagtgaccggaagtgaaagagggaaacagttggccttcccctccctggctgcctcagaggcgtcacactgcagaggcctcatggggtagctggggctgcagactcccgggaactcggcgcctgagccggcagctgaccaccaactcggcagggagaagggggtggcatggttgatagaatgatggaagggttgcccagtgcacaggctgggcatgagcctggtgctgaaggaggatggactttaaggtcaaaagggagagggtaccagccttgcagaggaagaccttgagctcagcatggaggatggagctcctgagccacggaaagactgaatccatgtcccatgtccttctctggggcccctgctccctcaaccctgtcccgttcaggttctctctgtgagatctgggggacatcagggcttccagagaaccatctccaccccaccaagacccttgtgcctgacccggatcatctgcccagggtggtcccaactcttctgcccattttcttcccacagggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccaggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataa

SEQ ID NO: 2463 - DNA, 23275 bp, Homo sapiens
  source 1..23275: mol_type = genomic DNA
tgatcattcgtttattttatttcatttttttgagacggagtttcactcttgttgcccaggctgggatgcagtggcgcgatctcggctgacaacacctcctcccccctccaaggttgaagcgattctcttgcctcagcctcccaagtagctaggactgcaggcgcctgccaccacgcctggctaattttttgcatttttagtagagacgaggtttcactatgttaccaggtttcactatgttggccaggctgctggtctggaactcctgacctcgtgatccgcccaccttggcctcccaaagcgctgggattacaggcgtgagccaccgcgcccggccatacatggcaagtttctacatggtgtttcagacttagctgatcaccctctaccctcaggccagattagattccacttctccctgttcttacagtgccgttagtgctgaaaggggaacgtgccttgttcatttggttctgcacagggtccagcccagtgcttggcacaaacgtggtctcggcagtgctgcatccctggcttgacctggaggtagcaattccttcaagccatttgctcatcttacattggttcgtgggccatggaatggtgtcgagagctttctgcctatcttccaaggaggtttaggtcctgccaagagctcacagatcctatttcttgccttatctctggcatttatttcttccttaaccagcctagcttcagtgctccagaaaagtgccctgcccttccacaccaggatccctagcgactcccgaatgatgctttcttggactctgttcacatggcctcagcccttctgcaccctgctgcacgaaacctggtgccaggccaggccaggccagccggatccctgcttactccttaccctgacatcccgctggtggagagggatggaggtaactgcaagtgaaagaccagttagaggaccgcatctggaagctgtgccaaattttaaatactgtatatttaaatatatatttttatattatatactatatatataacattatgagccaccaaacccaaagaactataatgaagagccaaacaaaacaaagtggctcaggttctaggggacgtcctagggtggagaaagaggcctggaaggtgggcagccccttccatcgagggtggggcggccgcctgacccagtccacctgcaccagtggggtgtggcatcagttaagcaaaggacccttaggcctatgcaacatttctgcccctaagttagagaaccaccttttagagtggcgatctcatgggagtggcagcttgactctgcaggaaatgtgggtgctatgagtgcagaacagaaactcttacgcgttctgatataaaaacaatacatgaaaggatgtggatttagccgcaaaatcacgctgtttcaattgaataaaggcaccgctgggattcgaacccaggatctcctgtttactagacaggcgctttaaccaactaagccacggcgccgaagctgccataaaggttcctgaaattcatctacaagaatatagagctaggaacccggaccgagctttttcagatctttctagaactaatttggtaactcaactggctcttgcatcacttgtccattcctcggatttccttcaatgtccaaagacgttaatcatagatttcaaaccaaaatcatagactctaaatcaaattctcgattctagagttcctagatgagaggtttggagggtgccgactggatcatcccatcctggagagaaatatggtcagtatgctgaagaaaaaaatatgacgtagtcggcaggattcgaacctgcgcggggagaccccaatggatttctagtccatcgccttaaccactcggccacgactacgaggcttagggcttcgttttcatccaatgcctttcttacttcccttgactgacaaacatctgcctccatgaaagcgcttcagggaaaaaaagacgcggcggttgcacgtgaaccttcctttcacccgggtgcccagagactcctccctccaagccttcgggagcgctagtgattcagggaataggaagcagtaggtgcaatataattctgttaccagaaggcaactggctccgggtagaaacttccggataacagcagagggtcagaaaacaaaacacacacaaaaaaaagccacccactggcccgtacggggttcgaacccgcgaccttggcgttattagcaccacgctctaaccaactgagctaaccggccactaactttccgggtctacttcaaatcttaatatagggtattgctaccataaaagcagcataaatcccaacatatgggtttaaccacgctctaaaggtctcccaaacacgaacaaatcctaacagccaggaagaaatggcctcccagtagctctgaaagatgtgcctcagctcatctttccacctctccatctatcagtccccagtaaagaaatgcagcaacaccagccaaaggcattggtatctccaaagaattgttcctagatcccctaattgtacggttgtgatttcggagcaccttctggtctcaaggtatatcgatcaaggatctgccttaggccaggcccttgggaaacctacagggctaaccgtagcctggggccctatagcacagtcacccagagtcctcacctgcccctgcttgtgcctggcacttgcctccccctacaccttctttgtgcttgtgaacacctctaggcattcatatttgacttcctgcagggcccagccttactgactgagaccatcatagctatgctctctgccttgccgccaactccccaatttacttcctttacagactgattttggtaccatttcttctgctggacgaaaagctcttctcttccaaatcactttccacctttggccctggcggcaaagggctgaaatgatgatgaacgactaggagttcctaggaggtggacaactaggagtcaggaggcctgggaccccagagatgagtaccagtgagaaatgacaccagagggcttcattgcaggtcaataggcctgtcaccatcaccccacagcgagcaagtcttttgttccctcagctcctgcgacaaagtcagaacccaggtgctcagggccgcctgtgaatgcaggtgccttgtcccaatcagaggacatattaatagggccatgatttcctgttgccacaattttgccaaggcaggctggcaccagaacaccaaagaagggaaattatagtggagtagcagtttgtgaatctggagtccttggttcaatcacagaacaagtagggagaggagccaggacctaggccttcaggttttcagcaaggaaggactctcaggccatccttgcagttcagttaacaggaggaagcaaggatccccagagagctggagtactctgactctcggatagaaaggcaggacaatcggagcctggggttcacgtgagtcaggaaagggagctctccacactggaatcgctgtagccgaggaggttctgaggtgggaagagaggaaaaacacacgtctcaggcatgtggcttttagttcccacccaccattctcctccctaactccagaaattccccatcagtccctcatccctcttcctcccagggacccatctatctctatcaccatgatccccctatcatcatgatccccccgtctccaaccttacctaatgggacgatcttcgacggtttcctttccagctcaaaagaaagcacaataggacggaggacagaggggctagtacaaagtgtccagaggaacatggtcatgggctcgtcaaccctggctgaagactagaaagagaaggtcaaggttaactggctcctaaaccctttgccaaaagcccaggaatttgggtatccgagtccctccctcccagccacattacacctcaagttgggctccaggccctgcaaactgcaagaccactctgcctggcacttggacgaaatctaggagggaggcccactctctaggacacagccctagtgctgctgccacatggtgattcctacaggtcaccacggcttcggcagtcccatcctccaccaggagcctatggggagcaggaggaaataaaaacgcctatagcaacccaggttgccaacaccctggacccaacatgcctccctccccgctgtctgcagtctttggctcacagatttaggagcttaccctcattcattcgttcaaaaaatattaagcaattctcatgagccaggaattatgctaatgtagaaactgcagatagacaaagtggtctcataagtaaatggcacaatgggtgcacgccttgtgctctcacctgatgatggcctggcttatagctgtctgcgtagggcaagtggagcccaggcgagtgcactttccctgggatgaagacagtggttggaaaagtcctcttggtcccatcacatccctctggcactccatactcagttcagcctgttccttccctcccttacctgccggcagatgctggtacaataagcacacacccagaagagctgaaggctgaagacagagacgatatggcaagaggcagtggcctggaatggggactgaccaccctgcagaagttcagccaggtagatgtggggcaggggaatgctaaataaatacagggagacagagacaggggtcaagataacagaacaggcaaaggggttctgaaagcagggtgggtctagaaggacttagagggcatcaggatggggacagcagtgggttccatgcgctcctagaagccccattttaattcctgatctctgatagtcattggttatttttcaggtttgaacaccatgatgttagccaagaaatatttgcatgttaagactgaaaagccttcaaaagcctagaacactaaatgattctgggtacaatgatagacacagagcattttttatttggagtagagaagctcctctgactcaacacatcttgttgggattggagaagactgtaatgatggcaaaatcttcagaaccagggacatgtgggagatgcagatgtgaagccaggaagtttaggggttggggtctgggcactgacctgatggtggtctcagggggaaaactcaggacctgcacataagtggatgaccggaaacaacaataaacattgtgagatctgcaagtggaagaggaatagtgagtgaccaggaagacaaggcaaattggggtagaagctgggactcagagatcaagcaccacagagtggccactccccctgagggacatatcctagccatggctctaccaaagctaggggaagactaggaggaggaccagcctgcaacacctcgtgagggtactggctgggcacaaatggcagactgatatatggaaacctgtatgaaagagaaggggtcgctgcagcaaagttaagcaggggtgcacattccagagagccacatcagtagcaagaggaggcaggtgacactacacatcttcacctggaaacccttttctccaactggctgaagtggacccgggctcctggaagtagtcctagtgagggaggcaagtgtgggtcttctatatatacatccaggtgaggggggaattcacattcagcagtctcaagagcgactgttagcttcacacaccttctcatggcccccgtgttccctatagaaggaaggtgggtgttagtaggatctgtgaagtccacaaagtcccatcactctatttcataccttccccacaaaggaagggtcattacccagtttcatccagagagacgccacaaggggttcacatagtgtccgtgacaaaatctcagcggagaaagacaccaaggaatctgtgaaactggaaggtcagggaaatacactgagaatggaggcacaagaaagcacagagtggagacagtcagattcaaggcagaaaatggagctaaagtatctgctagaacttcatatataaagtcctgaaaaaacctgagctctgccacactgcacactaagagtaacagggcctatgggaaaaagagggttgtggcagatcattcaaaacccgcacaaggtggctcacgcccctaaatcccagcactttgggaggctgaggtgggaggctcacttaaggtcaagaactcaagaccagcctggccaacatgacgaaaccctgtctctactaaaaatacaaaaaaactagctgggtgtggtggcgtgcacccctataatcccagctatttgggaggctgatgcaggataatccttcgaaccagggaagtagaggtttcagtgagctgagatcaggccattgcactctggcttaggcaacagagtgagactccgtctcaaaaaaaaacaaacaaaaacaacaataacaaaagaaatacctcctgcagcagaaaatgaagtcttcaccaaacccagctagcttgggagaagagagagtggccaaattaaccagaggggcttggtggacatttacttgtcactgagcaggtcggtcagtgaggattcaggcaatgacttgtttgcatccagcacatcttggatatcctgggagctttcaagctccagagtccagttgtcctggacagtgaggcaggatgcacagccagccaactccagaggacgccgagatatgcaggatgaaccatccttttcaaacaacattggtgtctgcacggaaatgggaagacgactgcctgtgagtgtgtgctagtccagtgggaggttcacaaaacattctgacccaattttgttctttctggagcatggagaaggaagtgtgtcaacacacacaggctttctggtgtatctaaatccagccttcttccaggaggcctagagaatgaccaggcactggcatgccctctttagaccccaaccccaaaaaagctttctggggaaaggtatgatgaagtaggacactcacagcggggccaggagctatgagtcggtacacctgtcccgggtgcaagaactcaaaccagcggactgaagagccaaagaaaatgaggtgaacctgggaggatggagagcaaagtgctgggatcctagccagaggctcagggcgcaggtcaggtcctgggtccctggagtcccagtttaccttctgatcattgtcgtcatttccctggggctcgggcagcccccatccagtaccctccttcctctgggtgcccccaagccagctccccaacacatagaaactgagggcgggcttgggcacctctggacttgctcctggggggacacaaaaattacgcttcatgagggcctccttgtggcagagcaagaagagccggctctgtcctaggtggggtccctctgggccggtgggatctgtctgaggtgttgagggtgttgctgaatgaaggcagggtctgggcacaggcaggatcagggcatcagccagaaagaactggacatagactctgttgggagagacaaggaatacatttcttagtgatgcaggcattgggtattttggtccccagcatcccactccttccaccaggcccttccttccccccagactcaagacaaccatgaccccaaggagccaacctggcctgctgcttctggatgaagcctggcatgctcagctccttccaggaagggaagctgcttctcacgtccctctctacgatcaactgaaacctctctgcccgcaccaggcagcctagaggaagaaagttttctgttttgacaagaaaggagacctgtggggtgggttgcaaggcaaaccatcctaccggcctcactacccatcccaggccagagctgctgccctcacatgacatgaaagcccacacctgacccccaccttagaggggtgacaccttctctccaaactaagaatgtaggagacacagttgtaatcctggagtgcatgttaggagctacggtggagaaatgcatgctggaaattctggctaggggtcctcttgctcctgttctctgcctgccatacaagtctcccagaagttgttgattgacatgtgtcacttctgcatctctagtaaatcccagcaggcttttcctcccaggctcccctggctatgagaaccaccatcccactaccatcttctttccacatctgaactccaaacctatcagccgtgggtcactgaggggttgagagtgcttggccaggagcaggcagggcagggaaccactttggtcccgaagttgcagacaacctttatgagatgaagccaccagaaccccaagtaaaacctgcaagaagatgaaggttgagttatcaaatgtttattcagcaaatactgagcatctactatttgccagatgctgtattacatggtaaagctacaaaatgaacaaaaaagacacgtctctggcttcaaaaaacttatattcaagtggggaagacagacataaaaaaacacacacgcattcacacatttagtaggagaagagaaagcgcacaaatagaggttacaggtaagaggccatgcgggatctcacaggacacaatgagacgtttgattttactttatatgcactgggaggcacgcaaagaatttaagctggggcgcagtggctcacgcctgtaatcctagcactttgggaggccaaggcagaaggatcacttgagctcaggaggtggagatcagcctggcaacatagtgagaccccatctctaaaaattaaaaagtgtaaaaattaacccaggccaggtgcagtggctcatgcctataatcccagcactttgggaggctgaggcaggcagatcactcaagtccaggaattcgagaccagcctgggaaacatggcaaaatcccatctctacaaaaacacaaaaattagctggatgtggtgatggatgcctacagtcccagctactcgggaggctgaggtgggaggactgcttgagcccaggaggcaaggttgcagtgagccaagatagtgcctctgcactctagcctgggtgacagagcaagattctgtcccaaaaaaataaaaaaataaaattagccagggacggtggtgaacgcccgtagtctcagctacttgggaggctgaggtgggaagatcactggaacctgggaggtcgagactgcaatgagccatgatcgcgccaatgcactctagcctgggctacagagcaagatcctgtctcgaaaaaaaggatttaaacaagagagttctgtaatacaagtttcacttttttttaaacttccttttttttcctgagtcttgctctgttgccccggctggagtgcagtggtgtgatcttggctcactatactcttgatctctcaggctcaagcaatcctacctcagcctcctgagtagctgggaccataggcacatgccaccgcacctaattaagacaacttttttgtagcaacaaggtctctctacccaggctggtctcaaactcttgggctccagtgatcctcatgccttagcctcccaaagtgttgggattacaggcatgagccactgtgcctggcatatccccatttctagttgctgcagagagaatgaattggagggccaacaacagatgaagtggtctgcttagaaggctagtgtagtcaaaatgacgaagaaagatagtaaccgagactagagtcgtggcaataaggatgacaaaaagggaaatcacctgagccctgctagggtcccccttacctgggctgggcagaaggcagagggcagcagacagagccaggaccaagccaggcggcgattgagttggcagctgggcaggtaggaggcctccgggaggggcagaagggccttagggtcaaaggaggcccaggccttacgctgtccttcttctttcagggtggccagagtggggaaggaggagggagtctgcagccgagtgtactgtcaaggagggaagagaaatcgggtgtgtgtcccatgggccccaggtgtcctccagtgttctgccaccatccttcccccacatcctcatactttctggaggggacagtgatgtggctcttcaaggatctcattgtgtgcattccgaacagggctgcctggcggagctagaagatccagggtaggagccaggagttgcagtcccaggctggggctcccaggagaggaatgttgcaggaactggtggtgtctcagcacatggggacacagccttggccaggaaaagcagcacagtcacttcccctgaagagcctgcctcttcaagaatcctgctctccttgccaaggaagtgtgctactcccactgcctccccgccctgggccctcagcctcctcacttgcaggccagctcctccagggccttggtagcccacaggtagaggggaagtcctaactgacgttcccacaccagctgctcgtacagggaggccccgtaggcttgacgggatgagtgagccccaggcttctgacgagagaagctttgaagcagaacggcgccacggaggcagggggcgagcactggccttcttgtcccccctcccactgactggagcaggtgaacatcctggagctgggggaaagcagagaaaatgaaaaagcagagatgaagaccccaactcaatgaacccaggcagagttaaccgcactttgccactgcctgggttccaggaagacggaaagcaatttctcccacgtgggctggcctcactttccattacaacccactcccgctgcggtcagccttcatctcccatgagctccactcagtcttgctgtgggctgggtggctcctggatgaacagacatggctgaggcttctcaccgggtcgcctgagatcaccccagccccagatctgtgcttcagctatctcctcctccagctgaaaggcccttctgtgaaggagatgctctggccacaactcctcctcacagtgcccaagactctactcctttttatttaagcttctgtccaagttatccttagcaaaagtgccccctaacacacacttttaatttctatatttctatataaccaccctgctgcagaaaaggagcctatgaaggtaagagaagctgcagaggtctctttttgttatcagccctgatctcacatacctgcagacacactccaggtcgcatcacccgcctaaggccacggaactgctggtaggcaaggcagagccccagctgcccatccagctcatagaggccagcgggctcattcaacacgccagtgactgctccctgcaaacaggccgaggtccagttgaccactattttcttcctctttgaaaacccacatttctggcccctcaagctctaggatctctccctgtgctcaccgaataggataggagtctagaataccggacaagactttctggatccttcttgtcctccgagttgctgggcatggggagtggcttggggtcagcctctaagaggggtccttccagctccagttccagctcctgcacacattctggtttcagcagcaacagacgggaggactgactggtcatccaaacatgctggcgctgaccacggatcttggacactcgcagttctgtcagcacataggctgtaccaggccgaagggctctgtgccacaccagctgggcagggacctggcttgtgcagagacaggcaatgtgacacaagagaccccaacactgccactctgccagagtccttttccctcacgatttgaactcagagacctgccctctgtgagtctcaactcacctctccatcttccctatgtctgccaactaaatcttagcgtctctcctctctcacaggagatgccaaatatttccaaaccacttccccaacatacaaaccatccctaaaacttccttcaaaatacataaatattccactgagaaaactgtgccctatcccgccccataacacacaaacaacattcattcatgtaatcaaagtgtattgagtatatatgtatccagtattgtgactgatgtcaagggaagtatgacaaactgttcttctctaacacagtaaggccctatttctacaaaatacatatatttttaaaatttctataaaaaggaaaagaaacattattcagaaacttatatgtcataaaacaatggttagaataaagatcaatgatttacaatttctaccttgggtactatgctcagtacctgggtaaagagatcaatcataccccaaacctcagaatcacaaaatatacccagttaataaacttgcacatgtacctcatgagtctaaaagttgaaattataaaaataaaattgtaccagttgatgcaaaaagagtcaacagtaagtaccaagttttttttttttttttaatgcctgtattcaatgtctcaatggtgttaagatgaatgatttctttggtcatctccacaagtgagcgtggcagttttttaaaaggtcacatacaatctaaaagctgtgtgctcaagtgagttgcacagcgggaaagtctactccctaactctatgcacaaacatttcccggaatcttctcccaacagcgctattccagaaaacagctctccccagctgtcctcctttcctacatggctcctcctatgatgctatctttcctactgaaagttctaccaccctcccccacttccatggctgaaatgaccccagtcctcacctgcacgatgatggacacgtgggtgacagctgggtgtgatctaccaagagacaggatgaagtaagctttctgtttacttttcaccagagcactcaatcgaactagactcccagccaggtttcgctgcacacctctgagcttgtttctaagaaggaagaaaaagccctgtaatcccagctactcaggaggctgagggaggagaatcacttgaacctgaaaggcagaggttgcagtaagctgagatcccgccattggactccagcctgggcagcaggagtgaaactacgtctcaaaaaaaaaaaaaaaaaaaaaaaaaaaaaaaaaaaaagcagcagcagtcatctttatttctcttctttttccctataaatgctgtcccttccacagtaaagaataacctggtaatgatacaaaatgtccatagcccaaagcaagctatgctaaaaaccttcaaaattctctttcccttaggtaaggcacagatcccttgaacaacccttctctttaccttcttaatattcaaagcccaccattcccttgatttggaacattcagtctatattactatcaatgcccttttctttctctccctccactgacccagcatcatccttcagttttacagcgcccctgccatgcctagagggggaaattacctgagcctgagcaggcaggaagcactctctgggtagaggacagggataggcgtgacggggccaggactgatggtcaaaggaaacactggcacaggggcatcccacagctccaagtgcccttcccctgaggaattccacctggcaggagggaggtaactccaacgggggaacagaaaaagatggcccaaccaagaaaggtccaggtctatgagctaagaaagaccaagagcaagggttaatcagaaccttagcatcctatccacccacctccccgtttgtttcctcagagacttaattgccttgatccttggacaccattcttgtcaggatctgaggcatctgatctccaccttccacttacctcacagctcaggacgccagtgttatctctcacatagaggcttccgttcctgcactcttgttccaagtctgccgataggtctgttagtgtccctaaaagtaacagctgctctcggggcagggggttcccatttggtccagcctcttgggcccaggcctggtatgcactactgctccacgacaggtggctgcagcatgggagacgctggtgagtcttgaggtcctgtactgagacgaagctgtagagtgaagggaacagaggtcctgcaaagccaggtccaagcctactaaggcaaccctcaaccctgataaaccctcaagagcccagggaaaggttgcagggaacatggactaagaggtgagtttgattgattaaaggggtaaaacctggggctaaaggcctaagaaaataaggatggggccgggcgagtggctcacacctgtaatcccagcactttgggaggccaaggcgggtggatcacctgaggtcaggagtttgagaccagcccggccaacatggtgaaaccccatctctactaaaaatacaaaaaattagccgagcatggtggtgtgcagctgtaatcccagtttcttgggatgctgaggcagaagaattgcttgaacccaggagatggaggttgcagtgagctgagatcacgccactgcactccagcttgggcaacagagtgagactgtctcaaaaaaaaaaaaaaaaaaaaaggaaaaagaaaataaggatgggatctgagtccaattccgtgctgaatagtatcttcaacaagatggtgccagggagaggacccagagaaatgaagtaggaatgcatgaggggcctgaggaaatgaatgtgtggggagaacactttgtaagtaacaaaggcaattctcttgaaagcatctcagctcttaactccagagagaacttaatgggaccacgtaggcatctaacagtccaactacaatgaccccagtcaagctcctttctagtctagaatagcacagtactagagactaggggggaagctgaggctgagatgtgggtgttggatgtgatacaagtaatggttaaattatcaacgttgtgataaattcacctttttgtaataccattattctcgcttgcattcccctgaattttttttttttttttttagacagagtctcactcttttgcccaggctggagtgaaatcaagactgaaatctggaaccctctccagatggggtttcaccatgttgtccaggctggtctcaaactcctgacctcaggtgatccatctgcctcagcctcccaaagtgctgggattacaggcatgagccactgtgcccggccccatgattttttttaagtggaaatgaaaaggatcgagttacaaaacatcacaattaatcctccctgttggactcaagaacattatacacaaatgagtatcaaagagagagaatgctgttctagaaagccattccccttctgcatctgctctccttccctgacagctttggagaagacacaaggcaaagacagaaactaatacctgttggcccctgccatgcacgctatactatactgagtctggtcaggcacaacgctgaattttcttcacctcaaaaccctgtaaacaccaccaatggggaaactcagaggctcaggtacacagaggcatgggtggcaaagctagatgtgcctcattcaaaagtccatgttctttctctgtgttttcctacttatctgaaggcccaggaaaaagcaaccagagagaactgtctcttttttttttttttttgagacagagtcttgctctgtcgcccagactggagtgcattggcgtgaactcggctcactgcaacctccgcctgccgggttcaagcaattctcctgtctcagcctcccaagtagctgggactacaggcatgtgccaccatgcctggctaattttttgtatttttagtagagacagggtttcaccatgctggccaggctggtctcgaactcttgaccccgtgatccacccgtctcagcctcccaaagtgctaggattacaggcgtgagccatccattgcgcccagccaaaaaaagtaatcttaagtgttatggacgtggacaagaattataggaaaagaaaggaaaaacagtccagtgaaataaaatgataaaaaggaaaaaaaacaaaaccgtgtacaagtaccctcagaaattactttggaattaggccaagcgcagtggctcatgcctgtaatcccagcactttgggaggccgaggcgggaggatcacctgaggtcaggagtttgagaccagcctggccaacatggtgaaaccccgtctctaccaaaaatacaaaagtagccaggcatggtggcgagtgcctgtaatcccagctattcaggaggctaaggcaaaattgcttgaatctgggaggcggaggttgcagtgagcagagatcgcgatattgcactatagcctgggccacaagagcgaaattccatctccaaaaaaaagaaattactttggaattaatgtaacaaaatatcatttaatgcctaccaaatagggaaaaataaataaaaataattttttaaccaaggtaaacacaggctcaagatatgcatatacactatgggccgggcgcggtggctcacgcctgtaatcccagcactctgggaggctgaggtgggcggatcacctgaggtcaggagttcaagaccagcctggccaacatggtaaaaccccatctctgcaaaaatacaaaaactagccaggtgtggtggcaggcacctgtaatcccagcttcttggtaggctgagacaggagaatcgcttgaacctgggaggcagaacttgcagtgagccgagatgatgccattgcactccagcctgggtgacagagcaagactccatctcaaaaaacaaacaaaaaaagaagtataatgttaagcacaaaaagcaggcaggggctgggtgcaatggttcacacctgtaatcccagcactctggaagaccgagacggcagatcacctgaggtcaggaattcgataccagtacggccaatggtgaaaccccatctctactaaaaaatacaaaaattagctggtgtggtggcgcatagtcccagctactcaagaggcaggagaatcacttgaacccaggaggcagaggttgcaatgggccgagatcatgccactgcactccagcctgggcaacagaatgagactccgtctcaaaaaaaaaaaaaaaaaaagcaggccaggcacggtggctcatgcctataatgccaacaccttgggaggccatggtaggaggactgcttgagcctgagggttcgagaccagtgtggcatgcacctgtggtcctagctatgtgggaggctgaggcaggagaattgcttgagcccaggaggtaaaggctgtgagccatgtttataccactgcactagagcctgggggacagagtgagaccctgtctcaaaaaaaaaaaaaaaaaaagcaaatcacggagggtatttacatagggtacggtaccatttatttaaagtctacacttatgcaaaactctacattatattgcttaaggatagatgcatgtgtagtaaaactattaaaatatttattggaataatatatcccatctccaagatagtgattattattattatttttttttaaatatggagtttcgctcttgttgcccagctagagtgcaatggtgcgatcttggctcactgcaacctccgcctcccgggttcaagcgattctcctgcctcagcctctgagtagctggggattgcaggcgcccaccaccacgcccggctaatttttgtattttttttagtagagatggtgtttcagcatgttgggcaggctgacctcgaactgccgacctcaggtgatccacctgccttagcctcccaaagtgttgggattacaggcatgagccactgcacctggccaatagtgattacttctatgaggagataaataggtttcttttgcaggacttgtcatagcctctaatatgttaataaaccctatgactctcccagagacgtttatcatattcaatgtccctcacacttacttagctatgaaccccttttcttgtgctttactaacgttgcctagaacacttttggaaatgatagtgtagagagaaaaaaaaaaaaaaaaaaaaatatatatatatatatatatatatatacacatatatatataaacacactctcggaagccctaaaactcacatcttaaacacaatgatctgcacttggtaatgtcaaacagttctctgtatctttgtttcccaatacacaaaataaagataacaccagcctctttccccacttcgagagttctttttccaaattttctttctctcttcccctcttcctctctttttctttaatcttaagccaattcaggagaactttaggaaaaggaaagcttgatagtgttagaaaagctctgcagaaggggtatgtttagactaccttgtcctccgctcactctctcacttgccctttttctaattatagaaccttacttttcaatcctgaattcaatacctgcccctgcccagcccccgcaaccgccacctctccttacctatagctgaggggcagtgtagaaccttggttccttccctgggacaaccagacagtcttcacacaatcaattaccaatggagtcaactggacattaggctccttgacagctggacacagggtcttttggatgaagacctgagcatcctcaagccaggcttgttcctgaggaaagtgaatttagttaaaacatcttgactatccggcccaccaaggaaacttgggaagaataaaggactagaaaaaaatatccgggccgggtgcggtggctcacgcctgtaatcccaacactttgggaggctgaggcaggcggatcacttgaggttgggagttcgagaccagcctgaccaacatggtgaaaccctgtctctactaaaaacacaaaattagctgggggtggtggtgcacacctataattccagctacttgggaggctgaggcaggagaattgcttgaacccaggaggcggaggttgtggtgagccaagatcgagccattgcactccagcctgggcaacaagagggaaactccgtctcaaaaaaaaaaaaaagaaaagaatatccagagggcacatgaaatgaagatcaaaagtaaaggaatttagaacttgaagaaaccttaaaagtcttagtccagccataccgtagacagctggccatccagctttggtcttgcccctttctctaacaaacttgtactcatgccatcttacatggaatctggttctaaagtcagtacgttgaagaccaagaatggacaaaaacattgttgaacaatcctttaaaccgttcataaagaacaggacaggctgggtgcagtggctcacgcttgtaatcccagcactttgggaggccaaagagggtggattgcttgagtccaggagttcaagtacagcctggacaacatggcgaaatcatgtctctacaaaaatacaaaaagccaggcgtggtggcacatgcctgtgcttccagctactcgggaggctgagatgggaggatcacctgagcctggggcggttgaaacttcagtgaacccagatggcgccactgcactctggcctgggtgacagagtgagacactgtctcaaaaaaaccaaaaccaaaaatgagtaagacatagtgccatactatgtataagtgcctaatagtggacagtacataaaaaggacataggcagagtataatttttaatcatctcctttttttattcaaaggtatgcatttcccacaaactaaatatatgcaagatacaacctcacttgatttgtttcctgttgtcttttcagctaaggtgtgggcttcctgaggaggatatggactatctttgtatacctgacacagattctggacacacacttgccatgatatgtagataactttagggaaaaggaccagtttggcctactcccagtgctaggcagctttaacacacttggcagtaggccctttatccttctcccttaatgctacttctaagccattacagctccttccctggtcctccaatgctcatatattaacatcctggtcaatctttcacattcctctttttttttttttggagacggagtcttgctttgtcgcccaggctggagtgcaatggcgcaatctcggctcaccgcaacctccgccttccgggttcaagtgattctcctgtctcagcctcccaagtagctgggattacaggcatccaccaccacacccagctaattttttatatttttagtagagacgaagtttcaccatgttggccaagctagtttcgaactcctgaactcaagtgatccgcccgcctcagcctcccaaagtgccaggattacacacgtgagccaccacgcctggcctttcacattcttctaatcttaaggagctcgaaaagagctagaaaagccagtcttccatggaatcaacctaaatgcacatcaacagtagactggataaagaaaatgtggtacatatacaccatggaatactacgcagccataaaaaagaatgagatcatgttctctgctacaacatggatgcagttggagaccattatccttagcaaactaatccaagaacagaaaaccaaatactgcatgtttgttcccacttataagtgggagctaaataacgagaacacgtgaacacaaagagggaaataacagacactgggtcctacttgagggtgggaagagagagattggaaaaaatacccatcaagtactatgcttagtacaggggtgacgaaataatctctataccaaacccccatgacatgaggttacctacataataaacctgcgcacgtccccctgaatctaaaataaaagttaaaaggaaaaaaaagtcttcaagttctagatgtcttcagcatccttgtggacagccctaccactgactttcagcccacttcagccacacactcattcatggtcagagttgtggaaggcagaccaaatcaccattcagagttgccccaccagtataagcaaagttccgactctcacgctttttgtcttcctctcccagtattcttttgtagttcctgtttctcggatggcctatcctttgcttggtgcactgaatacgactgtctctcaaagtgatcccatggcttcaaggtaaaattacctaagttttgttaaaaaggcaaattcgtgttttcatctactgagtaaaaatggagcagactggatgtggtggctctcgcctgtaatcccagcactctggggggccaaggtggatcgctcgagcccagtagttcactactagtctgggcaacaaggcaaagacccgtctctacaaaaaagaaaaattagctgggcatggtggctcgtgcctgtagtcccagctactcgggaggctgaggtgggaggatcacctgagcctgggaaggttgagacccgcctgggcaacatggtgaaactctaaaacaattcaaaattagctggattagcctggcgtggtagcacatgccagtagtcccagctacttgggaggctgaggtgggaggatcaccttagcctgggaaggttgagacccgcctgggcaacatggtgaaactctaaaacaattcaaaattagctgggttagcctggcgtggtagcacacgccagtagtcccagctacttgggaggctgaggtgggaggatcgcttgagcccagggaggttgaggctgcagtgagccatgatggtgccactgcactctagcctgggtgacagagtaagaccttgtttcaaaaaaaaaaaaaaaaaaaaaaaggagggaggaagaggaagatccagattaatacaggctgaagtttaagaacacaatatgctttcccacaattatctcaaccactgcatgggtttaacagccatggccagatgatgattgttcctgtatgtctactttagctgagatctcattcctgagctttagtcctatccatctgccagactctccatggccaatccacaggcagcacacatgcccaacactgaactttccacaaaaccctgtccttttctagaactcttctagtgttatgttcactaacttagcaaatagtacccttaaccaaacagttgttctatcctgaaacctagatgtcctccttagctccttcctttccctacataggtcccagtcctggctgggtgcagtggctcacgcctgtaatcccagcagtttcggaggccaaggcgggcagatcacgacgtcaggagatcgagaccatcctggctaacatggtgaaacaccgtctgtacttaaaaaaaagaaaaaaaatacaaaaatgagctgggcatggcggcgcgtgcctgtatgcctgtaattccagctactcgggaggctgaggcagaagaatcgcttgaacctgggaggcagaggttgcagtgagccgagatcgcgtcactgcactccagcctggtgacaaagctagactccgtctcaaaacacacacacacacacacgcacacaaaccaatcctttagattgtattttcttaacatcttatttatttatttatttatttatttatttatttatttatttatttgagatggagtctggctctgtcgtccaggctagagtgcagtggcgcgatctcggctcactgcaacctccacttccgtggttccctgctcagcttcctgagcagctgggattaccggcgtgtgccaccacacccaattaccctcatgttaaagtcgctgcttagcaagaggtacaaaactgtcagctctgacccctccaccaccacccaactgaacttttgagtttttcagacacctgctctatcctcctgcctttgaatatgtgtttgcttccgtcctgaaaccccttccggcgcttttttttttttttttttttttttgacagagtctcgctctgttgcccaggctggagtgctgtggcacaatctcagctcactgcagcctccgtctacccggttcaagcgattctcctgcctcaaccttctgagtagctggaattacaggtgcgcgccaccacgcccggctaatttttgtatttttagtagagatgaggtttcaccatgttggtcaggctggtctcgaactcctgacctcaagtaatccgcccgcctccgcctcccacagtgctggattacaagcgtgagccaccacacccagcccctttcggcgctttttgccttctacacgcacttcgggtctcagacgcttttacttattatggttgcccttttcccctacagctccgtcaagggtcttctccaggaacccacagccccatagttcccccattaacctgctcctggtttcccaccaggattaaaccctagagagtgaacggagaccagtttaaggctcacagcgggcgccgcgtgaatgagggaataaacattcgcagaaccagtaagaggtaggagcggaccgactcacaaccccctcacccatgggccggacgcggccagcgagcccagagagacaaggcagaggaaataggaagagaaagagtatctgtgacaaacaagaaaaaaggaacaagagacgtaatagcagcactcacggaggaagggacctgggcccggccagccgccatgatgcgccggagctccgcccccgggaggggcaggtgctcgcttgggggtggggatgggg

SEQ ID NO: 2464 - DNA, 23275 bp, Homo sapiens; identical to SEQ ID NO: 2463
  source 1..23275: mol_type = genomic DNA

SEQ ID NO: 2465 - DNA, 1911 bp, Homo sapiens
  source 1..1911: mol_type = genomic DNA
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggtgggtaccggcgccctggggtccccgggccggacgcggctggggtaggcacccagcgccgacagcctcgctcagtcagtgagtctcttcttccctaggagcgtccgtggccactgaactgcgctgccagtgcttgcagaccctgcagggaattcaccccaagaacatccaaagtgtgaacgtgaagtcccccggaccccactgcgcccaaaccgaagtcatgtaagtcccgccccgcgctgcctctgccaccgccggggtcccagaccctcctgctgccccaaccctgtccccagcccgacctcctgcctcacgagattcccttccctctgcagagccacactcaagaatgggcggaaagcttgcctcaatcctgcatcccccatagttaagaaaatcatcgaaaagatgctgaacaggtgagttatggtttccatgtacacaggcgactggagccgttggtcagaaatactggcatgtgccccctaaaaataaaatcaggaaaacccaggggttagttgaaggactagaaattgggattattgttttcacaattaaggtttcctttacgataattactgctctggtgccagaggatattcccaatgcctggcgtccccaccctggttcttccttcgttccaatgaatgtaggtaaaactgccttcatttgaggcccagtaggacaaacagcaacaggttctggctgtttttaatccaatagtacagtggagaccaccgccccaccccacccccattcctaaaagagcatcccaagcttagaggtccctgccacacagcacagctgtcataggcagtagccacttggttgccaggctggggaaactgcattcggaaaactctagaggctggaggagcagggcaggagaagagtgttgtgcaatcagctttcccgagcacctactcagggcacccattttctcattgcagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatagaaaaaactcgtttgatttttggggggaaacaagggctacctttactggaaaatctggtgatttata

SEQ ID NO: 2466 - DNA, 1911 bp, Homo sapiens; identical to SEQ ID NO: 2465
  source 1..1911: mol_type = genomic DNA

SEQ ID NO: 2467 - DNA, 2421 bp, Homo sapiens
  source 1..2421: mol_type = genomic DNA
tcttagttataattactttattaaccttttgatctttcaacatttagatagtctttcttaatatttccaggagagtacctcatttttattttgaaaaccattcagcacatttatcttatgtaacatgcagagcatatatctatctgtatttttaaaattttcctgttactcattgatacatagtacttaattacatgttattccatgtacactgaaaacaatataggaaatatatacatctaagacttctactttgtacagtctttcattaaataagaatacttacacatacattttcagatatttctaccttcctgtatgtgtttggaattgtatgtaggtagccactgaaagaatttgggccccttgggaggatggcagtggaagtccatgaagtaaagagcattctttaaaaagcagatttgattgcataccttttagttatttgagattctgagaattctgataaaccccaaagcagaaagattccttagtacccttggaagatgggaaaggtgagggaaatatttgaagcagggtcagaacatccactaagaacatagcacctcagtagagcttacattatagtgccagggtagagttattactgaatagcttaggatgatgaacattaaccttcctacaggagtagtagcagctgatttggtgaccatcattggtcaccttttagtgtaactgcaaactaagaacaattatggcttgacatatactccatgtagggaagtgatgggagaggcagcctctgtgtggtccatccttggaagcactgcatcgattttgctcccctctggttttaaggagatcttttagacctgtaagaagagaaaggggatataaaagtgtgatagtctgactctggcttcagattgggttgtgtttggaaagtaccgagttcatagaatagataactgagctttcctgctgctatgcattcattatggattataggggttgcttttttcaaccatgaaagacttggggaaaatgttgtcagttttgcttagatagttatagctgtacttcaaggttgactggtaatcagggtaacttctgatacttatcacacaagatggtgcctcagcatttaaataaatggaggtaggggagggcgtggtggtaacatacttttaaaccagcgattgcacagcaaaccacaatgcaagtatttctgactcccaagattgccgtttcctaaagagcaattcttctgcaggcaacagcaaacctacctttccttgctaactgctttcagtaaattcttgatggccttcgattctggattcagacatctcttctcacccttctttttcattgtagcactgtagaaataaatagggatgaaaatatttaaaactgtgttgggtcaataaaacagatggcatacgcagttctgaagtcagacatttaagtttcactctgcatgtttttgtttgctgtacattagttttagaatcatcacaaaccctttactgatctttttttattatcattacatatttaatacagtatataattacaaccagggaagtgataatcagatgggatttcactcacatgatctcaacacgtggacaaaattggcttgcaggaataatttcaagtttttctaaagaccttggattaacaggttgattactaatgctgatgcaggtacagcgtacagttctagagagaggtactcctgtaggaaaagaggaacagcagagaaggttagcacagtgttcattttaggcatttaatgtagactggtggtatttagcagaacctatatccccatatcagcaaatagtcacttaatctgaggaggaatggatcacatcataacacaactgtaaatgattaaagagttgattatctggaagaaaagaattgcagcttgttgattataaagtcaaacccttaagcacagttcatgtggttcattgagcttagttaggtaaggaagtatctgtatctcatctctgtccgcattccctcacattttctctctctatcctccctcttccccatctcttctgtcctccttccctttttccttctctttctcttattctatttgtttctctcacttcaattcatataagttttatgatctgagggaatctctatttatttccctcttatttataagcatgcagtgaaacttttacaaatacattatttctgtatttttagaatttatacctattcctatttctcattttacaaattaagtatcctttgatgttccttaccttgaatgccacttagagtcagaaagataaggcagcaaatcagaatggcagtttgattcatggtgctgagactggaggttcctctgctgtaggctcagaatatgtctaagcaattgaggaatgtctcagaaaacgtggggctagtgtgccatatttatctgcaaag

SEQ ID NO: 2468 - DNA, 3058 bp, Homo sapiens
  source 1..3058: mol_type = genomic DNA
tgaagtttagaaatcttttaatgtttattcaaaggacaaaataaagactatgaaccaatgagacacatagtaaaaaagtacaattttaatatagtgaatgtaatatatatgtaattactcataacaaaatggtcaaaacctttaaaagatacacaataggcatctaaaaagctcagcaatgctaaatatataatatatattatatataaatatataatatataaatacatacgtttttaccaagaaatgttttatttttcttgcagtagctttgttaattgcacaaaattatgttttgtttttgccatttaaatattatcacagaatcctattctgaaagacaaatgttcattaaaaacaaagcaaaaatagaaattcacaaccattaattacctaggtttgtcatttaaaggtttaaagaaaaaaagggaggagctttcctacaagccttttcacaagtgtcacattttctctttaaaagggaaggatttccaaacaaaggtgaaatagcttaaacagaaatatttgtaaaaataaactttacagcattatcaaggatattaagacaacactgactaaccggtttcattaccgcatcttcccccacccccaaccccagtgtgtcccaccaggactagaacaggctttacattcagacagaaatgcttcaaaatcccagtgaaatgaactgtgctaaaaacccgacaggcatcttccctgccctccccgctcccgctcgtcttctgcaatcctctaacccaggttctactctgtgaaaggggccaaagctgtgagtggggagggaacttgccccagcgtggccaccttatatataattatatattctaccataaatgctggccttcttcaaattatgattttggaaaatctaacccatacagagggataaaaaattgacatcccttggacaacttctccttgtttttttttgttttgttttgtttttaacattccaagctctctctggtcccctatccaaggagaaatgctagggcctcgaggatgtcgctatatatttttataactaaatgataaatttatattcaaattgtttgaatacgtttccaaaactttcagagtacaagtcattgttaagtttgcctttactttaaaaactaaaagaatacatttctatataaactagcagtcaggaatttgcctgttttctagcttcttcatctatctaaaatatatatttagctaccagaattatggtactcctaataaaatacttaataaatagcatataaaatcaaagtttaaaagtaaatgatggcagtttgccatactaaaaagataaagaatgtctaaaattataggaagataagatattagccctcatagaacttaaacttttagaaattctgaataaggaaatatattctacatagataaggtgtgaaacactcagctttctaaagtgaaataattaaatagtatcccacaatcaagagtaaggaaattctctaacatattccccaagaaacattaaaatatttcctatttcttataaaagtgaagataacagtgtatttccatcaacagaattcttatgaaacatcatttccacattaaatccacagccttctcagttaatatcttaaggaatatttcttggaaatataatagtcacctacaattcaagacactttgaaagattaacagccagtgattcctggctcacactatagtcaattgccaaaacttcaatagcatagcagataaaataacagcaaatagcagaggtactatgctaaacacttcattagctgagctgaaagcttaagcggcaaacataggttttcctcacactcttcaaagtgaggaatccaggaagaaagctaactactggaaaaacaaataaacaaacaacaacaaaatctttccttcttgtcttccctgggttcagagacctccagaaaacttctctgctgaagactgggaaacttttccatgcgtgctcatttctcttaatcagttttccttgtttccactgttgagaaaaatgttatattagtttaaccatttttcacactcctttctactccacccttgtcaaaactcagcgtttatgatgtttggtaaaaaaggagaatacaaaaatcaataaaagcaatgggtaaacaaaaaacataacttagtgacaagctgtgtgtaattgctcaagtaattacatgtaagattggtatattttcccaggacaatccagaaaaactttcccaattcaacaaccttttaattctaaacatgaaaagtgttacttaaatcgtacagagaataaagaccttgtgaagtctatggtctccctagatcagatttagaaaccacaaagatcaaagtgacaagtacccgtccaaaattttctggatgactttctttagaaaaggggcttctggatcaagacaaatttccttcccgttcttcagggaggctctgaaggaaagaaaaagaagatacactcatgagataccaaggttgaagacccaggctgcgggatttctctcttgccaaggtcacagcggacacagcagcacagaacttacaccacttccaccttggagcactgtgggcctatggcgaacacttgcagattactgatcattttgggatgaactccttgcgtggtctgtaaacaaacgcaacgcagctctctcaacacagcagcggcaggaccagctggggaagaaagagagacaccctttatagggcaggttgctgggagagttccctggaacgcagcgaccccgcagaggctgggatgcacctctgtgcccgagtgcgagtgcgtcccgcgcgccatgcgctctcaccgctggcgatgggccctggctgcgtcagcagcagcagcagcaccaacagcgcgcacaaggagctcgaaggaccggggacacgggccgcgcggctggacaggaggctcatagtggtcaagagagcgctgcgagcggtcgcgggttcctgaactgggtggaggagcggagattggaggagcgaagattggaggatccggagcactgtggcttcctcgtgccttctgcac

SEQ ID NO: 2469 - DNA, 3211 bp, Homo sapiens
  source 1..3211: mol_type = genomic DNA
gagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtaagcacatctttctgacctacagcgttttcctatgtctaaatgtgatccttagatagcaaagctattcttgatgctttggtaacaaacatcctttttattcagaaacagaatataatcttagcagtcaattaatgttaaattgaagatttagaaaaaactatatataacacttaggaaagtataaagtttgatcaatatagatattctgcttttataatttataccatgtagcatgcatatatttaacgtaaataagtaatttatagtatgtcctattgagaaccacggttacctatattatgtattaatattgagttgagcaaggtaactcagacaattccactccttgtagtatttcattgacaagcctcagatttgtcattaattcctgtctggtttaaagataccctgattatagaccaggcatgtataacttatttatatatttctgttaattctttctgaaggcaatttctatgctggagagtcttagcttgcctactataaataacactgtggtatcacagaggattatgcaatattgaccagataaaaataccatgaagatgttgatattgtacaaaaagaactctaactctttatataggaagtcgttcaatgttgtcagttatgactgttttttaaaacaaagaactaactgaggtcaagggctaggagaatattcaggaatgagttcactagaaacatgatgccttccatagtctccaaataatcatattggaattagaaaggaagtagctggcagagctgtgcctgttgataaaatcaatccttaatcactttttcccccaacaggtgcagttttgccaaggagtgctaaagaacttagatgtcagtgcataaagacatactccaaacctttccaccccaaatttatcaaagaactgagagtgattgagagtggaccacactgcgccaacacagaaattatgtaagtactttaaaaaagattagatattttgttttagcaaacttaaaattaaggaaggtggaaatatttaggaaagttccaggtgttaggattacagtagtaaatgaaacaaaacaaaataaaaatatttgtctacatgacatttaaatatggtagcttccacaactactataaatgttattttggacttagactttatgcctgacttaaggaatcatgatttgaatgcaaaaactaaatattaatctgaaccatttctttcttatttcagtgtaaagctttctgatggaagagagctctgtctggaccccaaggaaaactgggtgcagagggttgtggagaagtttttgaagaggtaagttatatattttttaatttaaatttttcatttatcctgagacatataatccaaagtcagcctataaatttctttctgttgctaaaaatcgtcattaggtatctgcctttttggttaaaaaaaaaaggaatagcatcaatagtgagtttgttgtactcatgaccagaaagaccatacatagtttgcccaggaaattctgggtttaagcttgtgtcctatactcttagtaaagttctttgtcactcccagtagtgtcctattttagatgataatttctttgatctccctatttatagttgagaatatagagcatttctaacacatgaatgtcaaagactatattgacttttcaagaaccctactttccttcttattaaacatagctcatctttatatttttaattttattttagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 2470 - DNA, 1747 bp, Homo sapiens
  source 1..1747: mol_type = genomic DNA
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtaagcacatctttctgacctacagcgttttcctatgtctaaatgtgatccttagatagcaaagctattcttgatgctttggtaacaaacatcctttttattcagaaacagaatataatcttagcagtcaattaatgttaaattgaagatttagaaaaaactatatataacacttaggaaagtataaagtttgatcaatatagatattctgcttttataatttataccatgtagcatgcatatatttaacgtaaataagtaatttatagtatgtcctattgagaaccacggttacctatattatgtattaatattgagttgagcaaggtaactcagacaattccactccttgtagtatttcattgacaagcctcagatttgtcattaattcctgtctggtttaaagataccctgattatagaccaggcatgtataacttatttatatatttctgttaattctttctgaaggcaatttctatgctggagagtcttagcttgcctactataaataacactgtggtatcacagaggattatgcaatattgaccagataaaaataccatgaagatgttgatattgtacaaaaagaactctaactctttatataggaagtcgttcaatgttgtcagttatgactgttttttaaaacaaagaactaactgaggtcaagggctaggagaatattcaggaatgagttcactagaaacatgatgccttccatagtctccaaataatcatattggaattagaaaggaagtagctggcagagctgtgcctgttgataaaatcaatccttaatcactttttcccccaacaggtgcagttttgccaaggagtgctaaagaacttagatgtcagtgcataaagacatactccaaacctttccaccccaaatttatcaaagaactgagagtgattgagagtggaccacactgcgccaacacagaaattatgtaagtactttaaaaaagattagatattttgttttagcaaacttaaaattaaggaaggtggaaatatttaggaaagttccaggtgttaggattacagtagtaaatgaaacaaaacaaaataaaaatatttgtctacatgacatttaaatatggtagcttccacaactactataaatgttattttggacttagactttatgcctgacttaaggaatcatgatttgaatgcaaaaactaaatattaatctgaaccatttctttcttatttcagtgtaaagctttctgatggaagagagctctgtctggaccccaaggaaaactgggtgcagagggttgtggagaagtttttgaagaggtaagttatatattttttaatttaaatttttcatttatcctgagacatataatccaaagtcagcctataaatttctttctgttgctaaaaatcgtcattaggtatctgcctttttggttaaaaaaaaaaggaatagcatcaatagtgagtttgttgtactcatgaccagaaagaccatacatagtttgcccaggaaattctgggtttaagcttgtgtcc

SEQ ID NO: 2471 - DNA, 2602 bp, Homo sapiens
  source 1..2602: mol_type = genomic DNA
tggtcctgacgatcttgtttattgaaaagttttaagcaggattttagacataaaaataaaagagcaaatatagaggtcttggggaccatggccacagtcactgctgagctggaggcctgggctgtggcttcatggggcagcaccctctacgccatgccttgtactccccgcacttggggaagatgaagttttagtttccaaatgagaagggcagtggggctccaggcagccacctcgggcggcaggatggggcttggcagctaaggagcagcaatggtgcagtcctcagagctgggagggtggcttcccgggagacctggtggtgctggggctgccagtgagtcccgggagcgaggatattggggagagccagagccggcagagggagggaggagcctggaatgcggggaagtcagactgtgggcgaaaggggagcccggattccggcctcacaagcccgagtaggaggcctctgaggtctcagaccaggatgaatcccggcgggaagacgatggctgcctctggagccctctctggttggggcagcccaggcgcaagagcagcatccacatccgctcccggaacttgacccctacaaaggcatagagcagcgggttgaggcagcagtgcatgtagcccaggcctgaggtgaccgacttggccacgtctaccctgctttctcggccacagttgcgggccaaagcgcccaggtccatgaggatgtccaccagcaccaccaggtgatagggggtccagcagagggcaaaggccaccacgaccaccaccaccagccgcatggcccgcaggcgccgctggcccctggaaaccagcagcacggccaggatgtgggcatagcagtaggccatgaccagcaggggcagcagaaagccagccaccagctgcagcacccgcagagccgtgcggcccacctgtgggaagttgtattggcagtgggtggcgttgaggcgctcgtcgtggtgggccgacaggaagatgaagtctgggagggcgaaaagcaggcagagcccccagacagccaggcaggtgagggtcacgcgggccgggggcccccggcggtagagctgggtggcatgaactatgttcaggtagcggtcaaagctgatgcaggccagcaggagggctcctgcgtagaagttgatgttgaagagggcacctgccactttgcagaggccagagccaaagacccactggacggcagcgtccactgcccagagcggcagtgtcagcaccagcagcgtgtctgctacagctaggtggagcaggaaggtgtcggtgctgctcagggctgtccgccggctcagcagcacggctgccaccgcgccgttgcccagcagccccagcagaaagaggaggctgtagagggctggcaggaaggcccggtcgaagttcaggctgaagtcctgtgggcagggcggggaggtacagcacgagtcactctcgttttctccatagtcataggaagagctgaagttctccaggagggcggcaacctcggcgtcatttagcacttggtggtcactcacctgtgagggcgggaacggggaggaaggggctgtgtaaaggcctggcaggaactcttttgtgattgagtctgatttagtctgtgatttactctgagcagctcctcctataactgtccccgccagtcttccagggccgtacttcctcaactccatccgctcagcctgggctctgggatagtgacttcccttctcaaaggctgcttctctcgcattcttctgcgtgatcccatcggcccagggacccctgggcaggaagaagagcgtccctccagtgcccagagccctctctgcccactgtcctctctctccctgctctcccttcaggcttgccttgcgtcctcagtgccccacccccaacacatagttcaaccaccttcctccccagcgcctctccacaatccccttttccagtcactaaccctcctcttccctccttggcccttgtccggggaccccaacttcctgcgcccccccccaccgtgtggcctctctacaagtcaccacgccccccaaatgcatgcagtctgcccagtccttccccctccctacactgaggcttgcacggccatttagctgcccacaaggggatcccccacttagcttgagaaggaatcttctttatcccctcacccccagcactatggacctgcaggtctccccagtaccaatttagtccagcacgccaagagtcaaagttccaagtctcctgaagggagccttcgagtctacttgccccccgccccccccattttgcagacgagacaccgaagccagagaggagaggagaggcacccagggtcagtggccaagctgggttcccaattccccagtgctgtttctgccacaacccatgcggcctccagctactcacccaaccctgtggtgaccctgggctgtgggccagccctggcattcccctgatgccccgggttttccacttcgaattctggcctggcctggctgggcagcagcacttacctcaaggaccatggctgggctggtgctctggctgctgggtggtgtgctgcctgcccctctgctttggtgcttgtggttgg

SEQ ID NO: 2472 - DNA, 2602 bp, Homo sapiens; identical to SEQ ID NO: 2471
  source 1..2602: mol_type = genomic DNA

SEQ ID NO: 2473 - DNA, 7796 bp, Homo sapiens
  source 1..7796: mol_type = genomic DNA
tcccggcttcgctgcatttattgcaggtgggtgcacctggcgggagggcaggtccggggcgaggtcacacgacctcgtcggtcaccgggatggggttgacctggggacctcccgggggtccccccgccgccaccgcagcctcctcctcgctgggcttcttgcgggcctcggccgggggccgcggcggggggttgctgggcggctgcttgatggtgcctccgatctgcggccgctcccggggcttgggctcgatgggcgtccactgctcgccacgcacagccgcctgcggggcactgaagggttgagccgcgccccagcgcccgccctccctccctccctccctccccggaggcccaccccgctaggggccctgggacaggctcaagtctgaatcccacgcaggatggtgtgactgccactcagagaggttaagtgacgcgcccgaggccacacagccaggacctgggtcggcctgacaccagcccaagctatttcttcatgccaggagtggggcccgaacccctgggcttctggaagatcccgtggtggacactcccagatgcaaattctagtactcaaattctcctctcaaggtgccaagggcagggaaggcagggaggcaggcccgaggtccagcaggaggggtggcccaggagagtagcaggccctgctccgtctggtgggcgccattcacccacgctggccggcagccccccaagggtgcccaggcatttctgcacatgggggtggtggggggagagcttgaagaccacgggattccactggcttttactaaaaatacagactcctgggcccatgcccggaggttccactgcaacaggtcaagtggacctgggagtgtgtgcttttcatcttctatcccataatatctggtggaaaaatatgtcacatcatatacgtcatgaacagaaagagaaactggacatgtgtgatcctacctgactccaaaacggaaacattccattctgaaaagcaaaactagaaggctgatagaagaaaaggcaggaacgtgaaggcaggacccagggccagggaaaggtgttttcacaaagcacagaccatagagcaggtgaacagggaaacctctgctcttccgtgcagtgaaggactccacgcgccaagttaacagaccctcaccagaaagcatgaaggcatccccagtgtttaaaggttacaaaggctaaatagctaaaatatatgtggacttcctgcaacttaagaaaaagacaatcaggccgggcgcggtggctcacgcctgtaatcccagcactttgggaggccgaggcgggcggatcacaaggtcaaggagatccagaccatcctggctaacgcggtgaaaccccgtctctactaaaaataccaaaaattagccaggcatggtggcacgtgcctgtagtcccagctactcgggaggctgaggcaggagaattgcttgaacccaggaggcgaaggttgcagtgagccgagatcacgccactgcactccagcctgggcgatggcgcgagactccatctcaaaaaaaaaagaagaaaaagaaaaatacaaaaaccacaatagaaaaatgggcaaaggatttgaacaggcaactcaagggagaagaaactccaacagctcaaatccacagtcagagaagggcgagtccaagctccacacggccagctcgtgctgtgaaactggcaagcgtgggagaaagcctagtgcatggtgggagagatggggccacatggctggtggtgggttgtctgctgaggagcagctgagcccggcagggtgaacggtgcagaggctgatgcctgacccagcaattcctctctgggtttagcacaaggaattcctcccgaggtctccaggagccactagctgtgcgtggcagcagggagacgggggggatgcgggtggcccccggaaaacaaagcaacagcccagatgagcacttggcaacaggaaggggttctaaaggagagttctgccggtggcaggtcagtgaggcttgaaacagaactccacttccatacgcggaaggcgtacacagaaagtgctgcacctttcccacgcacacacactagaagacgcacagcaaggggagggcagttgcctctgcgggcaggagggacttggctctatggacaaaaggatttaaataagcaaagtctgagggctctgtccacccagagacccccgcagtgagaggtggcctgcagccgtctgttccggagcccagggcaggcagagggcatttcacccaaggcctggccaggctgcgccctgtcctcccacccatccctggcctctcagagagatcactgtatcccatgggatgggcagccttctaacagggtgcagcagtcataaaccaaacgcaggtgtcggcagtttaagaaaatgtctgcgtcctggcaccgcccatgaatcagcgcgaatagggtttaggtgagaaaagcctgataatgggacccaagcgcaggcacggtcttcggccggctgcgtgaccccaggccagtcacagcacctccctgagcctccgcatctttgtctgtaaagtggggaccccagtacccctcccagggctgtggtgcgggttaatgaggaaatgcaaggaaatgacccgacacactagacacgccaaaaatggcagcagcaaccgctgcgtccccgccgtgctgtgagcacacgcccaggctcacacttgctcccagccttggctcagcctacagagccggcttcaagggccatgcgtgtccgagggtgtcagggcaggggctggggatgggggtggccggggccgacctcagagggcgccactcaccagtaggtagatgccgctcgcaatggccaggcaggcggtcccaaggatggtggccagcaggaagccggcgggcaccgagagcctgggggacagcgggtgagaggcagggacacagaagggcactcagaaaggggaacggagccccaggtctgggggccaaggccacaaagtctcaggacaaggcagactgcagacccaggggacgtgcgcggaccggggcttgtttcggtcctgggtgttctcagccttgatgtggacactagcggctctggtgcacttgctcggaggaagcagccacgtgtgggtgtcctggcctcagccggcagtaaccagcagacacacagcacggaaccctccaccctaccaggaagcccaggcaagaccccccagcagtgcatgctgaccccagaccctggcgacggatcggagctcctcggatttggagtggatccttacaaatcctgcacactagacagcagacacaggccctgccagagccagggacccgaatttttgtttggaaaaacactgaggtaagtgggggtggctcctgtccaggcagcccggccggtgggacagtggggagggtcggctccaagccctcctgagccctagagggggtgcgggacggggactcacaggagatgcaggacggcccgaacatagtaattcctggtaaagggcccgaacagcttcaccacggcggtcatgtacttctgtcccctgggggagggaggaaggcgagacggcgcggctgggcctctcccactcgggactcctttgctgccctgctgaccaccccagggcacccaggcctctttcctcccacaaaacacaccgggcaggcaccggccttggtttacccacaagcaccaaagggttggttccggagcctccaagtgagaaaccaagctccacccaaccctgtgagccctgcctgggccccgcagcccccggagagaccccagagcaggaggagactcaccagcgctccatggtggagcccttcttcctcttcccccgggggtactccagcaggcacacaaacacgcccgccacactgaagccatgtggttaaggaacagcccagctcagcctgaggggccacagggaactccctttactgaagacaacacagagaggggcccgagcacggtggctcatgcctggaatcccagcattttgggaggctgaggcgggaggatcactggagcccaggagtttgagaccagcctgggcaacatagtgagaccctcatctctacaaaaaatttaaaagccaggtgcagtggtgtgtgcctgtggtcccagctactccagaggctgaggtaagagggtggcctgagcccaggtggaggctgccatgagtcacagctgcaccactgcactgcagcctgggggacagagcgagaccctgtctcaaaaaaggtcgggggcagccactgcctgaggtcacagagccaggaggcagccacgggaggttccaacaggtctggcactcggggctgcccacgccctccctcccaccaccctgcccagtgctccttgtcgcaaggtccggctgggcggcagggctgagatggggcagaggaggtagaggggccggtcaagggggatgactgacaggagcgggcagaggggatcccagcagtccaacagggaggcctcagtgctggccctggccctctggtgacaccccctgcccaccactcaccaggacttagactggcgggtctgccgctgatcgccacatggtcctggcgaggggcctggctgctggggcctgggctgcccaacccgtgcacagcccaccctgtgtcccagcctggctgcggtggtggggagcggaggcaaacagctcactgtgaagtggctccccagctctgccctgggcgttccccgcccaccccagcctcaggtggaaggatacatggagtaggcaccaaagtaccactgggtgaagcgcccagctgtggccacgatgcccccggtgatgaggactgcggggagaagtgggtcaggcactgtggggctcccgtcccgggggcctgggccaccccccttctctacctactgtgggccaccaggccacccagagctgccccctacccatccccacagcacagtgacagggtcggggacacccccaggaggcacccctctgcactggtgaagagcagagcctgtggcgcacgggctggcggagggggtgctggacatgcccgggctctgggtcccaggagtggccaaggacagcccgacctgcaggccccagtgggctctgggacccccaaatggacccccttgtcaccatgagtctttgtttgatgcactgaaagctaacaggccgagtgtggtttctgcatcttcttgggggagtgtctttttccccccgatacggagttcctcttaacccgtcagcggttttgccttaatttcggtttcgtctgatatggctatttctgcacatttttgggggggtattgtccaatattcccccttactgttttttttttttttcgagacggagtcttgctctgtcacccaggctggagtgcagtggcgcgatctcgactcactgctacctccgcctccagggttcaagcaattctcctgcctcagcctcctgagtagctgggactacaggcgcccgccaccatgcccagctaatttttacatttttattagagacagggttttcaccacattggccaggctggtctcgaactcctgacctcagggaatccgcccgccttggcctcccagagtgttgggattacaggcatgagccacggcgcctggtccttcctactattttatttctttttttttttttttttggagacagagtcttgccctgtcacccaggctggagttccgtggcgtgatctcagctcactacaacctccacctcccaggttgaagcgattctcctgcctcagcctcccgagtagctgggactatgcgcgcctgccaccatacccggctaattttttgtatttttagtagagacggggtttcactgtgttagccaggatggtctcgatctcctgacctcgtgatccgcccgccttggcctcccaaagtgctaggattacaggtgtagccaccttgccctgccagccattctgtttttgtctccacatggtcttgttggaagatttcctatccttggtttgagcccagctacacattaactctctgggtttgtctgtctgcgtcggaggaggggagggcagtgtccttgagtctactcagccaattgtccatgcatctttggggaccgtcctggtcccgagcctgccatccgaaagagggtgcaaagctgccgctggtgccaccagggaggtctgaggacgtattctggcacccagccacatttacagagcacctgctgtgtacaggggggactctttgtcaaggccctgctgtctccgggccagctgcctcctggggctgcacggtctggaaggacctccccaggcaggtggcatttgaattgagaaataaatgagacagccatgaggctctgcagaagcagcagcttgtgccgaggccctggggcacgctcaggagatctaggaacagaaaggaagcacggcagctggaggagggggccggagagccgggaggccagggcgggcagtgcagggcgtccagtctggctctaactcttcgggccaggagcccctggagggtttcagcaggaggccagactagagcccaggtctcctggctcccagctgggtgccctcagtccgtctacttcctgtagggagtgcggggcaggcagggtgagtctcacggggcagctctggggagagctgtctgaactgacccaccgacttcttggccgctgactcgaagcaggcggtcactttcctgggcacaggacaggctgcagggccccgtcctccagccctcccaccctgaggtctctgctcccactccagctgccacgcaccctccagacaacagggagggcgctcagagccccaggggagtggtggcagcgggcccctcctcctcaccctcagcccccaggcccttcccaggcactcctcccccggtgcaggtccttcctggagctgctgcagtggtgcctctgccctcagacctcgcctgagcccagcctcacccgtgctgggccagacactccctggccctggtcccgagagggtccatttccaaatggagtccgctgccctcaccagaacctctgagcaaatgcacaggagggtgactgggggctgtgccatcccaccccaagagcaaagtgcctgtgcagctgggctgggcagggccgtcactgggtggtttcggcgccttgtgaaatctcagaccgcctccagcgcagactccagatgagaagggctgagccccagggcatgagcccattccccaccccaagcccagggagagcgacctccaggccagctggctaccgaggggcaggggagcttctcccgatgcccaggccggagcccccactcgggggcttcggggcggtgaccccggaaaccaccggggctgaaccgcctcttcccctgcgctgcaacttcctccttcgcggagtcgggggaccgagagaagggaatgggggaggggcgccgcgctccgcagggtctgcaagggaattactgggggtctcagaactcctccttccagcccgcggcctgagggtcccgcccccgttccccgcaccctcctggcctgaccccggcccggcctggcccgcctggcgccccacttccccaccctgtaagtagcccgaggtcccggctggggtcttgggacacccctccaggctgcagcctccaccgtccctgacgtgcactcactcaggccggacgccagcgcctgttcgttggcccacatggcccactcgatctgccccatggcgacacgaacccggctgggacactgctaggcgcgcactgccgcccctgcgctcccggccgaaccccgcc

SEQ ID NO: 2474 - DNA, 8794 bp, Homo sapiens
  source 1..8794: mol_type = genomic DNA
gctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatggggctggagtcggtctccgagagctggtccaggcatctgggttgggacttcaacctgtcattcttggagtcatagaatgggggccacgaaaactgatttggaagttgtttgaacccaaaaatgcatctttaacccagaataggaacgtgttttcgaagtgaccaacttgagatagttagccataagttgaggagatattttaatccagccaaggaaactattcctacctttataagtaagctaggccgatgtttcccaaacttgccttttttttttttttttttttttttttttgagacggagtctcgctctgttgcccaggctggagtgcagtggcgcaatctcggctcactgcagcctccgcctcccgggttcaagcgattctcctgtctcggcctcctgagtagctgagattacaggcgcacgccaccacgcccagctaattttttgtattttttgtggagacggggtttcaccatgttggccaggctgttctctaactcctgaccttaagtgatccgcccgcctcagcctccccaagtgctgggattacaagcgtgagccaccacgccccgcctaaacttgcctcatcttaagaatccacctaatgtgctgggtggttctccagctctctccccaccccacccttaagtctccaagagattaagatcaggagtaagtttgggaattgctgactagactgtttgctgaactctttttttttttttgagatggagtctcgctctgtcgcccaggctggagtgcagtggcgcaaactcggctcactgcaagctccgcctcccgggttcacgccattctcctgcctcagcctcccgagtagctgggactacaggcgcccgccaccacgcctggctaattttttttgtattttttagtagagacggggtttcaccgtgttagccaggatggtctcgatctcctgacctcgtgatccacccgcctcagcctcccaaagtgctgggattacaggcgtgagccaccacgcccggccagctgaactcttaaattgtacaaagggtgggatgggaagtggaaggaggaagggcagattgcttgggaatccccattacagcttctgctcccggtggctcaggatttggtcagctttcctgattcatgtaagggatagtccctgacccggggaggtaacggagaggagtcagtggtcactgggatgactaactgttttctcaggtatctaagcaatggatccaagccctggaggttggtgagagccatgtattacccctagatgaaattggacaagagaccatgaccgtaaccctcctcgatgccaatcactgtcctggttctgtcatgtttctctttgaaggatattttggaaccatcctctacacaggtgggcctctcaaggaatcccagtgacttctccagactagatgttttttttttttttttttttttttttttttaatgtatagactggggcctcgcagtgttgccgaggctggtctcaaactcctgacctcaagcaatcctcccgcttcagcctccacagtagctaggattattggcacaagccaccacacctggcagacttttcttgagcagccttaactcaatagaagtctggaggcgctggaggccttctaacttcatcacatatgagcatagtgaccccatctcaactgatttcccactgtttttttttccttcttctttttgagacggagtttcactcttgtcacccaggctggagtgcagtggcgtgattgtggctcactgcaacctccgccttctgggttcaagtgattctcttgcctcagcctcccaagtagctgggatgacaggcgcctgccaccacgcccagctaattttcgtatttactattagtagagacggggtttcaccatgttggccaggctggtctcgaactcctgacctcaggtgatccacctggctcggccccccaaagtgctgggattacaggtgtgagccactgcgcctggccgatttcccactctttaagggtccgaaccttgtgaagagtaattgaaaaataggagtaggatggagacattacaacaaagaaaccatgcagctatactgcctagttcagtgccaggctacataatagttttttcacagactagtaagcaaacgcctgtctattgttggaggtaggagaggcttgtcttctattcttttgtctctgaccttctgcccccatgtacatattcctccaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggtgagttgtttcctttcagtttcctgtcacctgtagatagtgaactagattctttaaggattctcacatctttcagatctttgtgcagttctcactttctcctacactgaccaccttatttaaaattgcaacctggctaggtgtggtggttcatgcctataatcccagcactttgggaggccaagatgggagggtcatttgagcccaggcgtttgagaccagcttgggcaacatggcaagaccctgtctctacaaaaaatttaaaaatcagttgggcacgatggtgcgtgcctgtggtcccagctacacaggggactgagacaggaggattgcctgggtccagtaggaggtcaaggttgcagtgagccatgtaagtgccattgcactccagcctggatgacagagcaagaccctgtctcaataaatgaatgaatgaatgaaataagtaaaactgcaacctgcccaccatccccattcccaactcctgatcatccataccaattcatttttttcatttttttatagcactcatatactatatatatttttaaatatgctattgcttacttgttgtctatcatgcacttcctctggcccatgcacatacgcgtgcacacacacacacacacaagcataaactccttaagagcatcactggaaatgggaagagactttgtgtgtttgtggaacagagaagcagcagtcagtatgacaggcacacagtgggcaaggaggctgaaaaggcaagaggggctgaagtgctgttaagccattttggacttgatcctaaacccaaccaagagctattgaaggattttaagtagaagagggacaatatgcactcatcaccttgcaatatattctataatttatgtatttattggactttttattgtctgattccccctgctagaatgtgaattccactatggcagtctctgttttattatgggtgtatcacaaatgcctacactaatgcctgacacagaagcattcaatatgaatgaatgaaatttatcagaacatagatatttaagtgagcgttgtgctttaaattaagtatactgaaaaaacaggtttgtgcttgttgtactgattataaatagtataaaacattgttgaggactctttcttggagttgccatttggaatagtttatgaaaatacatttttgttttataaaataaataaatgtaatagatttggttctaaattacttttttggttgtttccaaatttgtgagtctacaaaaggacaaagacttgccaccattataaatatttgaaaaggacatgtctcaactctgaaaggagtttcaaaatgagactaaacaaaggcattgaaaaaattatataacttccagggtgactaccaaatcgattgagaaatatcctctactctcaggattgcttagctacttataaagacctaaccattcttaatattttaatgcagaattttctcaaaaaagcaaagctggctaggaggatgctatagtaagccttaattaattttgcaaatatgtaataagcctctacccactaagtaccaagtatccaataggcagtggggatataaagatgaataaaatatagtctctgacttggagggctcacagtctggtagggaaggacctgtggggaggtggaagtgggaatatatatagagagaagaaaaatccgctccatttgtgcccaaggagtgagattttgaaccataatcaggaataaagtggatataaataatatatacttctttttatggcgttcacaatctggttgtggatttgaaacttcttcagaaaaagtctgagaacagctattaaacaacatctcccatatctgttaccataaccatttcccaaattaatgtctccatttctttctctgtaagtactatttgggcccttcaattgaaacttccactccagcttcttctcatcctggcagtcaaataatattattaccatatttttctttttaaagccctgctctgagcatattattcttatgattagaattagccattttcctgcttcacactcagtggctccccttcacttacacaatgaagtccaagcttcttagcggtacatataagacgctctattatatggcccttgcttgcctctctggtatcatttcttatcaattccttttttactttagtaacagcaaactgacccctcttaaaatgttttccactataccctttctaccctttccttgccaggttaaccttgcccatcctttaagatttagcctaacgttccctaactccatcacctgttagatacaatactgtatactttttttgtttttttttaagagacagggtctcactctgttgcccaggctggagggtagtggcatgatcacagctcactgcagcctggacctcccggactcaagtgatcctcccgcgtcagcttcctgtgtaccaggaactataggcgtgcaccaacatgcttatttgtttatttttgtagagacagggtcttgccaggttgcccaggttggtcttgaactcctgggctcaagcaatcctcctgcctcagcctcctaaaattgtaggcttacaggtgtgagccacagtgcccggcctgtacacatatctttaacgttgctcttaattgtggtttttctgggtctccttgtagatagtacttcttgaggactgacagttttctttattagttttcatggtgcctgaaacttgctagatgctctcttttgttgaactaaatgaatgagtggattctgtgtcattccctttcatatgtcttagctcaaatgccacctcttccttgatattctccctggatttctccatgaattgtatctatttttgttaaacattttgttgatttattaggattttccaatagcttaattttcttccttctcttactttccccaatacattgaacattatttaggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcagcactgaagccttgccaggtggtgcccattgtaagtcggcggccctgtggaggctttcaggacagtctgagccccaggatctccgtgcccctgattccggactctgtacagcaatacatgagttcttcctctagaaaaccaagccttctctggctgttagaaaggaggctaaagaggccgagaacccaaggtgttgtgtttgaatcccctgaggaaagtgctgatcaatctcaagctgacagagactcaaagaaggccaagaaagagaaactttctccctggcctgcggaccttgaaaagcagccttcccaccatcctttgcggatcaagaagcagttgttcccagatctctatagcaaagaatggaacaaggcagtgcctttctgtgagtctcaaaagagggtgactatgttgacggccccactgggattttcagtgcacttaaggtctacagatgaggagtttatttctcaaaaaaccagggaggaaattggtttagggtcccccttggtacccatgggagatgatgatggaggtccagaagccacagggaatcagagtgcctggatgggccatggttctcccctgtcccacagcagcaagggcacccctcttctagctactgaattcaggggtctagcactcaaatatcttctgactccagtgaactttttccaggcagggtattcttccaggagatttgaccagcaagtggaaaaataccataaaccctgctgaagacaggagagtacagaatgacaacattgagcccacactgcagttttgaagatagtaactgatggctggtgggaaagagtttgtttttggggcctacttttctatctttacaagactcttatgggcccaccgtggagcagcacttcccaaaacttgttcactggggtcctcgtgcctatggaatccttctttttataactaagtttaagaaatactttttttataaaatctttggagtatgcgtgagcaaattaaaagttctttgaagtcctacagtaacttaatctgtttaaccttgtttaacccagtatttctcaaacttttgtgaacatgcaatcatcttatgtgggtacagaaagaggtaaagagtctgaatcaaaaaggaccaggttattgctgttgctgttttgtggtgtcatgagccattctccatgtccccttctccctcttctcagatcaaaatccctagggagttctatttttaaaattatgaactatggcgctgcatgcttcaatcctgaacgtcactgacttgctgtgaccatccaaataattttcctgtctctgcctctgggagggaacaggaagcgatgaagaggtcttggaacagtagtgaaaattctacctctatgtccttcatgaggatgtgcagtatcccagtatcactgggatccatgtggaacagagccagctggggggttgggcagctctctccaaggcagtacctagagcccagctgaacaacaaggctttgggtgtgaagggactccccagcctggagaccctatttggctgaaacagttacaaaatatcaaatgtgttgtcagatattcctccaattgttcacatagctgggatatttgttgctcccctcaccccttggattatgtagggagccagtgcacacagcctgtttgttttagtatccaaggaagagaccaaggagccagctggcgggaaggggtgggggtgtgcagtctgccctgtccttctgctcataacctgacaaaatgccaaactagtaagcaggatagctgataccacggctatgagggagtaggctctgagagggcacagacttgtggagctgggcgtctggatcaaaactgctttgggatggaacctcgagccctagcagtgaagaagattccatttcttgtccaggggatttaaaagagttttctgctttgagagagaaatagagagtttagaaagcaattgctcttgggaaagctatacacagctctgttttgtcaatgacctttgttgtaagtctcccaacgtcctattaggagccacagcaggtgaggcatttggtgcagcaggaaacatggggactgcctaggctcgaatctgtggcaccctgagcaattacttaaattgtggagcctagttcctcatctgtaagatggacttgagattcctacctctcatgattactatggagattgaataattggtaaaattctcctagctcagtgactgccacaggatgggtctttcagattttggttctctttagcttctggttcttgaaagaaattaatctgtatataacataagaaactttgaaagtcaaaaaaacaaaaaattttaattcctcgtagattaattgatttgctatcttttagtttttttttctatgcatgtagatgtattaaatatgtaaatgtttttcaaagttgaggtaatattgtatagaattttatagcctacattttaatttcttgatatcttaagcatttcacttattagatattgttcaaaaatgccatttttaatatttgtataataccctatcatgtgagtataccttaactaagccattcccatattcaacattttgtgtactgtttttctaattacatatattacaatgaacaaccttatgcata

SEQ ID NO: 2475 - DNA, 29372 bp, Homo sapiens
  source 1..29372: mol_type = genomic DNA
gcgctcccgcttgccgcagcctgcgtcgtctgccgccaccgcgcgccttcactgacctacaccaccgccgccgccgccgccgccgccgggctcgctggctggcccggtgcgggcggcggactcccgccggagaggactgccagcgccgccgccgccgccgcttcggcccgggcccgggccccgaccccgtcccgggccccagcgccggccgcccgcccggtcgggcgatgaagtgtcactatgaggcgctgggggtgcggcgcgacgccagcgaggaggagctcaagaaggcctatcggaagctggccctgaaatggcacccgggtaagtacctgtcccgcagcccccgcggccactcggagaagcccggccctccccgaccttcccttcccccgggcggactccgcggagccagcagagagggacctggcggcctaggagctccttgccccgcccggccagtgcccggagccgccctgcccgtctcggtgggcgaagcgctctgccctggcgcaccccggctcacaccccatctcctcatacccgcgaccccggccccgcatcgccactgtagggggaaaactgcagtccaacaacctcacttgctcccgctaccgggtcgcagacaccacgagggagcagtcgggaactcggaactcagacctgccccaggcttgcttttccctgcgtcccttgcagcgcagcctctcggtgtttttcctccgctgccctccacctcgtccgggaatcccagatacttcaacctgatgtatggctcttttcgtttcttagttaagaagttaagacacgggagctagtaaaatatcttttcaatagggatgcgcttttttcgctgttttttttttcttttaataagctgtttaagcagaccttgtacttcactttggacatgattctgccggggaaggttttaatcaggcggcttccccagtaaagtttgtatgtttacttagaagtatccttcctttggatgtttcattggtctgtaatccaggcctgtgtgacttttatgaagtaatctgatcttccaggctgggaaactaagagagtagttgactttcagctttttgaggttcatatgaagaggctttcatattagcattcatcagtaaacacggttacagagtatccaatatatgcaagtcactgcactctactaagtagatttggaaatgctgagacaggggtcttagagtcttgttaggaaaacaactttctgccttacacaaatgaaaagttaaatacaactgccagaaaaaaatcgcaacatacataattggtggttagattaatggaacaactaatatatgctccaggaattcagggagggagttaccattttgtattgagtcttccccttctcagaggagtttggactggatcgtagaggaatgcaatttggaaaagtgaactcaacagtatggaggatagcatggtggaggacaaaagatgttccgggggacagtttgactgaaggtggtgtgtattgcaggtctgaaaaatagggattatgagaggagtggaaggaaaggtcagggacccaaagtcaaaagggaatggctatggtgatggagtgagagatagaggtgtgggtctgttacttaaagttatgcttaccaacagaggcgtgaaaaaatgtgattataaatatattagaagagcagaagtaaatgaactgatgttcatcatagcagtaagtcagaagatacagccaaaattaataaatgtaaaaatagtgtagaagtatattcttagagtttgggttagtgtagaagcatattcttaggagtttgggttgttactgttagaaatcaagttaggaattagaaggaagttcggaattccttgactttctaggtgggaaagggtaaatgaagtagcgaatgctgtgaccaaaagcgtatgtaattttctgaagagtgattttaaatcagattgtatttcttgagtacaagagtagtttgaaatcagattgtatttcttgtaatcttgaatattagcccaaggactgtgaaatttgcttcgctaaataagggagagttgtggctggttttattaagctgccatgggagagtactatgaaggcaacttagtggattgaagagggctggagacagaagttagggagagtccgcagtggacagacaggtaagggcccaagccaggcttggggtcagcgggagggggaaagcgcaaggggaggagatgttgggaaggaaaaatgaccagatttggtgattaattagaaatcagtgctaggaagaagcatgcaaatatgactaaagtatcagttaactcctttgaaaccaaacctgttaggaactgaatgcaaatatcttctctaaatatcatcataatttatggcatcagtgtgatggtatctgagaatgggcagcaggaagccctgaagagccatgttctagggcggcaaaactatttgtagataagacattgctgtcatgttttcttgtaacttcttagaagggaagtattgagctgtagcttaaagaactttagtgtgctccggccaggtgcggtgactcacacctgtaatcccagcactttgaggggctgaggtgggcggatcacctgaggtcaggagatggagaccatcctggccaacatggtgaaaccctgtctctactaaaaacacaaaaattagctgggcgtggtggcgcacgcctgtggtcccagccacttgggaggctgaggcaggagaatcgcttgaacccaggaggcagaggttgcagtgagccaagatcgcgccactgcactccagcctggtgacagagcgagactccatctcaaaaaaaaaaaaaaaaacgaactttagtgttctccatagtcaattcaaaatgctttacgttctgaatatattagttgtctattgctgtgtaacaaattaccaatacctcagggcttaagacaacaaacaacaaaaacagcaagcctatgttgactatatggactcccacagtttctaaggatgagaatctgggagcggctttgctaggtggttttggctttctcattgtctgaaagaacctgcttccagctcaccaactcaccagctcaccaaccaccaactcatgtggttgtggcaggcctcagtgctctgccggctattggcctccttcaccccatgagcttctccagcttctccataggcagcctgagttgctcatgctatggcagctggccactcccagagtgatcaagagagagggaaagcccaaggtagaaactgcagtcttttataacctcatctcggaagtgaggtaccattacttctgccatctcctgttggtcacacagactacccttgctgacacagaagggactgcacaaggtgtgaatgccaggaggcggggtgctgtcttgcaagctgggtaccaccctgaggcaaggacgctttctgaattccatggttcaggaagcacagctaaggaaataataactaattagtgtatattttttaaactttatgagatttcttttgatatacattgatgagaaagaaaaaaacaatgtcagcactaaacataatctagtacaaaataagtctttctagaactgattttatttattttactccttttaaaagtaaaatttatactactcaggtttttccttttgtggatatccagttgacttgttttacttttattttattttattttattcattttagagatggagtcttgctggagcacagtggtgcaatctaggctcactacaacctctgcttcttgggttcaagtgattctcccacttcagcctcccgagtagttgggactacaggcatgcgccaccacactgggctaatcttttgtatttttagcagaaacggggtttcaccatgttgaccaccaggctggtctcaaactcctgacctcaagtaatccacctgcttcggcctcctaaagtgctgggattacagtgggcgtgagccatcacgcccagcccagttgactgtttagtgatgtaccaaggcttagggaaaagcctgaaatttctgcttagattgttgcttttaacaaatcctgattattgactgttacgtggagtctttctgcttggccctggttgtttcttgttttgtgcacgtctcatctgtttgtggcatttctgatggaaaatgtcttatttagattctgtcctgtacgtttttgattgacttaaatttctgtgactttaacagataaaaatctggataatgccgcagaagcagctgaacaatttaaattaatccaagcagcatatgatgtgttgagtgaccctcaggaaagagcatggtgagcatcacgctgtccttcccatcctagtttatgatgttgggagcagttatcaatataggtggttgttttttcaaatttagtacattaaatggtttttggtgtgttctgaaacatctgtcacctagtcatcacataaaatctaacgtttgggtcagaaggaagcttggaaatgattgctccaattatctgatatcatagggggtgaaacaaagtttggtgatattatatagttttaattttgatactttaggtgacttctcattaaataccctttggtgtatgatagatttactgatatcagacaggtagaaggttttcgttttttgtttttttttgagacgcagttttgctctgtcacccaggctggagtgcagtggcgcaatctcagctcactgcaacctctgcctcccaggttcaagcgattctcctgcttcagcctcctgagtagctgggactacaggtgtgtgccaccacacacctgtattttttttttttttttagtagagacggggtttcagcatgttggccaggctggtctcaaactcctgacctcaagcaatccacctgccttgacctcccaaagtgctaggattacaagtatgagccactgtgctcaaccaatacagtgttttaatacaagaatggtaatcctcaaaactactttatatgaagaaattgaattaagcttctgcatctgtgacagatattactaatgatggtgtgatcatttaaaataatttccagatgaaaattactatgttgaagttctgagttttcagattctcaattaactttttgctacaaggaaataggttttaagctttgacataactgtgcaagatcctgctcttacaaagagctactgtgcaagtcatctttctgttaaacagtgtacaaccaggtggttgtcaagaaagaaaggctgcaaagaaaattcttacaaaattgtgtttcataagaaactcagagagaggatcctgaacatttctctactcaaggaatttggagatctggtcttagaattgcttttgccttcttcccagaactttgaaattctttcctgacttccttttgcctactctcttctcaagatcttgggttgttttctgatccttgggattcctttgtctttttagtcaaagctcttgcctagtaactctctttttacctggaagcagtaccgtgtagtggctaggagctggtcttcccaatgtaggagacctgcttctgaattcagactttgctggttactggttttattattatggatgacaaattatgtaatatcactgagcttccatttccttttatatcagatggagataataactgcctttacagagttattatgagaagcaattgtgtgtgtgtgaagctcctagattaagttgacataaatttaggaagattcttattccagtgcatcttggtaaatttccaaatcacagatgtgtaatgattctgtgggccagatttcctatgtcctgttttatgtttctttcctgtggaagtacgggactcagagacagtcatggaaattccttggctttttaaattcccctgttcatgtgggctagcattgtataatgtatcagaagttgcaggcctagttataattaacagttctgtgaaagattatgaactcttttcatgttaatatttcattaaaaatttttggttatggattggacatatcaacaaccaaaaatgtacaataataatattcaaaaggagcaagaaatccttttgaattcttacttattcagccttcacaatgatgctaatttttgtttttcaggtatgataatcatagagaggccctacttaaaggtgggtttgatggcgaatatcaagatgacagcttagatttgctacgctatttcaccgttacctgttattctggttatggagatgatgaaaaggtaagataaatgaactcacccttgatttctcatcaagtacttcattaagactcacatacaaagagaattcttaaaactattctgtaatagaaagtgaagcagtgttcattttgaaaactgaagatgcattgccttcatgtttaagctgtcagtgtataaaaacctctagttgaaatctaaatgtattgcagggactgaactttgtcccaaaattcttcaacattaaaatttttcattttgtattttaaaatctttttctgtgatcaggctgcaaaagtattaagaatttgtttttgttactgttttttagggattttacacggtgtatcgtaatgtttttgaaatgattgccaaggaagaactagaatctgtgttagaggaagaggttgatgatttcccaacttttggagactcccagagtgactatgatacggtaaaataaaaatgcattgttctataattagtatttatcactgtgtcatttttaaattttattttactttttgagatggtctcactctgtcacccaggctgcagtgcagtggtatgatcatatctcacagcagcctcaaactcctgggcttaagcaatcctcctacctcagcctcctgagtagctgggaacacaagtgtgcgccacgacatctagctaatttgtcaattgttttgtagagatggggtcttgctaagtttcccaggctgatcttgaactcctggcctccctccttggcctcccaaaagattgggattacaggcatgagccacagctcccagcttctcatttccttgttttaaaacaattggttctagttctcgaacctatcccatgacctctctttgtctctcttcctttctgaagtagcttttcgatctcttgcaaccttccccctttacttttccctttttattttttattttatttgtttattttttttgagatggcatttcacttctgttgctcaggctggagtgcattggcaccacctcagctcactgcaacctcagcctcccgggttcaagcgattctcctgcctcagcctcccaggtagctgggattacaggctcccaccaccatgctcagctaatttttgtatttttagtagagacaggatttcatcatgttggccaggctggtttcaaactcctgacctcaggtgatccacccacctcagccttccaaagtgctgggattacaggcgtgagccaccatgcctacttttcccttttaatttactaattgtttactgattatttactaatcaccatggtcccatctagtgattagtaaggctatttttattttctcattaagtttattttgaagagtgattttttctggaaagccttaaaagtactgtcttctccagagattattagaagtgttatatacatgaaaaaagaaaggtaaaagatgtttcgcatcagtaatatttactgcttttctaaaaaaaaatcttaaagcgcagaagttaatctgttttctttgtcactaggtagtccatcctttctacgcttattggcagagtttctgcactcaaaagaattttgcatggaaggaagaatatgatacacgacaggcttcaaaccgctgggaaaaacgagccatggaaaaagaaaacaaaaagattcgggacaaagcaaggaaagagaagaatgagcttgtccgtcagctggtagctttcattcgtaaaagagataaaagagtgcaggcgcatcgaaaacttgtggaagaacagaatgcagagaaggcgaggaaagccgaagagatgaggcggcagcagaagctaaagcaggccaagtgcgtagcgtgcgtggggccctcttctcagtatcggtgggggtcagaggcagcaccagaggtaccttacatgttcatgttgggttcagtcatcagcctggctttatcctgctttttcttcttttttaaattgtggcattggatagtgttttttcatctactgtgtaaaaattattattatttttgggacagtgtcattctgtcacccaggctggagtgcaatggtgcgatctcggctcactgcaacctccgcctccaggttcaagtgattctcctgtctcagcctcccaagtagctgggattgcaggtgtaatatgccaccatgcccagctaatttttgtatttttagtagtgacgaggtttcaccctgttggccagtctggtctcgtactcttggcctcaagcgatctgcccgcctcagcctcccaaagtgctggaattacaggtatgagccacagtgcctggcctaaaatttttatttgaattggatattttccttcagagaccctttacatttgagagatcctttagacttttgtaaaacttaataattttaattaataactagcgttaattgaattcttcctctgtgcaaggccacgttctaagtgccttcctcacagcaatgctgtgaagtacttatcctccttgttcttctgaggaaacaaggctgacaggcctgagatcacagagccagtaaatggtagagtcaggaattgaacctgagaattctgactccagactttcctgctttagccaccgtgcagtactgccttttggtcagtgtaccctgagatactcagttcattttagttcctctaaagttttgttattaaaaagttactgtaaatgcattgtgtccagagcattatagcatacttttaaaaattattcacttcttaagaattctactcatcccaccctcatcttttgaaaattaacactttacctacatgacttaaaatcatctgaagacttttaataagttgctgagtttcatgtttcaaaacctgttatctactactggagcaattaaaattaaccatacaacaggtaacaggtttaagtgactttgccttggttttaactaagcacaggttttaagtttgtaagcgtggataggttgggagcaagctctctagtgggaatggattttaaacctaagtagtaagtgaaaaccatgcagaggcgtgcttgtcgctgtgagactgtgctgtatgtgtctagactggtggagcagtacagagaacagagctggatgactatggccaatttggagaaagagctccaggagatggaggcacggtacgagaaggagtttggagatggatcggatgaaaatgaaatggaagaacatgaactcaaagatgaggaggatggtaatattatttttattttatttatcttttttgttttttaagtgaagctggaaatctccttgcttatttgacatctcccaatttttaaatgtggcaaataattaaaaataatgttgtatgggccaaaggtagtcggctgagctagtctaattcaagtaatttgattaacaaattcttttctgaccatgtcctaaacagtgtgtacttctagctgcataatatgacaaatggacatgtttacaagtgtgactatttttttttttttttgagacggagtctcgctctgtcgcccaggccggactgcggactgcagtggcgcaatctcggctcactgcaagctccgcttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcgacctcccaaagtgctgggattacaggcgtgagccaccgcgcccggccaagtgtgactattaaagaaaattcaactaagtgataggtcaagttttaatagtaactatttctagaaaagctgatattgcatgagaatctatgtgttgtgtataaattcttcctctcccttgtgactttatagaagggctcctcttggtgtgccaaaatgttgttttttttttgccgctatcattagagcacaggtatttgactaccttaaaaggcaaggattaggcatttttgagaatagctgtatatctgattttccccactgtctctataaaattgacccagttttaccttatctacaaatgtgatttttcagattcgtagcccaaataataaaatgataaacttttatttattcaaaatgactaggaagtgaagcgttttattaatgaatcagaagtaatacttttgaaagtactttgaaaattataaatcactctataaatgtgaggtggcctaatttccatcgagttttacaatttataaagtcctttcacgtacaagctctcactggatcgtcacacaatcccccttacatggaggttttgctcatggaatcgtctctgttttgccgttgtggaaactaggactctgagaagctatgagatgtgcctgagaatgtatgaccatttttagatccagagtttttgcttcaaatccagtattgttaactattcgattaattaaaatttcacatacatgatatattgaaagtctacaataccataatggaaaattaacaccatatattaaacattaacactagatagggtatattttgatcatttatgatttcaatgagacagtccttcaaaatcatactgacatcacttataaataaccaacatgtagaatatggaagataccttgagatatttattggtcctataataaatcccaaatgacagtttacatgtttgtttcttcaaaaatagaatacggatttgtgaaaataatttcaattgagctttttagtcagttggtttttgtggactatactgatagtaattattcagttgtaataaagccaaaagcttattaaaaaaaagtttataatgttaaactttacatgtaatatgttaacttatggcctatccgtcttacagtgatggaatgttataaacttataaactaagtttattaagtatttaagagtaagtcacagttgtaaatgtgtttggaccaaatcttgctcaagaggtaaactaagaaaagaccttttttgaaaaactgcttcgtggtagaactatgaaagtgggatttaattttttaaacttagctgacatccaagactttaaagatgttttatatcttcttctaagtagacttaggaaaagaacttgaaagttaaggtgctttatttggagcctttccttatagtacagtgctgcttttaaaaagccaactcaaatccttaggattatttttttttaggtaaagaaataaaaaaatttaatttctaatttgttagcatattttagatttgtgctctgatcaaagagggttcttactgtaggcttccctgtcataggtaaagacagtgatgaggccgaggacgctgagctctatgatgacctttactgcccagcatgtgacaaatcgttcaagacagaaaaggcgtaagtttattaatttaatttaatttaattttgagacagggtctcactctgtcaccaaggcaggagtgcagtggcacagtcatgactcaccacagcctcgacctgttgaactcagatgatcctcccatgtcagcctcccaagtagctagggctacaggaacctgccatcatggccagctaaaaaactgcagttacttttgcaccaacctaaatattttctttggagatggggttttgccatgttgtccaggttggtcttgaactcctggattcaagtgttccacctgcctcagcctttcaaagtgctaggattgcaagcgtgagccactgcatccagttaaaaggagtaagtttagtatctctgaacttgtgttttctttttttttttttttttttttttggagacagagtctcactctgttgccccggctggagtgcagtggcacgatctcagctcactgcaacctccacctcctggattcaagcgattctcctgcctcaagctcccgagtagctgggactacagatgcaggtcaccgcacccagctaatttttgtatttttagtagagacagggtctcaccatgttggtcaggctggtctcaaactcctggcctcaggcgatccacccacctcggcctcccaaagtgttgggattacaggcgtgagccacagcgcctggcccttgtgtttttttttgaggtgaagtgtaacattttgaaagttctaaaaacaatgtgcttgtagcagttgataactagccccacatactgtctcgggggattcctttccagcagggtagaaagaggtatttgtacctgccattaaacctgttgtactgattgtcactcatcccagtattcctatagctgcttttaaaacacatgcactgtctccagaagcattgcttgttttggcaaagaagacatagtcacatgggcaaaaagtctagaccgtgtctaatcatctccctccatcattggtgtcagactcacttcccaccatcattgtcccatgcaggctgatgctgccaatataggggctttaaacttgtctggcccagagtatctttgctgaagtggaagaactttatcttaggggaacaatgatgaagaaagaagtattaaaacggataccattattataaaggagggaggaaacaacacgggagaaaatgggagtagaatcagcaagggaaaaaaagcaaaatgggcaatcagagagaaaggaggccaaaggatgagaatggcgctgtgagagtcataaatggtattaccatatgacctcagggagaaatgacagagtactaggggaagtggaaagaggcagaaaaattagaaacaagcaagaaaaaggtcaacaatgaaggagattaaaaatttttttttatttggaaatgacacacttaaaggtaaattgcaagaagagaatatagtgtgtctgattgacctgttactaacgttttgcacaatttgcatgtcctctttctctctacacgctcaacacacacacagtatttttctgaataatttgaaagtaacttacatatatagtgttcctttacctctaaatacttcactatatcttaagaataaggttattctcgctgggcgcagtggctcacgcctgtaatcccagcactttgggaggttgaggtggacagatcacctgaggttgggagtttgagaccagcctgaccaacatggagaaaccccgtctctactaaaactacaaaattagctgggcgtggtgacgcatacctgtaatcccagctactcaggaggctgaggcaggagaatcgcttgaactcaggaggcggaggttgtggtgagccaagatcgtgccattgcactccagcctgggcaataagagcaaaactccgtctcaaaataaaaaaaaaaagtaaggttattctcttatgtaaccatgctacagtgaccaaataaaagaaattattaacattgatatggtatttttatctaatttactacctgcattccaattttgccaatcaattatttattaatatagaatttttctccaatacagaatgcagtctaagaacataatctggaacagcttgtgttgtcttttatgctgtttacattttagaagtacactgttttcacttttttcatagaattcttctcattttgtctttgtgcatttcctcatgattagattcaggttatgcagccccaggagggacgccgcacaagcatgttgtgctctcagggattcatagctggagacacgtaaagtccttctacccctcatttgtcgtgataattttcatcacccaatcaaggtgtcatctaattttactactatactactaattttactatagagttagtattttttcccttgcaacaggttttcccttgtaacatgtttaatctgtgaggagacactttaaaactatgcagatatcttgcttctcataaaagttttcctcatagctttagcatctgttgatggttttagcttgcgtcagtcttttttatgatggttgcagaatgatgcttttccagtgccagtaccccctcaagtttttatcagttagcacttggccttctgctgtaaacaggagccttcccttttatccatttatctattatcagtttgaatttatttctttttttcagtgttttataattcattactgaccttttcatgctcaaatttttccagaattggttagtgagcattccttcaaaccacccttgtgtccttttgacatgtgcttataacttttttggaggacttactttcagacacaggatcttccattatctccagggcagcttggtctcaaggagaattttagtaggaaagaaaaacagcaactaaaactataataccaaaagcctgaacagatgagatgaagtagatagttgacaaagtttcctgctttttagttgatataactcttgtagcttatgttgtcaaccctgttttgttgaatgctttttagttgcctgtaggtgtgctgagacagacattgccagcagggttttgaacacagggatagagatgtgtctgaatgtacgttacggtggtgagagtgagaaaggagacctctcctgagaaggtgaaaagcagctgttgaaaaagcaagaggcagtaaactgctcttgtatttcaagccttcccaccaccatttctctagtccagggggctcttccttttaacattaaaatgtgtgtcttctaatttcccagtgatccctccaagtctgtgggatggcctggaatgtaaaaacacttagcaaatacttagtgattaaaagaaaacaatggcggaagctttaagaattgaaaaatcaaaataataagtagagaatttgtccaaacctccccctgccgacattcccccatccccagaaaggaagaaaatgtatgtagataaaaggacagagaaagacagggaaagctgtggtacggaaagaaagagtgtggccacgagcttccagtatgctcactgccaaggaatcctgacacgttctgtttctctgtataaaatcatgaacaaataaaaaaaaagaaaaaaataaatagaatcagaaacgttttgcttagtgggaaaaaagctaattttatcttggttgcagttatccagcaacattatctggacacgtgaactaattttagcgcagctgctcacgtcagattgctctttcagcatgaagaatcacgagaagtcaaagaagcatcgggaaatggtggccttgctaaaacaacagctggaggaggaagaagaaaatttttcaagacctcaaattgatgaaaatccattagatgacaattctgaggaagaaatggaagatgcaccaaaacaaaagtacttctaaatattaaatgtcactagaaatacttatcacattcagagattgcattaaaaggttttttttgagatggagaatcactctgttgcccaggctggggtgcagtggcgcagtctcagctcactgcaacctccaacttgtgggttcaagtgattctcctccctcagcctcccaagtagctgggactacaggcacacaccaccacgcccagctaatttttgtgtttttagttgagacagagtttcaccatgttggctaggctggtcttgaactcctgatctcaggtaattcacctgcctcagcctcccagagtgctggggttacaggtgtgagccactgcgcccggccttaaaggctgttttatcccaaggaagttattctaactagaaaagattgtctccatattttctagttaatggaactttatagtgttgaagtggatacagacgtcaactataatatttatagaacatattatcactatattaaaagcagtttttatacctggcagttgataagctaattactatccattgaactacagccttgtgttattctctaaaatgacaatgtgaatactttattttccttttaatgctttaagatattaaatatttttaatcttttacttctgttttactactttatcactagtgtttcaacttttttttttttccacttactcttcacagagtcaagtatttgacatttcgatttatatttgctcttaggctttctaaaaaacagaagaaaaagaaacagaaaccagcacaggtatgttagaaaggttttgttaacattaaatgccaacgataaagttgcagtgctcttatttattcagtgtagtctgtgttaaggagagaaacttatactccataattttatgttgattgtaagattgattaaaaaggaattagaaatattttccttttttagtgcttccccccccttgtatgtatgtaataacaaacttaattatgactgccagtgtgtttaacaagtatgcatgtagaattcccctggtatgaattagctgaattttcagtattttaaaaatctgaatacatctcacaaaaggcttttaagtcaagacaacaattaaaatcttgaaataggaaaatctgggattggtcatttttttatctcagtttattctgccaacaacataaacattgcaaaaggaacatttggttagaaacttgtaatgattgtgagtcttgaaaaaatgtttctatttttctgaagtttaagtaatttaaatatttcacagctgaagtccaaattcattctctgtcttaaggactatttttaaataaaatggtattatgttgttatacctataaaaataaagtgaatttgtccattttaccaaggacatttggatttatggcattttagtataatctagttatattaacttacattaagtattaaatatttttaagaaaacacattaatgctttttaataaaacttcagatttggtttatttatccaaatggttataataatatatttaatagtcttttttaaaatcagtttcctattcaaaaaatgatatatgacacatgagttaatcacttaaaattgtaatttggaactttttgcttcagttataaaaccgcatagcaaatatgtgttctttttataaattgacatctaccatcatccatccaaacaccttataattattagtttggaacactttctctttcctttgtgtatgtcagtaccattacagtaaggacaaaataaatggagagagatttatgtttaacctgagcctgtattaccttgattaatggagcatagattctattgattgcaaccataaacacatacgttagtattttcttactgatgaaaatgcttcaaatgaacaccccatcgtttctctcaaaagctatattcctttatagcatctctcgtttatgattcctgattgtagcaagttcagacctagcttgatgtaacacttttcctgatattttctaagctctttttgaagggaagggcagtgtggagaaatgtactgatagatttaagagcagacggcagcaaataatgagtatcttgaaacttgagattggggaagttttctgtatggccagaaaaattccataaccaacaaggaattgtacaagaaaaccctcccagattaaaactgaatgtaaatagaaagaaatgaccctgactgacaggaaagaaaatttaattcaagtaactcaaacatagtactctgactgaataccttccaagggatatagttgaaagataaaattaactgccaaaaaagtaagtcctgaatttagtatgttttttggtggtattggtgtggtatttttgaaagtaaatgagtatattttcaccaatttcatagaggaggcattgatgtgcagaaatgttgaagtatcacgtagttaaatttttctgttctttgttaatcacatatttaatgttgtgtctaagaaaatggttccaagacccatgtcatttctttcccctatattttttctaagaggtttgttagttatttttatgtgtaagtattttatttaaaatattttttgtatatgattcaaggagaggatccagctttatcagtgtagacatgcagttttcaccatgtttttttttttttttttgaagagattatcttttctctatcatgtgctcatggcaactttgtggaagatcatttaatcatatatagaagagttcatttctgtgccgtattctgttctgttatctgtttttctgtctttgtgtcagtaccacattgtttttgttattgtagcttttaatatgttttgaaatcaggaagtataatgcctcctctttttcgtgagtgcttggctagttatagttcataatcaaatttaaaaattttaagcaatagttctgtaaaaaaaaatcctgtgctattgggatttttatagaaattatattgaatttgttcacaatgtaggttgtattgacatcttaataaaattaaattatttgatccttgacccctcccccaaaaaaaggaattaaatgaataaattgtagctgggaaccatattctttttgtgggaagagggaaatacaaatataaattgaggaaaagagaagaagaatactgtagagttggattgaagtggagatgttggtatgagcccatgatttaaagaaagtaagtgtgtgagcagtgtgcattgtgaggacctagaagcagtgacacccctagcagtgagtacacctaatgcacacgttttggtttttaagttcacttttccatgaaaaggaaacaggcttgctctttggagaaatacctgatttcagggctgagactaggaaagtggaacgtgagcctagagcatcttatactagaaactaaggaagtgctcaaaaactgatggggatacgttagaagtactcaagatccagcttgcggggcctgccagttagggaaaacttgagtcatcaaaaggaataagggtaatagatcttcatacattgcatttgttaaaaagaaatttatgtatctatattgacttttaaaatagtgagagctggccaggtgcggtggctcacgcctgtaatcccagaactttgggaggccaaggcgggtggatcacaaagtcaggagttcaagatcagcttggccaacatagtgaaaccccatctctactaaaaatacaaaaattagccgggcgtggtgccatgcgcctgtaattccagctactcaggagcctgaggcaggagaatcgttggaacctgggaggctgaggttgcagtgagctgagatcacgccactgcactccagcctgggcaacagagcaagactgtctcaaaaaaaaaaaagttggagaaaggagataggaaagctttattattacagaaaaatattaattagtacaagtgcaaatgacacaagtaatagagggagaaaatcactcttctacatccaccagtatataaatgtttcaggcaagaatcattaatagatgccaagtatattcggtaaatggtcatggggacaggatattcacacagtctcagagtcacactctgcagattacttattaatttaaaaagggaaaacatactttacagttgaaaaatctggcaataccaccctaaccaaatgatcaaacttaataatatcactgaaaaatgacaaactcattttgcttcccgggattatagtattatgctagaaatgtttaacctgaatctgatcatttggaaacaaccaaacaaagccagattatgggacactctacaaaacatcaaattgtcaacatcatgaaagacaaaaaaaaagtgggggagctgctctagaataaaggagattaaaggtacctgacaactaaatgcaacatgtgatccttgattacaccccctatcctgtatatccctatacaggaaaaggagtaattggtaaatttgaatgtgggttgtgtaacagataatattagcattagattcttgagtgtgagtattgtgccagagaatgttttgattcttaggatgtacctggcaaagattcatatctgcctgcagctcactttcagatggcttggggaaaaaagtgtgtgttgggagagagaagagatggagagagcgagcacaaatgtgccaaaatgttgcttgaaaacagacaggtacgcttaggatatgtttgccaggcgtctttcttttataatgcctgtttgttgttgccattgtttgtgactgtagaagaatagttgctcattgcttatcatttggaatatggaaaagtatcatccttaattttacctgtagagattacttaataaagaattaaattgtgattacactatgtataattttctttcttctacttttgctaatatgttgtaagtattttttcacataattgagtatctttggaaacatgatacttaagcacttcagaatttttcttcatatattcagccattcactttttgaacatttggattcttttcagatttcccttaatttactatcactgtaatgagcatccatgttcttaacttacctgcttctcctttttatttcccgaaggtatataactatttggcaacataacataaaaagctagtagtagtattatatttattttgtaacggcacatatgttttattacctagaattatgatgacaatttcaatgtaaatggacctggagaaggagtaaaggttgatccagaagatactaacttaaatcaagacagtgccaaagaattggaagatagtccccaggaaaatgtcagtgtcacagagatcattaaaccatgtgatgatccaaaaagtgaagctaaaaggtaagtcaaagttgcatattatttgtaaattactgaatattgatagtaaggatgtagcttttcatatatcaaataaaatcttctttcccatgactgaccaggtaatttagatgtatctgtacatatttatgtatagatacacacacacatatgtatacagatgaagagcgttgagaagaggatgctagaggaatgtgcccacacacatctcagcagcatggccaaaatcagaaagatgtcactttgatccagttcttgtttaccttatcctgctgtggcgctgattttgtcgtggatcattaacacttgacactcacatgagaacaagactcctgctgcgtccctggagtgtcactaagcaaatctccatgctcacgacagcagcctgtgttgggccccaccatgttgtgaggacacatggcagcagctggggcccttcctgctcagaggagccctggactcttggtgctgcacaaggccatggtgtggactaggaggaggtctcacccaagggaggtagccagtcctgttctctccttcctcctcttgtctgactttcttttccccatcctcctcggttcctctagaacagagaatcatttcttatttcttgaggaaagatctgatagtgaggagcttcaagtttctgtcattacagaaccctgaaaagaattaaagtgagagagcaaagtgggagcatgacgtgaaaatgctaacactggagcaacagtgatggggtggggagtgtgtgtacttcggagtttaaggcacttagtagtaggaaggaggaaacagatgtgggtgagacctacagtatgactctggctatagaaaaaggtatataaagaactacacaaactggtaatgttgaagctttgaagaactttggagagttgaagcctagaaagggaaattcacatgtatttcactctgacaccaggtgtttgttccctttctacaaatggggaaactgaatttcaggttaattgtccaaggacaaaagctattgagtagaaaggctgacacttcattccatctgcctgacaacttgaaggcacccagatcatctgactccatggagcctgtgtgtcctgtgggatgggcacaaagagtgggccaggaggtggggctctgggcccctgaacccctttttcatctaaaactaaaatgttttccatgttacttcttttttttttttttttggagatggagtctcgctctgttgcccaggctggagtacagtggcgcaacctcggctcactgcaacctccgcctcctgggttcaagcaattctcctgcctcagcctctcgagttgctgggactgcaggcatgcactgccacgcctggctatttttctgtattttagtagagacggtttcaccatgttgcacagggtggtcttgaactcctgacctcatgatctgcccgccttggcctaccaaagtgctgggattgcaggtgtgagctaccgtgtctggcctccatgttacttctacatgagaattgatctggggaggaagaagggttctcaggcttgggcaaccactgatatagttcagctctctaatttcactgatgtgaggaaaggattcagagaattcaagtgacttcttcacagctgcagaatggcagagctaagatagatacattatacccagcaccctccccacaccactctgctgtcccctggatccagggcctttatgctggcagctcctctgttgcttctctggagtggtgtggacactggccacctactgagaagtgtttttttaaaaaatgtgtgtgtgtgtgtgtgtgtgtgtgtatagtatttttaaaaaataaaggtcttagatatcagcttcagagatgtaactgtctttcataatataagtgatgtttgccaggaatattatcctaaatttgttagacatatttctgacatatctgtgatgatagtttgaaaattagtatgtattatttgttgccttttatgccattgtgtccttttcttgatgttttcaaagctggctgaatcctacacaatatgttacactcctaatctgcattttttaaatgcataggccgtttaacttagcacagactattggcctctgcttgaagaatagtatacctataaactggaagcattatcatcacttactcattataacccatcctgtctgttctgtacagtatagttggacccagatttttaccctatgaatttggttagcacaaatgggggaaagtatgaaatgccaaggaaaattgaaattcatgtaggagatgagtagaggaatgttcaggagttcaagcagaacaagaggaacccaactataccgtttctgatctaaatggtatggtggggaaaaaccatcagatcaacagaaaggacataatttttaaataaaagtaacttccttatattgagcaaatttaattttatgaaaaatgcattacaaagtctttgtttcactcatttctctgtgcgactattgaagtgtttgttaaactggatcacgtccaagaagttaatgttaggccaggcagggtggctcacgcttatattcccagcactttggaaagccaaggcgggtggatcacgaggtcaggagttcgagaccatcctggccaatatggtaaaaccctgtctctactaaaaaatacaaaaattagctgagtatggtggcacgtgcctgtaatcccagctattcgggaggctgaagcaggaaaatcgcttgaacccgggaggcagaggttgcagtgagccaagatcgcgccactgcactcgagcctgggtgacagagtgagactccatctcaaaaaaaaagttaatgtttttggggaaccacacttcatgtcagatcatttatgattaccgttggttagttttgaagatggtttgctcctttaaatggagtattaagtgctttgtgcttttttttttccccctgaaacagtcttactctgtcaccccagctagaatgcagtggtgcaatcttggctcactgcagtctccacctcctgggttcaagtgattcccctgctcctcctcctaagtaactgggattacaggtgcctgccaccacgctcagctaattttttatatttttaatagaggcggaggtttcaccatgttggccaagctggtctcgagctcctgacctcaagtgatctccccgccttggcctcccaaagtgctgggattacaggtgtgagccaccgtgcctggcagtgtttttatgaaaacactgtataaaacattctgtataaaacactgtattaaacactgtataaaacatttatctctgtataaaacattcagagatattttaaggaccttgttttaactttgtttcaactgttttaaggaaattccttaatttttgtgccaaatttgatattcaatttgatttctgaagttgctttttaaagatgttcatttaagatgtaaagattatttaaattgcctttaaaattaatgaattaacttttaaagtgcagttcacttttttgagtgttctagagagcactcaaataatgatggttaaaaggagtatgttatttttggattatgctgaattatttattttccagtgttcctaaacccaaaggaaagaaaaccaaagatatgaaaaaacctgtcagagtacctgctgaaccacaaacaatggtaggtcaaaatcatattcatatctctttagcatatcttgctgtttaagcagtataatgatctaaagatggaaatgtgtatttggtgagccattccgcaaagagcctgcaaagatgtggatccatcaacagttttgtttgatataatgtatctttttttttcattaaaataaaaagaagcacattggaaatgctagactgtaccagaacagttactgttgttttctattacttttcaatctaaagccttggtgataagaattacatgtgtcaagttctggagattaattgtgaagcataaactcttcctcttttttagtccatgaggtacatgctattgaaagtctcaggacccttaaagttaatcgtgttgattagtgggatttaacctccaagaacatctgcctttgttgaacgtgtttattacctgtccactctgttaaaacatctttattttacaattgtttgatgcttaatcttgatattaaaacctaaaacactactttcaagtgataacgcttacttttatttatgattttttgcccttctcagagtgttcttatcagctgtacaacctgccatagtgaatttccatctcggaataaactttttgaccatctaaaggccacaggtcatgcaagagcaccttcatcatcgtctttaaacagcgcaacaagtagtcaaagcaagaaagagaaacgtaaaaacagatagagattctgcctgtgcttttgtttgactgtctctagattttgaaaccaaaaaactgaactgaaatcatctaaagagttaaaatttcagtgatctgcaattaattacattgtggaagattattttttatcttgtaaaaacacttttttggtttaatatatatttttaaaacatttcactagtgattgaattctacttttgccatctgaattgacttgaatgtcttaaaacaggtaaatactgtaaagtgtgtattcttgatgtttattggctcatgtggacagaaatgtacagggagaattacattattttaacacacagaagtgcaactttctgctttattttctgaatttcacattacttttacttaatgcttttgtgttttgttaatacttcataatatgtgaaaaactcggatcttttaaaaagcatcatagatcatttttccatatgacactggttccgattttaaaaattatttttaaataaccgattattgattactgtattttttttctcaagaacagtgataggtagaaactaattgaacatttggtagtctttcaagaatagtgtctcttcaaggttttacttgatttaatttgatattttactggtttaccagtaaggtgtattgttcagttttttgctccgatttgaattgtggaggtggaagcaaattagtttacatggcatgtcctccctaggcacagtgacagctgtaaagtatgacggaacaaggtagcagatggtacagaatttatactatttaagaagagatgtggtgttcttcattgagtttttttcttcactattttcagaagtttttgttcttttttttttttccatcactcagtggagaaaagctttgttaatgaaagattttgtgatagagctgatgcttatacatctattctataacagtgatgaatattaacacaaaggaaatatggagaactgttataactgagtgttagaacagtcgtgtacattgatcagtattgagtccatttttaggatggattagtcagttcttttcattggtcttgaaagtaattttggctggtcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaagtaattttaaactcactggcttgaaatgtgtgctttctgtacaatgaagttattgctttccatatatccttgaatcttcagattaacgaaatgaacaaattttcggttacagatcagctctcaaacactaaagtccttaatggcaaggtcttttctgatagcttcatggatagtattgatgatcagatttcttctgtgttattgtcttaaaaataagcatttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttgcgtctcatcctttatgatgttgagaaatcatctaatttctcagaactttttcttatctctaacacagttattaccataataatattgtctccatttatcatacaggatcattatgaaagtaaaatgaagtagtatatatgaaaatgctttttaaacacaaaagctttatacaaaatattgttgaatttaaataaggtaaatcttttttagtttatatatttgcagactatacatgttggattaaatgggcaattaagttttataggaatttgcttcctaagtctacttttgaagaggaaaacaggaacgtaccatatattttgctaagggtaaaatatttttggtgaattgcagacatttaatttcacttgtctgaggtaaaacaataaactaaaatacatgggcatgcatcttacactgatcttattagaggtcagtgctaagtacccatcttgattgaagttagctcagatgtggagattcatagaatgagggtccaggagaagaaagttaggggaaatctcattttctttctgtaattcattcagtggtgccaaagctgggggttccctacaatggctatttagactttccctgcttcaaaataagagcagtatccttagctctagccaagcatttttctaattcctgcctttggtcacaaagaaggaaaagcagagctgtgaatgagttagtggaggtcaagtcacatcagagttcatgacctagtgattgctggtgaagtaatattggaattttggtaccatgagaagacttataaaggatttcatcagaagttttcattttttctaaatcctcccctacaaaattttcagattggaaattactcttgtatttgtagaagattgtctctaaaattgtggtttaactcacgcaggaagtaaaattcctatagcaagacatagtttcattttagaggacccccaaaatcccgtgaattctctggtgatgattctagcctaaccttcaacataaaataatgaagagaacttttaaacttttttatgaattcctaaacattaccatttatgtggcagaagttctgttccctataatctgcaatgctgaagtatctctattcaattcccttccttatctgttaaatttaatgtctttatactaaaaatataggctcttgggattggagaggaaaaattagaggtgattttcagatttcttgttctatggaagaggaagctgagctcagggagatatgagctccacagccacagctggttaggggcggctgccagtagaacagggcagatgcctggactcccaactcagtaggccttctgttacacctcaaaatgtgttacatgggaagaaaaagattaagaaaaagcaagataattttgaagaaggacgagaggaagaggcatgaacttgtcctaacaatgtcaaagaatattttaaaggtataccagttaaagtagtgtgtggctggtgccagtagaggtcagtcaagggatccctgacgagaataaagagcccagaaacaggtccatgtttatatgggaacttgatttttgacagatacggcaagctctatggggaaaacaatatgtactaccttatacccttccccaaaaacaaagggattaaagacctaaatatgaagacaaaacttttaaatgagaatctataaggttattttcatgattttgcaaatgggaaggatttctttaaagcaagacacaaaagcatacacaggaaaaaatgatgcataaaaacatggcttctgtagaacaatagagactgtaaaagaacaagctacagacaaggaaatgtttgcaatgcatggaactgtcaaaggattcgtatctggaatacattaaagaagcaaaagaacctcatacaaaagtcattgagtaaatgacagccatgcattagaacagcaattctcaaaacttttggtctcaagatccctttacactcttcaaaagtgagaaccccaaagagttttcatgtatgtgggttaaatctattgatattttctgttagaatttaaaaattatgttaaaaaaataagaagaatgactatttttcaaaacaaaaaatgagaagagtggtattgttttacatttttacaaatctctttaacatttagcttaataaaagatagctggcctctca

SEQ ID NO: 2476 - DNA, 29372 bp, Homo sapiens; identical to SEQ ID NO: 2475
  source 1..29372: mol_type = genomic DNA

SEQ ID NO: 2477 - DNA, 18378 bp, Homo sapiens
  source 1..18378: mol_type = genomic DNA
tatctgttagagacattttatttagaggcaagaaatggttaataagatgagacccttgggtctaggagcgtttgctctttgttttcttccttagagtgacagattttttgctgttggtgaaggcccttgaagactgtagtttaaattcaactggaaagtggtcgctgacatccagggcctataaggagaaaggggaggtagacatggaaattaggagatgcctgggagatgctttcattttagcgatgagcaaatttaggaccagggaggggagaggaaatgcccgaagtcaccccacagaacacttactggtaagcgtcattccaagaccagctcgatcagaaattttggaggggcctcaaatcacagaatcataggcattgagggtcaaggtctagtgcccaatgttgtgtcttcagtggtgacctcaaagggtggcatcaacccatctttttttttttttttttttgagacaggatctcactctgttgcccagcctggagtgcagtggtgcgatcttggctcactgcaacctccgcttcctggactcaagtgatcctcccacctcagcctcccaagtagctgggaccataggcatgcatcaccatgcccagctaatttttttgaatttttcatagagatggagtctcatcatgttgcccaagctaactcatctttccaggacaatggcatagaaagacaagatggcaaccttacctcctcttcagtcagcttgtaagctttctggaagtcaaaaacactgtttgacttgggaacaacagaactgacgatttcttgtcctctaagcacaatcctggaacaaggggagggaaaacagttgtgttaatccaacctgtgattgctgagatcaaaccaaggtctgtgtttgctgtctggaattaaccgagcagtctggccctttcatgtggcgctcaaagtccagagctggttttagcctgtgaccccaaaggacagtgcctacaactgtgaaataggatcagtccctgccatggttctgtggacaccaggacactgtctcccagtgtgggcaatgttctggtggagtaggagaagattttatatgacacacgcacactatcccacacaacaatgacttgcgtactgagaacgctgttcctttttcaattatttttcactttccctgatttgattatggagaaattctcagggaggtgctggtttgtctttaatacctccctcagtcccgtgttgacagagagtaggctgccatctccgagcattctgcaggcaagagaattaaggcagaatttaacaaggcgtgattttcactggacttaatttttacgttaccttcaatttatggcaaatgctgctgctttcttactcatgctagtatcatgaaatttcttttaaaaatttatttcagcaagaaattaagcgatttaatggaaaatatcgagaaaaatcacagcatatgtgctttgcaataatgacaaaaagtaagaatgaggtagtcaaatgagttttggaaacaaactaacatatcccaagttgggtgatgcagttgtggtctacgtggtcctgagtgacttcccgaggaatggcaaggtgagtcaaactgccatttcatgagtgaccagtgggccttccccattctaatcaacagttttggtatctgcatttgctaacatcaccagcacaactaacttttttttttttttttttttttttgagacacagtcatgctctgtcacccaggttggagtgcagtgcgccatctcagctcactgcaacctccaccttccgggttgaagcgattctcctgcctcagcctcccaagtagctggaattataggtgtgtgccaccacgcctggctaatttttgtatttttagtagagacggggtttatccctgttggccaggctggtcttgaactcgtgaccttaggtgatccgcccacctcaacctcccaaagtgctgggattaccggtgtaagccaccgctccagggctacggcttttttttttctttttttgagacggagtctctctgtgtcacccaggctagagtgcagtggcgcaatctcggctcactgcaagctctgcctcctgggttcatgccattctcctgcctcagcctcccgagtagctgggactacaggtgcccggcaccacgcctggctaattttttttgtattttttagtagagacggggtttcactgtgttagccaggatggtctcgatctcctgacctcgtgatccaccggccgcagcctcccaaagtgctgggattacaggtgtgagccaccacgcccggcccgggctacggcttttaattcaacccaaatgtaaattcttcgcatcaagttagacatttgtgaaagctttctttaagactcagaaagcaaagaatgacatgttaaaggctcttccatttctgacttcttctagggatgtgcaggaccaggccagtgttcatgtgacgttttcagtccagggcaccagccagatcctgggcatctttgcatgttcccccagcactcagcacatgagaggtgtttgataaatatgtgaacatggaacaaagactggaactgagaccatcttgtctaattacatttttaaaacatcatttttatggcttttcattttctccgtttattttatttaattttactttttattttattgtattgagacaggtctcactatgttgtccaggctggagtgccgtggctattcacaggcatgtgatcatgttgctctaaagccttgaactcctgggctcaagtgatcctcctgcctcagcctcccaagtagctgggattacagcatatgccaccacaactggcctatgactttttaaaagccacaagaggccgggcatggtggctcacacctgtaatccaagcactttgggaggccaaagcaggcggatcacctgaggtcacgagttcaagaccagcctggccaacatggcgaaaccccatctctactaaaattacaaaaaaaaaaaaaaaaaaaaaaaaaagcggggcatgtttgtgtatgcctgtaatcccagctacttgggaggctgaggcaggaaaatcgcttgaacccgggaggcggaggttgcagtgagccaagatcctgccactgcactccagcctgggcgacagagcaggactctgtctcaaaaaaaagaaaaaaaagaggcacaagagttatacatgttgttatgagaaacaaaattcagagcatcaaaataagaaatgaatctttaaaatgtcacatgtaatcccaccatcctttgggatacatgtgtataaaatcaggatccttttagtaaacatctttttctaacctgttctacccctgacctgatctactgtggccatgttgccttctgattcttctgtatcattttcaatcacttcccactcatttgccaggggagaagaatggcgctggagaagggacttgacctacccacgggcacacaactgccatgtgtaactgagtgagtggccatcgtccaggctttgctggaagtccttcaaaatagggggtctgggcacttagacccctgtaactccccgccttgggttcccactttgcagagtgataacttctgcaaaggaaacaccagcctcaaaagctccaagaggaacaggccgggcatggtggctcacgcctgtaatcccagcactttgggaggccgaggcgggcggatcacgaggtcaagaaatcaagaccatcctgggtaacatggtgaaaccctgtctctactaaaaatacaaaaaaaaaaaaaaattagccaggcgtggtggcgggcgcctgtagtcccagctactcgggaggctgaggcaggagaatggcgtgaacccgggaggcggagcttgcagtgagccgagatcgcaccactgcactccagcctgggcaacagagcgagactctgtctaaaaaaaaaaaaaaaaaaaaaaaaaactccgagaggaagtgaaaacgagtggcctggtggctctcatgcagatggccatctcacacttcctcgtggcaggctgagctctgggaactgtggccaccacctgggaccaggctcctaggggtttccccacctgtggtctctgtgatggaagatcactaacattcacacgcctcaggcactcccccctctgtccccattgaaggagcaaagatgaaagctgtttgaaaatccctgaagggactttaaaaagcacgagggaatgctaggacttaaatgtatgcattgcatttaggaatatgtagctaaagctttaaaaatataaataccgttgcactaattggtctcatttttagggttgcttcctgaggaaatcataaatacttgcacaaaatgcacagaggatattgattttagcagtatttataacagcaaacccttggtaataacccaatgcctaatgatggggattgggcgcatcaattgcggtaagtctttgtgatggaacaatgatcagcccatgaatgtaatgagcacttgccgtatgccaggcattgtgctagcagcctgacatgttatttcatttactccacatcggatcttcatgagtgaggcactaggataacttccattttacaggggaggaaatgaaagacacagagagcttgtctcttggtcacagacatatgaagtgataatgtcaggatttaaatccaggcctatctgatagcgaagccagtgcttacctctgctaagctacagtgcccagggccaccgcatagggtcctgtggttcatacgctacatgtggtacccagtagaggggcctgacatttaattgactcagctctgcaagcagtgtgcttttcttatttttatttttattttttatttttgagacaaagtctcactctgttacccaggctggagtgcagtggtgcgatcctggctcactgcagcctccaccttctgggctcaagcgatcctcccacctcagcctcctgagtagctgggagtataggtgtgtgccaccatgcctggctaatttttgtattttttgtagagacggggtttcatcatgttgcccaggctggtctcaaactcctgtactcaagcgatccatccatcgaggcctcccaaagtgctaggactactggcgtgagccacagtgcccagccaccttgcgtctttcctagtgcacaccaagcactgtggtgagccagcagcaccctgcagggcctcctacctgtcatatgcacagttggtgctcttcttcaccgtggtgtcctcttggtccccgatcagccaaacaaacctggggtcagtcctcaagcggatgttcttccaggccttcttggggacgtagctgcagccggcattgaagtcacccatgaaaatgaaattctaaaagacaagatttggaactgtcacctggtgggtgctgctgcagaatgctttcacactggactctagcaaagactctgcgtcccaggcccagtaaacaacagggtctgttatgggctgaatcttgtctaccccctgctcccgccccggccaaattcctatgttgaagttctaacccccagcaccttagaatgcgactgtatttggagatagaacctttcaagagggaattaaggtaaaatgaggtcatatggatgggctctaatccaatatgactggcgttcttgtaaaaaggggaaattaggacacagaaaagtggagcaaagaccatgtaaagacactggaagaagatggccgtctacaaaccaaggagagaggcccccaaaagacaccagccctgctggcacaccttgttctgggactccagcctccagaacggtgacgaactcactttctattgtttaaacttcccagtcttcagtatggtactttgttatggcagctctagcaaatgaatataaggtctttaaaaatttctttttgttgtttaaaattgagtcacagttttgatgagtcgatgacaggcgagtgcgtaccagggaggatgttcttaacaggaaggagaatgtttgctgttcttagtcgccacatttccataattcagcatgcagagtcaggtgtggataaaaaaaatttcagtgaatctattccctcacatcttttgtccctggctcaaactactgtagggtgtaaatatacgaatgaatcaacgccttttgctttcaagcaggaaaagtgaatttgggtggtgtattgacaaccctggcatcactctttctctcctattgttttgaagttggaaacttatttctgtgaaaattcagtcccttgaggaggtgggaggcatcttcaggggaggggaccattgagtgagctgtccacccccacccaaggccaccaagagaaacttcctatcttggaaatatttttccctgcaaggctcttggaacagaattttcaacattccacaatccagaggaagtgccagatttccttgtttgtgctattgtttggtggggcattgctgacttcagagttttcttcaagaacattttattttgaccttggtgatcacaattttccccatgattgatgggttcagttgaggacagagtgtcatccttaacctcagtgatcaccagcttctgctaatatagacatgatttgctgaacattcactatgtgccaggcctagcactaggtgtttttaaatttacacctggcagcaataaacaataggaggtacaagagcccactaacttctatagaaacaggattgagagattaagtgacctgctctaggccacaggactgggaggttcaaatggtgaagtcaagaatcacatcccagccaggcgccgtggctcacgcctgtaatcccagcactttgggaagccgaggcgggtggatcacctgaggtcaggcattcaagaccagcctggccaacatggtgaaaccccatttctattaaaaatataaaaattagccaggcgtggtggcacatgcctgtaatcccagctactcgggaggcaggagaatcacttgaacccgggaggtggaggttgcagtgagccgagattgcaccattgcactccagcctggggacaagagcgagatttcatctcaagaaaaaaaaaaaaaaagaatcacatcccagtctgcttcactgaagcagtttcccctcttgttcacttttaggccactgatgcctccccacagcccaacactcaatagatgctcaatacattcttgtttaataagtgaatgatttcataatttttggaaagaatgaatctttcttttgacctatttattaataagcaatgaaatacacccctggtcttttccatgccccagctctgatggactatgttcacactttatttgattcattttgcatttgagcagcagaactcaagaggaggaagggggatcacaggagtcacattccgaaacgagaaaagagaaatacagaagaagaacccttgggtgcacttccatatttaccaagagctttcacagcccctcacagccacaagtggtctcttccaaaagtggaaagaactgagcctatagggatggcaaatatgtgcccccttctgtgaaaacagcaccccaagttcctttgggagaccacccatccctcctccacctcaaactgagtttggggtggagctggggtggacacagatttagtcaatcagagtagctcaacaccctgatcacaatgattggttcagggatggacacctgacccagtcagagccaatgagactcagtcccacactatttgttgccttgtgggaaagaaaatttattttggtctggaggctgctggtggctgtcctgccatcccagggatggaaccaacctgagaatggagccacacagaggaaagggcaaccaggagatagaaaggaagagacaaatcaagctctgattaccttgtctgagccctggatccagctatgcctgaagtactcctggacatttcagttacacaaaccaatcaattgctcctttttttcatgagccatgttaagattctgtcccttgcaactgaaacaatcctgactgctctatgccttacacttctcaattgcaaagtgggaatgagaaaggtactgtagctacctcaagggattattgggaggattaaataaacttgtccatgtcaagtctcagcacagtgcctggcactagctattcactcagtaaatgttggcatctgttattaatgggaaagtgtggcaattcccaaggcccacatgcagggtacccaggcagatttagcaaaagggatacttagggctgaagaaaggccttaaagaatgctgtaagtggtggtagcctgcacatgcccttcctcctccccctccctggagaggtactcatcccactcagggaccagagcctgcccctgctagatgggaattcgtctgacacagcagtcctcacctccgccttccagcggtgtttcacgtccgtgtagacctcaaccaactcatcgatctccttaacggatgtctctggggtggtgtgcagggggataatcacgaagtctttgacagctgagaaacaggaaagaggcgggggtcacacacttcccctgtcaaggtctcataaacactgctggagggaaaccagctgtcccctccagaaggcacaggctgcattatctgggtccccagttcccagagggtccagccagtggccgagattttaatgatcttggggtcattaggctgcctatttttagtacacgaaagactcatttctcccagttgcccttcatggctaagagaaagctggtagactgttgtagaaagtaaaaaagtttcctcttcaaagtttcccttcttattaaagaataaatcataagtgttagaaataatagtttcctttaaagactaacttccttcaagtctccttgctttgtgctaataactctttgttaagctctatcctatgtagctgttagacatgctcacaggcacatagtacattctatgtccttgtaccttaaccaagatatttgtgctggacattccagctcgcaggcacattccagctcacagcctttgccccttccctatttggcataagcaacttcctcttttcctttgttctcccttgcctttacctatttaagaaaggtttaaattattagccagtcgggttagcttagattgtgtggtctggctccagccaatagagagacaggacacagtagcagggacaagctgagtaaaggataaaaattgcttccctcctttattcaggtgtgctctcgccattgttccatctgcaaggagcaccctttctgcagaaagtaaaattggcttgctgagaaaactttttatctgaatgttgatttttccttgcagtaccagggaacaagcattctgtttctaaataaacattttacttataacaactgtgttccatgctggcattgtgagtgcttttattttcccctttttgtgtgtgtggcaaatctgtattttcttttgtttctgatgtattttatccctcttctttctttttttaattgacaggaaaaattgcatatatttatggttgtattttcttcttttttttaaaggtttcctttttttttttttgagacggagtttcgttcttgttgcccaggctggagtgcaatggcacaatttcggctcactgcaacctctgcctcccaggttcaagtgattctcctgcctcagcctcccaagtaactgggattacaggcatgcaccatcatgcctggctagctttgtttttttttttttttttttttttttggtagagacaggatttctccatgttggtcaggctgctctcaaactcccaacctcaggtgatccacccatctcagcctcccaaagtgctgggattacaggtgtgagccaccacacccagctgggagttacaaaaagagtataaactgacccatctcagcctcccaaagtgctgggattacaggcatgagccaccgagcccagtcgcacattttctagttaaaaaaaaattggccaggcgtgttggcttacttctgtaatcccaccactttgggaggctgaggctgatggatcacctgaggtcgggagttccagatcagcctgaccatcatggagaaaacctgtctctactaaaaatacaaaattagctgggggtggtggcgcatgcctgtaatcccagctacttgggagactgaggcaggagaatcgtttgaacttgggaggcagaggttgtggtgagcctagatcacgccactgcactccagcctgggcaagaagagtgaaactctgtctaaaaaaaaaaaaatgaggcttgtcagtttatactcctttgtaattaagaacaaaagttccaaaaagctatttaaaaattagcatggtcttcacgaaagacttttgtgaagtgtctgaaaaccttcccccaccgttggaggactgagagcctgagtgtggcaatgtgcgcgagcctcagaagccgttcctggcccacctgctaacagcagctgtcgccttctgagcagctcctcctgggacttcccctcattctcagcctggattcccactcttacctcaacagacacgggctgtggggcggtcactgctcaagtcacacagagaggagccagaactcagcccagcaggctgcatccagggccccacgtgtcctcattgccagctctcctcctcaggcctccactgcactcctccatcctctttttggtccccctaaatattccagcttccttcccacttctgagcttttgtgctcactgtgccctccatgtggaatgccctttctccagccctctgtatggctgacttcttcaggtcacagcccaatgtcacctcctctgtcttgtccagtgccctcaacagagcctggtacatagtaggtactgaaaaaatatttgattcttgactccatcgagcattgcataacactgcatgttaaccactggctgggcacagtggcttacacctgtaatcccagcactttgggaagccaaggcaggcagatggcttgagctcaggggttcaagaacagcctaggcaacatagcgagacctatctcgctatttaaaaattttaaaattagctgagtgtggtggtgcatgcctatagtctgagctacttgcgaggctgaggtgcgaagattgcttgagcccaggaggtggaggttgcagtgagccaagatcatgccactgcattccagactggatgacagagcaaggccctatctcaaaaacagaagaaaaaaaaaagaacatgagctcctgaggtggtggcctgggttacaaccctggcctgtccatttcagtagctgggtgactccatgcctttttaaacctcagtttcctgaaatgtaaagtggagataatcctactccctaccttgtagtcattgcaaggattacaggaggctggcacttaatcaggggccagtacaagtactgttgttagagttcagggagcaatccatttggatttcctcacccgctgcggcctgtggaggagtctgcgatgcagtgactggagggagagtgagcctctaggctaggggttcacctaagccattgcttaggattttttttttttttttgagacaagagtctcactctatcgcccaagctggagtgcagtggtacgatctcggctcactgcaacctctgcctccctggttcaagtgattctcctacctcagcctcccgagtagctgggattacaggtgcgcaccaccatgcccagctaatttttgtatttttagtagagacggggtttcaccatgttggccagtctggtctcaagttcctgacctcaggtgatccacctgcctcagcctcccaaagtgctgggattacagccatgcgccaccgcacccagccaggatttttaaaaaggaaggaagagttgtacttgacaggtaccaaggaattgcagaaaacaatttccatgagcctaaactctccaaagagagtggactaccattgcttccagaaagtgggttctgggctggggaagtcttgagtcatggcattctgagaagcaagcctggtgccatcacactgaactgcatcgtctacattgaagtattagaagcaatgcactgtcacatccagcctaatgcctccttaatgggctcatgctcaaggctgctgcgcattcatgggccgttggggaggtcccagacagaaaggcctgtgtgggtcttaccagtgtggggagattggaaccagaccacaaagggctccctggaaaacacatctgcgtctccatcctgatagtcatggtagtgataactcctcttcacagacaccagcttttccctataagaaggaaaaggaagtcctcccagctgagtcagcccttttcttactactttcatgaagcagagatgtaggttcccatggctttctcagaagccagagcaggctcaagcacaggatcgttttcctgagaacaaggctaagtcaactcttctcaacagccagggagctgttgcgaatctgggagctgaagatctgagccatactagttatctgtggcacccaaaagttaatgttcagacttaagaaattactagcaggaagaggaaaagaatacgaagttcaggaatcagctgtgctgagaacctcagctttccagccctgggccaggacttgactatgaggagtaaagaacacctggcctgccaaccatggagccaaccaacaaattaggtgtttggagaccccttgtgttttcagcttgaagagtcaatactttgcataggcccctagttttgacagcaattattttgatgaacactgagaattggttagaaatcaaaatttggttttgaagaaaagacatgcattttgattcaattcacgatttattggtggccatgttccagggagcataggtgatacttacttgtagagaaaggcatattgttctttatatgtgtttcttccaagccgagagctaatcacatagttgtacgttatgcctctccttgaatttctagaaaacaaagatttaacactgcatcttgaagagtaaacattcccctactgtacatgttcctttctttccaatctgcctccatacgcccaatggcatcatgtggaagggccactgttcatcataacctttgagtccaatgagaggagccaccattgattggctggaatgtggcatctgccacgatctttacagccattatttcttgccttatgaggagagtgttatcattaccccctttctatggtttgcaagcccaaagctgggatttgaacctagatccaactcaccccaaaacccgcatgctttggcctgtacctgtgggaggccactgagaccctagaagacaatcttggccagaatcagcccctgaccccgctcatgcccatggctgcagctgcagctcatgctttctggtggaataaatgtcatcaggccacctgtccgtgtccacgaaccactcctgagcatttatgataagcaggaatattctctcctctgaaagccatcaggcatttttttacaagctttgggaccacgatttcaattcactgttgtttatatcctgggtgctggggatacagccatgaagtcccattgaccttgcccctcacctgcaccagggaaagcggactctttctgtgtgtttaccaaacctgctgataactccactctgggcagagcctaacataatttcactctatctgctcacaaaaagatctagggcatgtctaaagctgcagcatattctcagattcagttggaaaaaaagcagaaggggtatttaggggccaacttagaccttacagaaattcctgggacttcagatgcagtatgctaaggcagacttagcccctggggccccaggagtgtgaacagtaggttctgccgggcttccactttggggagactggccctattttgaacatagcctgccaagtcctgagttagcaaactgcttgtggtgactcagttgcaaagtgactaaggcccatcctggcttgtgggggataaagagacaaacaggcttggctctgcttggagtccgcgacagtctagataggttggggtgtgccaagaccactggtggtgaaaagactcgccccagactgactgtggaggagatgactggagcctacctgtcccctcagtcccccacaaacctgtcccctcagtctcccataaacctgactggggacactccaaggaaggctgagatgacaaagaatagagcactggctatgagatcagatgtgacgcaagttcaaaggtaggcttggccacttcctggctgggtaactcaggcaggtcccccactcagttcccttactataagggaagcccttaggcagactgacatggattcttgcctgtccctacaattgtcctacacatgccttccctatgatggataagcccagagcctgggggatgatggcaccaggatctaccatctcatcttgctcctgcccaagacccagacatggcttttgttcaaaagtccctattaagtgtttcttgctgagatggccaggtgcagcggctcacacctgtaatcccagcactttgggaggctgagaggggcagatcacttgaggtcaggaatttaaggccagcctgggcaacatagcaaaaccccgactccactaaaaatacaaaaattagctaggcatagtgggtgtgtgactgtaatcccagctacttgggaggctgaggcaggagaatcacttgaacccaggaggcaaaggttgcagtgagccgagatcttgctgctgcataccagcctgggcaacagagtctcagatttaaaaagtactaaaataagaagcaagtgcccctcactccttcactaacccctttcaccacagctctctgatcacaccccccccccccccaccagaagtaaccactattaatagtttggagagcatccttccagtctttcatctctatgcacatggaaacacaaacacacccttattcatgtaacatgatgactcaaatgggctattttacctgcaattctcaacttgctttttttcaatatattgtggccattattccgtgctggaatatttagctctaacttattctgtagcaagcatgattttttttttaagagatagggtcttgctctgtggcccaggctggagtgcagtggtgtgatcatggctcactatagcctaaacctcatgggctcaagcgatcctcccacctcagcctcccaggtaggtgagactataggcacgtgccaccacacctggccaccagcatgacttttaacagctgcataatattcctgtgtgtgagcatgttgtaattttattatctttcttctactattggtttctaatcttttctcttttctccaacattttcttcataactgtactttttagctcagcctcatctgcttttttcatttctttctgtgtccagacccctcatctatttcccctattctattttatcacagtaaaatcaactggttgaaagttctcaggaccgtggctaagggagctggactcctgggcaacactggctgtgtgaactggtggtcaagtgcgggatctcacattactttcagttcccaggggttttcagatgcccttgcacttgaccttgagccctagagggcccacccttccccatgttacctgttcagcttctccatcagtatggggcagatcctgttgttgctgtccttgatttccatcacgagtatgatgtcacagcgtttgatgacctgcaagaaagagaattcccaggggtttgaggtcatttaccacagataaataaaaccttttattggacacttactgtttttaagtattgcactgagtgcttattaaaataatttcttctctgaactaaatgaaggactccctgaggtaggtaggtgcttttgttatgtacattttaaagaggagcgtgagactcagagaaagttgagtaaattacactcccaatcaccctactagaaaatggcggaggcagaatttgaacctatgtaattcaagcccagagccccttgctcatgacctccccacaatatcctgcctcttggctttgcttgaataattacaataataataataaatatttattaagcccttagtaagcaaagataacagactggattagaaataaagaggtataattataatgataataattataaaagctgacatttactgcaaacctactccgagccttacaacaaccctgtggggtaactatgcttattagcccattaaacataggcagaaaccaagctcagagtggttgagtgactagcttaaagtcatacagccaggataggtggtagagtcaggatttgaacttaggtctgcgtgactacaaagcccaccatgttgaactgttaaaatacagtcccagccgggcacggtggcttacgcctgtaataccagcactttgggaggccaagatgggcagatcacctgaggtcaggagttcgagaccagcctggccaacatggtgaaacccgcctctactaaaaatacaaaaattagcacctataggaggtgcttggtcaatgggcgctagggataatcctattctgaatgcctggcattctcgggtgactgtgagtgccctgtagggtagctcttgcagtgttttggggatggcctcttggtaggatggggagggtgaggcagccttgacaaggacttcggacatgctctgcaggacacagctgctcaggggagatgcagagttcaagcccccatgatggactcaccaaggaacaaaaagacagccgggtttcatcagtgaggaaggagatgggaactcagtggctacccaggctccacgggccatgtgtgaagtggggaaaatcattgccttgcatgtcagggtttcccattgaacaatcttgtcatggctcccacaggcttggcattgctatcctggctaaacaacaccatctagaaggccttggttacctcccaaagggcagggccacctgggtctgagaggctcgtccaaggaagaacagagcctgccagtcctcactccaatcctccttcccagtgacagcaacagcagcggctctggctcatgaatacccaccttgctgcaggctctgctgggtgcctcaggcaccctgagttctcttcaccagccagtgctacaggtggtatttggatgtggtcgccattttactaggggagctggtggttcagggaggggcagggcctcccaagctcacaagtctggtaggtggaatctggacccagggctcctggcccccctaccacaccatggtgtctcaggtttcctaaggtaataagtacctttccagagtcctgggaaagggttaagttgccagcatcaaaaattaattaacctgtaggataaagggagtcaattgactccagagaaagcaagcagtgtccccggacattgggtatatcacccaaggaaagcgtaagcgaaagtggaaggagtggggaagtagaggagagggagagaggaaggaaggaggagaagaagaaagaaagacaaagagagggagggatgatgaggatgggagagagaaggaaggaaggaaaaaagtaaggaagggaaaggaagaaagaaacaaagaaaaagagaaaggaagaagaaagaaaagacagaaagaagaaagaaaaaggaagaaagaaaaaggaagaaagaaaaagaaagaaagaaagagagaaagaaagaaaagaaagaaagaagaaaaggaaagagagagaaaggagctgggctttgctggtgaaaaggagtagctgtataaggttacttcatctttctttgttcatcacctctacatggggagtaatagtccctcttcataaagattatgaagtgaaaccatgtgcttatagtgcctgatacaggcattcaataaatagcaataaaaatcataatggctaacccttatctggaacgtataatgagccagatactacattaagagctttccatttgccaactcctgtagtccccccagcaaccctggagggaaccattgttatcacccctgttttaagatgacggcaggaggtacagagagttgaagtggttattgttccaagccagcttctacattccccctaagggccaactttaagttccttgagtctcttaaagtctgcagacaggagagagggtgtgaggggtgtctgggatcctcctcccaggaaaggggctcaccttcacaatgacatccatggcattcttgtcttcctgcttgctttccccaaaggacctgacgttgaaggagcagatcctcatggccagggcgctgtggatggagaggaggagaagcagcagtggggccagctcccgtgacatcctggcgctgctctggcttcaagactctgtgagaagacagcagtgcttggagtgctggattctggccacttccgcaggctccactgacttataaagc

SEQ ID NO: 2478 - DNA, 18378 bp, Homo sapiens; identical to SEQ ID NO: 2477
  source 1..18378: mol_type = genomic DNA

SEQ ID NO: 2479 - DNA, 6311 bp, Homo sapiens
  source 1..6311: mol_type = genomic DNA
caccaatttccatttatttactcctcaacaatcctgatggcaggtattatgtttcccattttgcagacaggtagactgtgtcacagagcggttaaggcacacaatcaaggtcatacagctaggaaggggatgaactgggattcaaaatcaagtccaaactggttcctgagcccttagattttttattttttatttttttgacacagagtctcattctgtcacccaggctgaagtgccgtggtgttagctcagctcatgacaacctctgcctcccgagttcaagcgattctcctgcctcagcctcccgaggagctaggaccacagacgcgtgccaccatgtctggctaatttttaaatatttttaatggatatggggtttcaccatgttggccaggctggtctcgaactcctgacctcaagtgatctgcccatctcagcctcccaaagtgctggggttacagatgtgagccactgcacccacccgtcccccgccccccctttttttttgaaacagagtcttgctatgtgacccaggttggcgtaatcatagttcactgtgaccatgatctccctggttcaatcgatcctctggcttcagtggctgggactacaggcatttatcaccgtgcctggctaactttttttaagttctagtagagatgtggtctcactatgtagcccaggctggtctcgaattcctgagttcaagtgatcctccctccttggcttcccaaagtgctgggattacatacgtgagccactgcacctggccataagggttagatcttataagctctgctgggcttcctggccatgccattacagggctggtagttcttcaccagcggctggaaggctttccagagggctggcagctgggcacacagtgtgcccccaccccgttgctcctctccctggttccgattcatgtcacccacgcaggtccagggcccttttggggacacgcaccatttggagtggtcctctgtgctgttgaagcttgggccggctggtccagggaaagctatctggttcacattcagaacctgccagatatccgagcagttagagggcaggatgcctacagttttgtgccagaactggacctgcaggttggtaccaagggctgctgccaaccagccggagtacaggtctgcaaaggatggagagagggcacaggtagggtcagggccactgcgagggagtccctagtccacttcccctctctcagctcagtttccatatttccttttttttttttttttttgacatggagtcttgctctgtcgcccaggctagagtgcattggtgcaatctaggctcattgcaacctctgcctccgaggttcaagtgattctcctgcctcagccttctgagtagctgggactacaggcatgcacaaccatacccggctaattttttaataaagaggggtttcaccatattgaccaggctggtctcaaactcctgatctcaagcaatccgcccacctcggtcttccaaaatgctgggactacaggtgtgtgtcaccgcgccctgccacagtttccatatttctgagctcagttgtcaattcccagtcctgggaatgatgacattaatattaattgcccttcccaaatttgtttttgagacagagtctcactctgtcgcccaggctggagtgcagtggtgtaatctcggcacactgcaacctctgcctcctggtttcaagcgattctcatgcctcagcctcctgagtagctgggattacaggtgcccgccaccacacccggctaatttttgtacttttagtagagatggggttccaccatgttggccaggctgttctcaaactcctgaccgtgtaatcagccagcgccctccaccatgcccagataatttttgtacttttagtagagatggagtttcaccatgttggccagactggtcttgaactcctgggctcaagtgacccacccgccttggtctcccaaaatgtggggattacaggtgagccaccgcgtccggccctgagtgtttttaattaattaacttatttattttgagactgggtctcattttgacaccccagctggagtgcagtggcaggatcatgactcacttgcagcctcgacctcctgggctcaagctgttctcccacctcagcctcctgagtagtggggactacacgtgtgtgccactatgccccactaattaaaattttttttgtagagatggggtcccgctgtgttgcccaggctggtctcaaactcctgggctcaagcaatcctcctgcctcgactgggattacaggtgtgagccactgtgcctggcctatttatttgtatttatttatttatttatttattttgagacacagtctcactctgtcacccaggctggagtgcagtggcactatcttgactcactgcaagctccaccttccgggttcacgccattctcctgcctcagcctcccgagtaactgggactacaggtgcccgccaccatgcctggctaatttttgcacttttagtagagacagggtttcaccgtgttagccaggatggtctcgatctcctgagctcgtgatctgcccacctcagcctcccaaagtgctgggattacaggcatgagccactgtgcccagcctatttatttatttttaaataaagacagggtcttgctctgtcacccaggctggagtgcagtggagtcattatagctcactgcagtctgaaactctgggctcaatttatcctcctgcctcagcctcccaagttgcttggctaatttttaattttgtagagatgaggtcttgctatgtttcccaggcttgtcttggatgcctgtcttcaaatgatcctcctgcctcagcctcctaagtaactgggattacaggagtgaggcaccacctctggcacccaaatgacttacaggtaccacttcattcacaattttttaagtagatgtcagtatccccatttttcagatgagtagaccaaggctcaggtgaagttatacatcacacagcaaaacccagggtttgaacccaggtctgttcactgatcatgtgattatagctcccaaacagacctggtctctaccgctgacttgaactcagccatggccacaccagtcaccctgtctgcagagaaggagctctccaaccctcaaccttgagactcaccatctccaaatttgctgaacttggcaaagctctggaaaacagccccggcctgggatgtgagtgtgatgctgctgttccagggttcttggctaacgtggtggcccttgaccacattctccaagtcggggaattcctgggcaaagatcccttccagctggtagttatagacccaggggtaggtgtaggtcagctgcttgcctggaggacaaggggaggaggaaatgcaagatcgttccaggttctggtcagtaaacccaggactcatcctgtgtccctgactcgacttacccatcttcgagaactgagcgaagggaaaagacacacagagcagggtctgcccgtaggtacaggcgctatgaggccagctgtatgcagcagaggaggccggtggagggaagttaggtacactgtggaccagccagaagcccccatcgtggtcaaggagcaggacacctggaccaaaagaaggcattaggggaggtcgggcgcagtggctcacgcctgtaatcccagcactttgggagaccgagacacacagatcacctgaggtcaggagttagaaatcagcctggccaacatggcgaaaccccatctctactaaaaatacaaaaattagctgagcgtggtggtggacgcctgtaatcccagctactcaggaggctgaggcaggagaatcgcttgaacccaggaggtggaggttgcagtgagctgagatccaccactgcactccagcctgggccacagagcaaaatttcatctcaaacataagtaagtaagtaagtaaataaataaataaataaataaataaataaaaatttaaaaaaagaaggcaggccccacgcagtgtaatcccagcactttgggaagccgaggagggcggatcacctgaggtcgggagttcaagaccagcctggccaacatggagaaacctcatcactactaaaaatacaacattagccgggcatggtggtgcatgcctgtaatcccagctactcgggaggctgatgcaggagaatcacttgaacccaggaggcggaggttgcagtgagccgagattgcaccattgcactccagcctgggtagcaagagcaaaactccttctcaaaaaaaaaaaaaaaaaaaaggcaattagagggtattgctccaggcctcccagcaagctcatctgcaatcaggaacaccctcagtttgcagcggggcttagagagggtgccagcagtgttagaaccacagctgagctcagtttttgcaggcataaattcttatagtccagaataacgccaagagtaatgtaaggtagggaaacaggccaggtgtggcggctcatgccggtaatcgcagcacattaagaggccaaggtgggtggattgcttgaaccaggacttagagaccagcctaggcaacatggcaaaagcccactctacaaaaatacaaaaagtaggccaggtgtggtggctcacgcctgtaatcccagcactttgggaggccaaggcaggtggatcacctgaggtcaggagttcaatatcagcctgtccaacctggtaaaaccccatctctactaaaacatacaacatttagctgggcatggtggcgcacacctgtaatcccagctactccagaggctgaggcagaagaatcgcttgaactggggagatggagattgcagtgagctgagattgcaccaccgaactccagcctgggtgatggagagagagtgccgcaaaaaaaaaaaaaaaaaaaaaaagccaggcgtggtggggggtaccggcaggcccagtacttgggaggctgaggtaggaggatcacctgagccctgggaggtcaaggctgcagtgagctgtgatactgcactccagcctaggtgactgggtgagaccttgtctaaaagaaaataaaataggggaaatagatgcccaaggtctgacaggggagatctcccaccccactatggaggtcaggggttagcttggaaaaatgcataggaactcggctgggcagggtggctcattcctgtaatcccagcactttgggaggccaaggcgggtagatcacttgaggtagaaaccaggagttcgagaccagcctggccaacatggtgaaacctcgtctgtactaaaaatatgaaaattagcctggtgtgatggtgcgcctttaataccagctacttgggaggctgagacaggagaattgcttcaaccccagaggcagagattgcagtgagccaagattgtgccactgcactccagcttgggtgacagagcgaactcccaccgtctcaaaaacaaagaaaaaaaaaagttggggggaatagatgcccagggtctgacagtgcagatctccccgaccaccccatgcacgtcaggggttaccttggaaaaatgggacccgagtctctccccagcccccaatccaggcctcacccttcgtgtgcccacgcatggaagagtcctgagccttgctgggttgaggcggttggtcattgtagagcaggaaggcgagctgcgggcggataaacggaggcaacgtgaaattcctcccaggcagggcagccctagagtttcgcccctagttggcccggggcccccttcacctggctggtgttgctccggtacagcggctgcaggcttcggcccacggccccctccgggctgttgatgagtgccctgccgtcccgccagcctccggagctctcgtccagatacttgtactgcagccctctctgcgccgcctccccggaccctctaagagctggcagcttgtagaccacgaacctggaggtcggagaatgcacagaaataggagagagggaagagaaggcaccccagggttccccgaggaggtagccatcccggttgagtgaccgcagccggaccccggggcgatggtaggccccccgctgcgcactcaccagtctacaggctgcccggagtccccgtagcaggtcagggccccggcggggacgcacagcagcgctgccagcagcagcgggatcatagctgctatggggctgagatccaggaatctgtgtcgggactgcggggcgctgggttacatcagaggccaggactggcacctggcgcctttcacttccctaaacttgcctgggaaccggggcggggacatcacgagggtacagactc

SEQ ID NO: 2480 - DNA, 403866 bp, Homo sapiens
  source 1..403866: mol_type = genomic DNA
tgccatcacagacaggaagtaactttaattaaatattgtgaaagttgaaaagtttttacagcttgaatttttgcaaaaaaaaaaaaaaaatttaacaatctctacagtagttaggttctctaacaattgaactgtacagtgtgtgtctattcaaaaagttttgataagaaggtgaaaggttagtagatttagagatgacttcatttaagctgcatcctagtacaatgtgaggccagggcaatgttatgcaatccagtcatccagaagctgtattttttcccccaacactgaaatcttaatttaattcttcatttcattttcttcttaaagccatattctgtatttaggggaacatcttttatttgtaaaacttttgtggagaagaaagaggatcagagggccagaatgtcttttcatctaatcaatagaaatagaagcaacaaaacacaaattatacacattttaaaggctctttggactttcaagaagagttctaaccactgcacatggctgacagatgggtagtgtctgttgtcaaggtctaagccggacaccttcccggctgaccgttcattccttcagaaacagttaaggggctcaccagataaaatatggctttaacttgtgtacatcttcaggccagcgcttaccacgcaaattcagataacctttctgagtaccgagaagcaatgcgtccaccttgcttacattttccagttttttttattattattagtcatcattattatttctcaccatgaaaaacagctttcctccctcccctaccctcccacaactcccctcccccacccaccccaacccataaaaatcgcactcttgacagcctagtgaaaaccattgcaaaatccatatgggggcatgcacagttgcagcattgttgtaaatgatttcttgctctactagaaaaagttacattgtcttaaggtaacaaaacagttcttttgtgcttttcgatttctttgtttttttttttttctttttttctttttcttttttcttagaatgttagtgatgactgacagttctggtgcacagttacaatgtacaagtgaaatgaatatgatttgcattgttaaggcatccaatctgctggtttatatttatgtgaaagacagaggaaatatacaagcagacttaagaaagaaagtatgttcattgatttctatgaagtttctccctagaatttaatgcacaaaatgcgtcactccaaagggagagattccatgcatattaatagagtaaaacagcattagggttgttttgtaagcttccaaagcaaaggatacatttttttttaaatctactgaactaaatactacaagaataatatgctactatttttttttttttgccatatattggaaaaaacttcttaacttacaaataatacaaaaatagacaatgacttttgggtggaaattaaaaaaactgaagcatggtttataacaatactaaaaataactataaatgaaatgtttaaaaatcacattgaaacagctaatacaagtgtaggtgaccaaacaaatacgcacttttcacgtagcaaacatacacaataaaataaattgggggtggaaggaagaggaagaagggaaaagcaatgtacaaattcgaaagataaatacattatttatatggatattttacaaaatcccctttaaaacaaaaagccttttaattaactttgcaagtatgtgcaagctaaaggtagtgagctttttttctttgcaaaatacgcagtaaaatctttttgtgatattgaaaaaatgtcttaagacattaaaatgtataaatagaacaacaactttggcaaaaaatcacaaaaaaaaaatctacagtatttataactacatacaaaaacacaagagcaaagaaaaaaatatcaggcaaatgcatcctcagagctttgctgcatctttgctattaattcttatttttaagaacacttcccagataatgagagcaaaaattcccatagaacagaaaactatgttttggaggtctcaaccttcttttcctttctccacccccggttccctttaactcttaattccaaagcacttaacctgttgtttcaatctattatgttacaaatggtaagggtcgactgatagaggcagtatctggaatgggaaaatcgaaaatacctgccacgttgcttttatcaacttttggaagataggtatgaagtctgcatttaggacgagtaaactttaaacttgcaaatgggggagcgtacgtgaggttttggcttgttaactggagggcagagtgtggaattctgtgcctggaccctgttccatgaagtctcaaaggagattctcacacagtatgtgtgccaccaagctctcgagaggccatcggcttcagaagaaactgacttaagtaaaaggagagaatgagatcagatttaaatatgcagttttaacaatctgtctagaggcactggattttcgagtagagggaaaaatgtgatcacttacatcgcgttttaactttccaggctgcatttatttacacagttgcttaagacaacaatacaaaagagataaataagcttgcactgctaaggggtggcatgttaagttagatattgaaaatgcactgtctgagctaactaccatttgatatgctttaaggcgcaaaagccgacccttagtttttctaaaaaatctaactggcattcctattctgtcccatacaagcttttttttttttcctttttttctttttttttttttttacttttttgtaaatatcaccacttcattcttcctttacacagctttaaaaacatcataaattaaaacatggagtcttatttatagtgtcccttgtatagagctttacggtttataaaagacaaatgattgcagaattaagcttaaaaaaaaaaaagaaaaagaaaaagtggatttgcttttgtcaatacagaataaatatatcccccaaatacttgggaggtacaactttaaccaacaccctgcacttgcagatccctcttccaatttcagtatttgcaaggtcggtgattttgtttgtttaaaaatctgcagttattgtgattcctcttaaaaaggcctgagttaaaagttccactctgggacttgtatcagattactctctgtagcagaatccaacctcttcattaatacaattcttcaaggcaattctttcacataggaggaacaatcatgccagatatcgctatgaaagaaaagacagaagtcaatggtttctttgcgttcaaacttctcactgagaaaaataatgaagactaaaaaaaaaaaaacacccacacacaactatgttgttcgactattagccacaaatttgctctcatcttctctggaatgaattttcgttataaaatatacatgtgctttattaaaaattataataaatcagcatgggtatgtgtctttaacagaacaaaatatcctaaacatctctccaaatctgatttcaattttaaggcataactggaaagttgcatagtttgaataccactgggaaagttgcagcttcgaaccttgcaaaatagtgagaattttcactttgtcactcttttttccctccccttcacacccaaaatataaagaagtggtccatccaaactgcaagcagtttctacaaaaaacttggcattccctatcctctgtattagcacaaaaactaagccacagagcagaaatcttgagtgcctttgcttaggtccttaagctgggagaaggaaatgccagctacagcaggccttgttcactgggaacataaagttgggagaaagcatagctgggaggagaagacaggtttgcatgaaactgcagaatgtcttccatatcacggcttcactcaacgtttcgggaatgatctgaccatatttcctagaaaactgtagcctggggaagctggagtgagatcctgggaaaaaagaagcctgtttgaggtaaccaaaaattgttgaaagcattcaaagctaggaggtcgcagatagtggtatttagagaacacagaatcagataggcctgagtcccacctctggcttttctgctgtgaagctcagcttctgtagctagaatcacagcaacacttagggttattggagaggtgaataaaatgacacatgcaaagtgcttagcctgggttcagctcctagtgaggacctgatagacgttagctgctgggatttttaacccatcacttctgctactaaactagctgtgtgaccttgtgttaattgcttaacttttctgaggtgtatttgctcttatgtcaaataggcaccatcccatgtggcacactttgtgtgattgctgggaagaataaaaggataactaagaaaattaaaacagggtggcacctttgaaacatgtcaaagtgagagagatgctgacattacaagcaaggggcagccgtctttggctcccaatcacggttaagtgtcttgtcaggcagagagagtcattgctttctttttatggcaaatctaaacgtaaattaattagtgttcttgtcagtgatgactgtgtctaggaagtggccctcttagtttactattctggaagaatgtgcctttaaaaaaaaaaaaaaaagcgaaccccagtaccacaaatcctgcaagtggacacagggaggccaccctgggctcttagccccaagacccccacgttcctccggcttccccacccccacccctggtattttagattcaattaaaatgaaacccaaaaagtattttgccaaacactttttccgttaatttttaaacccatctgtattcacaaggaaattcaatccacatgtttctgattcatttacacgtaaatcatccaaatgttgttttgcaagagcctttttgcagcccaaaagctcctggagtcctttctgtaagccctcataagcctttttttcttagaaacaggaagttgtcttttgccaaacgcagaccaacttaaacccccaaagacttgagatcagttggaaatgcagtccccctaagattcaagtgagccctaggtttgactgaaaccaggagctcagtatttcaatccaagccttaactggagaattcgagatgctatcactccaaaggcaaggaggcgcaggggagtctttgctgtgtgacagcccagcatggctctgcctccccaaggatcttttcatctgggctggaggtgggtccaggcacctttattaaagacagcgggagttttaagcctgtggcaaaaggtgcaagtctactttcgctttccaccaaaatctattctgcgtgcctggcattaaagagcagttccctatagtatagtcacacaactcaggcagtatcaatatgattcaaagcaaaggaaaaagctaatttggttggtgggtccagccaacatttattagctggtctgtgaaaacatcccatttgaatggccagaattaaaaaaaaaaaaaaaatctaagcaggcttttggtacccaaatagtgtgttagatcaactagattaagcctccacttagggccacattaaaagttctaaagcaaagctaactgatgtaccagttcatagttaacagcgctttttattttggaccattggggctgcaaactccagcatcccaagagcccaggctgcgaacagcagtgagtgaatcccctgggtgcgtaagtgaggatggaggtgatgatgccaagggcatgcctgggcagtgactcagctcccaccaaatgccactgggcaggaatgcctgctcacagccactgatcttctcaaatgtttcaagagaagctagagatttagactttgtttttttaaaaaaagaaatagccaagtttatacatgatagcacaaaattgaaattaaaaacaaatatatgggtctagggggtgggtttggcccactcctactttcctacctcgccttcatcagccgacagacttctctgagagtctaatgggagctatggaacctctcttcaaaagaggttgtgatgtcttggcacacagtgctgagtatcctcatggggaatcttcatgtaccctacttgggcaagacagcatgccacagcatttctggaacattctaaggcccatgttgcctacacccagaattttgcatgtaatatcaaagcattactgttctctaaatcccaatcatgacttcctaaactccaagggcagaacccttgcggttgagtaaattatgggaaaagatccctgcctgtggcctctgagcctagatacctccaaagaggcccttttaatagagaaactccactgcaaaactgcctgaagatcttgagttttaggagttgtttttcttatatctgtgctgcaatctgaagattatgtgggtgagagggatgggtgtctggagcttggaatgttccagcaatgccattggcatgctaacttgcccaagtggagtgcataaagattcccatgaggacaccaccctctcagcaccatgtgccaagacatcacaagaccatggtggctctgccattttccccagcagctggatgatcatgttctctgacagaagctcagaaaactattgctttgagaggcaatgcatttttcattaccgtttccatatttttgataaaaacaaagacaaaacaaagttctgcagagctgggagggtttggagtgagagggtggaatgtggtcgtacccaaaccaccacatgtgtaagaattatgagctaatcactcaggaggctgaggcaggagaatggcatgaacctgggaggcagagcttgcagtgagccgagatcgcgccactgcactccagcctgggctacagagggagactccttctcaaaaaaaaaaaaaaaaaaaaaaaaaaaaaaaagaattatgagctaatcaggaacaggggggtaagtgagtgggtaaatcttgcaccgactgaatatgtgcatggaaaaaatgacgattccataggatttggtcctgggctgcatgatatctagggttgagaagagccagcctgagcttcagcaaggtggaaaagaaaaaacatcagtatatggatactacttttgtgaaattactctggcctttttgtttttaatttttcatgcgtagactgtccaggacatggctaaggtttagaatcactacatcagcgggggttccaatggcatgtaacagccttcttggggatgcctctgtcttgaataaatgaagtcctctgaggcctaaattgcctgaaacccaagctctaagcagcataagcttcaggagaaaggagaggacatctccatggacaaagactgagcatagttggtgactcaagtctttggctctggaaaacagacacagttaggtagtctgggaccaggatttatcaattacttcacctgcataagaatagaaagaggtatctctgcatttttctctttaaatccaaaatatagttgcattttccaaagtttttcatatgacattaagtgttcttaacatgcagaaaaggactctgtaggcaaacaagtttgccaaactaaatgaaatagtcatttttatttaactgcaggatgccccagagactttaattgtggatctccaagatagtgatccagggagcaccacattctaaatgtttttgactaccatatttttattttttaacaggacattttgtgaggctccagaagttgagactagagttgctttttcaaaaaaaaaaaaaaaaaaccctcagatatatggtaacttttcaaacgttttatctacctgggagacaaagccagctggaatcatgatagaatctgtgaatcctactggtcaccgcatgttatccaggacatgtctgtctctgcttcttggctaaggttgtcctcagtctttctgctgaaagtgccccttgcccccatctccctggccctgaatcccacttgttcctccttgagcctgttctgaattctccttcatctttccttcctctgtacttccacagctgggtgcccagcctttcccagacagatcttccttatttactttggtgtcatgtctcccctaatacagggaaagattttgagggcaggattttgtagccctcttgtgcctaacctagtgacttgaatatagaaatgtaatatagcataggggcttaacatagtccagtcaatctgtctgggcttaaagcccaggcttccttgtttgctagttgtgtaaatggggacaagccaccttagcttcagtctcagtttctgcatctgtataacagggacaacagacaagctaccttaagggtggttgggagccaggctgggaataagccctcctagtcagtggctgtgttcaccattatcaccaccatgtgacatggccgtgcttagttcttggggaataaatatgcgtgtagtaaccggaggagactaagggagtgctgctggggaagaggtcttttaggagtcggctttaaaaaacagaaccatgcacagttaacagagtggtagttggaggtaaataggccttgaaaacacttaaatggcctaaatgtggcacctctaatcttgttgacatgggcaatttgcttaaccaagtcttcctagtcacttaacctgtcttaatgatcacaattctgaactaggtgggtcccaatgaagtaggtgctactgtaacattgaaaaggaaaaacgtggaatagaacacttcagggatccttacaccaattccataacctgccttcatcctttttttcttttttttttttatggtagaaatagtttggaaagttaaagatgaagtaattctctgaatgtcacctttctcagggaaaacttttgtggctcaagcaagagtgccctgaaaaactggtgcccacctaaggctgggtcctctttgccctgctggagattgtgtgcagaggctaaagaggcaagtcccagagtgtgggccccacctgccagcacagcacctgggggtgcagtgggcagaaagaagagcttaaagtgagatgtttacattaatttgactttaatttctccatccgtatgtccatcactgacatctcaaaagtagggatatttggtatatgacagtacgagcaaaccaaaaaccattttctttctttctgtctttctttttgaaatagtcttgctctggagtgcagtggcacgatctcagctcactgcaacctgtctcccaggttcaagtgattctcctccctcagtcatcctagtagctagaactacaggctgcaccaccaggcccggctaatttttgtatttttagtagagacgaggtttcaccatgttggccaggctggtctcaaagacctgacctcaggtgatccacctgcctcagcctcccaaagtgctgagactacaggtgtgaaccaccacgcccagtccattctttttatagttgttttatcatgctcaatagtcagggcatgggataggggaaaatccaaaaaagtctccttgacatttgttcaatcagaaggaaagggcagtgtcatccacaacagtgaatccagcacaaggtgtgtccctgaatcagacctcaaacctcccacactgtggccctgtgttaggaaaggtgacagagaggcacagactcagcagttattcagagaaatggggacagtctctgtacttttgggatctgtaattgggtaagaattgagttggaaaatccctgggaggacaaatgcacaaactttgtatatatccctgtcctgaagccatttcatcatgacttaaacaggcacataccctcatccagatcctggctttcagttgataaccagatctcctgaaacccaggaagtcataagatctgagcccagcccctgtttccaaccacttcctgctccttcctaggaccacagggcatgagaagacatcgggcctcctgggagctgcccacttctgtcactgttggcctatgatagagccactgaccttccaatagtgggggccttttcttctccagtgcttcccgtcaactgctgattataaaccccatcatatcttgtttctgatgtcaaatctatgtttagcaagggctgagattggcagctcaagaatggtaaatttctgctttccatatgtatgatcattatttaaacctattataagttatattcgctcaagcattatatccctagtttgccagctggaggtgtactgagggtgacaaagcattatttttagctgaaagagaatgagatttgcaggaatgggtggctctactttgtggaggtgggcattttctatcatgagtaatattgcctgaaatgcagttgcacaggcacgctttttttttttttttcctctttcctctaagaagatggatttgccactgtatgttagagtggggaagagcggcgtgctctgtggggcgctgagtctgggctgtgctgggcagatttgcaagcaaggttctgaggagtattttgaagagtcctcctggaggcagaaagacaacgtgatcgggtgctcaggctctggggtcacatggcttgtgttccagtttagctgtactatttattagccatgtgacctggatcaaattaagcctcaagtttcccatctgtataatgggactagtgctgacatcatacggtcttcaggagaatcactatatgctcatcacagtgtaaagcatccagcacacagtatgtgtagacaagtagaaatatgcatgtacttgtacataagaaacagggctgagatatcccagacatgtgcactgccttcctcacccctccctgacttccaggctgacctccatcagtgagatgccagccaccaagggaagacactgtgggaaactttgtatggctgggcttaagggcacagactctgatggggcttacattcatctccaccgtttaaccgactatgtctgtggtcaggtatttaccctctttaagcttccattttatcatttgcacaatgaagaccataatggccctcatactttaggaagatgtgaggattaaatggtataaaatctgctccatgcataggacagccccaggtacactgttcagtgctcaataaatggtggttgactagtttactaatcttatctccctaccagctgccttaggaaccctggctatgtctcttttagcacctctgaataataaagtatttaggagatgaatgtttcagtctgaatttgaagccagcttctgccatgtatcagctgttaaaagtcaggcaatttcataacctctctaacctttagttttctcatctgtcaaatagcagatatgagtacctaccacacaatcctgctgggggcaatgaatgaggttgtgcaggtctcaacatatgacacacaacagagtgctaagctcataagaaaaatgtaagaaatggtgtgctcagttttaaaaggtgggtaaccttttattcttaatgaaaaggtcatctcaactcttagcaactattttattttccaaatgcaatggtgggaaagcgattgaacaattttaatatgaatcagaatactctagtggtgttctggggtttcttaatcccagtaggaagtctttggcctttggtctatgatgatctaacttcagggctctgatcaagttatggctcaccccctccctgttatcagccccacacacgttcactctgacacaggcaacaggaagggaaggttgagtgacctacttcaggagaaggccagtcccgggagagaccctgcactggagaacttgctagagtccacaaaagactgatctgataatggcgaccacaaggagtgaaagaggagaaaagagaaatgatgctgttagtcagtagaaacagtattcccaagcaaatcccgggcctgagcagaattgctgaagttggaaagaggacttcttgagcacctccagcagaggagagatgagtatggccaagggccaagggccagggttgaggagagcaaatacaaaggaacagaagagatgagggcagagagaatcaggcagggcccaaggctgataccctcagcaatggtgatgcatctgcttcaggccctgggagggtgaagtcagggcattgaatctggattggcaggtggggcctggggcttaccttgcaggctgttcccgttggtgctggtgcaggtgggaggtggggaggtctggggtctgacgactggtgcgaaagcactcttctgtttcacggctgagaccatgttggctggtgagaaggagaagatgcccgaggagctgctgcagttggaggggaggcttgtggaggaggccatggtggggctggatggcactactgagaggggcaatgagaaaggagaaatcagtgcctttcatggcatcctgaagcaaagaagctcagatccatccctcacccagccaccttgctctgccctgctcagacgatgcttccagcacaaaccttccctgaattcgcaggctctcatccactttcactatacagaacttagcacgtgctacctttcattactggagatcttttatgtgtttattgtggggccactgtgtgccaggcagtgtgctaggcactagggtcatcagcagcaattgtcattaagggaaaatgacccctggtcatcagcccaaggcactaaccaatccaaatgcaccgagtgcctttatggggcagaacacagagccaccatcctcagagtattccaggccaggaaacaaaagtgcaacaccctcttatgagggatagagtagcacaaaacagtgagaaaggtgaacatagccatctcagtggaggcagggaagggaaatcagagaagacttcatagaagaggtatcaggggatgcatcccaggtagagcctaaactaaagttctaggaaagaggctggggtagggggaacaggaagaagccagcttgagaggatggccaccagactgccacatgcagcatttgtgaaaaatgcagaactctacaagttccaaattctttataaccgccatgggatatacatgaatgtttgggaattaataagcagtaggatcagagccttacataaatactcacagtttggtagtagtagggatgcagataaccaatgatgggaaaactctggcaactcagagaaaacctagcagcttggggatatgaaagagctcggtagacgtacattctctaccgaccatgatcctcttggcctggcctctcatcttttgttccaggttaataatctctcggttactttaggagacagagatttcacatacgctaagtcaagactaatattttcatacactcgctttctatttcctccatttcctgcaggaaagtatgtatcctagatatttcttctatgttattattttttcacacaacttaataaaacatcagatattgttttatcattcacaagaatcttcacgtctttttcatcttgtcatgggcaatgcaaccttaagtcggggcctatcacatatatttttttttttttacaaccgaggaagtgaagcaagctgggactcagaaagtagtgtagcagctagcccaagggccatagctagaatgcgctgaagcaaggaatcacgcccaaatttggagctctttctgctaagctaccctgcaaaggaaacagatctccagggggaaaagcctcgttcccatgagcccaccagagtcaaaggagctgtttgggtggccttatcctttgcaaagtgggaatccaattggtcataggcaacaattgccatcaggggaaaatgaccccttctaatcagtccaaggcactacccaatccacacgcactgagtgctttatggggcagaatgcagagccaccatcctcagagttttcacaaacattttctaaactgtactttttcttttaatgaggccagcatttttatacatctcttaggatttgtaactgtgaaaatacgctcaataataacacccatttaaattgcaaaactcctgcactggaggtttgatttttaaatattcgtagacttgaaatcctgctggttcactgaggaaggcaattaatctcattggcaaatgtgatcattatgtgtatttagaggtggggagttttggggtggggggccagttaacagaggtagaggtaaaatatagtcaagcagctccatttgttataacattattagttatcagccaccacaccagaaagtgtgttcaccagtggaatgtcttatttttttattccattggaatttttcaacatgagtgctttatgaataattaaatattatggaggcaaaaattcaaatcaactgggctttgtgtttattgttttatttgcatttgtgcagataaagccgtcccatctgagagcatatttgagaatttaatactatgtttgtgagcactgagaaaatcaattaatggaaattaaatgttcaaagtttcacagtctgacagatgcaatctcaggctgaagcggctgagtgtctgcacaggcttggggaggagagcattccaagcccctaaattgaattgctaccatatagcaattagtttattgatttaattaagaatgccatcttttaattttcaggtcatgatcgaaacattttctgactgaataaatgggagaacactgaaattatagatctctatgagaaacaatcttttgataaatcaaaatctaatgtgaaactgatcctaaacattgacttgtgagtagacagacataatatatgcagattatttggggagttgtaaatgttcaacaaactgctgattccaaactaagatgaaatgtgtaattttgtggaccttgagcagaaaaattcacccagaaagtaaaagtctgtaagtacattttcagaaataacttctcttacagggcaagaatgatctttcctctttcaaagaactagaacaatccatactttcactatgagacagggcatcatttgctgtatttttagccaagactccttaagaaatcatgaatattctttaatttaatggtacacctatctatccttccacaaatatctaagagtttggccacattttacacatcagaagagtcactcgcaatgtccaagatgaacttcaaagtcagagcgagatcaagagattgtgagaacacgggttatgacattttatagataaggaggccagttctctgaggttctttagaagcaatataaatgtaccaaaatgtttttgtaggcaaacttctttaaggcagagacaaggcaccaaagaacgtttttttatgtgtatatggttttcttttccttttttttaatcttgccagatttctggaaaagtgttttgatttgttgttgttttaaatatacaccaaacacaaacaaaggggaaaaatccaagcattaaaaaataaaggagtcatatgtgtgttcaccagaggaatgtcttatttttttttattccattggaatttttcaacatgagtgctttatgaataattatgaagggagagaagttaggttttagactattgttactatgttataccaccaccaccacgttattatctttgcatcactatgattattagatttactaaatgtgcctctatccatgtgtccggcatcaggacaagctcactgtatgcgctatcttctctatgtctcacaacactggatggggtgggtgctagttccttcccaattttacagatgagaaaattgaggcttggagaggaaatgaacttgattccttttatgtagctaaaataatcaggtgaaacaagacgaaactaatagatgttttgggattaagtagatgacaaatatggtgtcctcattgtttatgggggtttttttgtttgctttttttttttctttgagacggagtcttgctctgtcacccaggcactggagtgcagtggcacaatcatggctcactgtaaccttgaactcctgggctcaagcaaacctcctgcctcagtttcctgagtagctggtggtaactggtagaagtgggagttagtaactgggagaagcaggagtcaacccgtcttcatctaactcagagcatgggttcctgaagcgacttcatacagctgctttggatggtagcaacattctgactgttagggagactttgtaggaaggaaggtgagcactggagagcggagattcctgctggagacgatggtgcctttagcaccatcacccaggggagtgccttacaggagggaaagatggggggcctcagaccgagaagccctgcccactgggccacatggcatgatgccaagttcttctagcgaaacgtgcaggaacgcaggatatgcatctctacttactggcatagggggagttggcagctgagccgttgaggaaggtgggggagccgcccaaattggacattgcggcagagccgtatccgttcatgctcgtggtgacggagttatagttggtctgctggggagtggtgctcggcacgtacccgtgtggtgatacgctgcttgagttgcgggtgaaacctgaggggcgggggcaaaaccggaggtgagggtggcattcagatggtggcaatcctggaagactcggggaaaggaaggtctctgtttctggccccgtcgccgcaacccagagggaagggattgggtgattcatgtgcgtgggttggtggtgctagctctgtgattaaaatgggaagcgagcaaaagacacatttcttaggagatcataaatacttagcagggccgtgagaaatggcaatgctgggcctataaattatcattttagagcagaaataaatcccgatctaagagatgtaccctggagttaacaggttcctattccctgggcaagaatgatgtgctttgggccctcaaaactttaattccatccctctctgtgatctgtcattcatggtttatggtgaaaagtcaaatgtagagagatggctaaatgcatgcatcctttctagccctctatattagattacccgaatgatagctaggaccaatattgtacaataatatcttatacacataaactaagaatctcccttttgggatgaaaataattttttaatgtaaaaattgttcatgaccaataaatgaggagatggggtgcttaaggttggggagggaagagaaaagcaagcttctgaccctgattggtggcttgtgatgcctcggagacattcacggccagttgtccactgaacgaattcacgcccatcatccctgcgtggaccgaggtgttagcaagggccgggagttggttgtggttgcggggaacactgtacagggcctcggcaatgtcggccgctctcttcagaatgatttcctgaaaagtcaaaggaatatccccttcagctgcccccagtcatattcccaataataccattttttcggtgccaggtaccgtgctcagggttttcaatggtcagctgcattaacttctgtgaccctcatgacaaacctgttatattagtctcaccatcatcatgcctgtatccgaaatggggaaactgaggctcagaaagtcaaaaacctcaccgaagtacactcacctatttaagaacagagctgagattcataagcccatttgtctgactttgaaagtccattatcttaactataccttcatactaccctacagtccatacaggacagcaccatggggttttccatccttcccaataacatgtaggaagtctgaggttacccagggggagaggaagagaggctgcaattcacctcccctattgatgttaagggaaggctgtagatgactacctgcattactgagtattaatgggactgtgtcccccagacattgactcaggctacatgaaaaaggagtgaatggtttgtcagactcagtttcctaagctatgtgaatcttatacatggagttctatgaaacagaagcagacaatactattcaggccttgctatactttttggagaaaaaattaaaccctctttctcttcctaaatttgcttgaaaacctgagagaaataaaataaagcaccagtaactctcctcttcaattaggaagtatgttcccactaaagattagttttaaatggagtaccttttctcatacagaaaatgattcagtggaaagggcaataaaaggtttacaaaagaggattgaatcatcttgcaacatgttatatctgaattacttatactcttaactcatgcacatggcttttatattgtttgtgctttctcattacgatgaggaatctgagatctttaattgcatgtggcagtccacacaggctagacacccacagcgctcacctggttgttgtgtggcatcccatacagtgcttctaccagatccgcagcccttttgagtattacttcctgtcaagagaaaagcagatacaatcctttgagtgaaggcaggttgtcgttatcttttgacatgatcacattccagtccctctggccatactttgccaaggcactgctataaaggccgtagcttggggaaccccagaagggtgttaaatcaccaatttatccctgttcacatacacacttaattgagtcaaaaggtgagcatcattggtactgcgagataaaatacatcactcaatagtctgccataggcatgataaagcactcatatgtttattgctgaatacaattcctaggtcatttactagattactacaattgatgtcattcagtcgtggtatgaatccctaagatgtgtttattttgcacttaattgcttattccagtaaccatgaccttatcagacaggtcattttcgagggatttccaatcaatcttcagctactagaagcatgtagtattaaacttcttttgtttatctctcttggatggtagagacataatataagagggtgatgtaggaaacccacatactgaggcaatgcactgtttgtcaaaaactcttatgaaaggactctactgtcctcagaggccccctctgcaccaattttcattactggcagtatctatttctttaatagcaattatttgctatttcagtattgtgtgatttcccccatttgctcattcattctcatcctagatagatgcttggctactcattccagttgaaggaaaaatatctccctctttttacttaggtggacctccatatttagcctgcatgcttggttctaataatagggagtactctacaaagtgagtgtggtgctaatatttttggttctaactaaaagaaatctctctcttcatttttccctaattttcttcagattcatttccactagaatgtgaaaagaaaagcaaagttaagcttgatgcatgtaaaaggtaggggcttgtcagagaaccaaacgtaagggtgtggtaggatcatcagaggtgatttgcatgaagatatgtttaccatttttgactgtgggtaaagtttcaaacagaagtgtaactttaaatattttacacaatagatttctacatggagaagcagtgctgttcaattttcacagactgcagtcgctgatcagaaaatagggagataatcgcattcattttgctgtcatcatagcctcttcaaaaatccttgaacaactcttgaaatgacaagcttttagatacatattagcatttttcaattttaaattctctataatataagataaagtagttgtcatactacagtaactacttatgacatatctaatgtcctaaattcaaaaataagatagtggggttttcagttctcaataaacatttatgcttgccttaagctgatagaccccctttataaaacagtttagttatttttcatgtagggagtaaagaacattatataatcaaagggatttgaaccaatacatctgaaatcatttctttattttttaatgtaagctacaagctaatttaccactttttgtttgctgtagtagtgtctgaccacagcagttaataatttactattgtacgggcacactaaaccctatccccagatcaaattcagcctgtgttgccttcactaaaacctcttggctttatctggctcttaggaaagatgaaaacaaaaaacaggatcaagtgagtttatttactaagattagacttctctaggcctatgttcatttatttctccaaataaatatttatgccagtgttggggcttggcagggaacgtattttcctttctttccattttaggggggaaaaaggcaagtctcccgtttgtcaaaagcgtgatgaggcacagaaagaaactgcacttgtgaacttcactcttgtaacactataattgaggacttagagcagtgtaccttattttaattaatttcacagaagcagggaggagggaagttcaaaattaaactccaagatctttgaagttttcataagcctgaaaacataccatctatcagtatatattatatatccttggtgatagagtttttcaatgacaaaatctacttttttttttctccttatgtcgatatccagagctctcatccccatttaatcctttgagaataaaacacgtggatcttgtttcctaaaggagcatccttctttgatccatgatgctgccttctttgatccaccatgctggggcatgttttcccattgagtacattgccataggtaggtcatcagtacagcatcacttcaggccagcagtcttggatttgaggagtgtgaacctggatttcttgtcttgaaagggacacccttaaataatatcttacccattaaaaaatatccttcactgtagtatcaacttgtaaggacttaagaaagacttggttgagctttgcccatgtgatttggcttctattaggtatttctgcaaatgggaaggagaaaggaaatttctgggtcctccatgagttagtgcaatggacctgcaaactgcttggatttcggtgaccagaaaattgctctcacctccatgtcattacgctcccagtgaactagcccccaggcgtgtttgtgttggggatctaatatattgcctttcaatcagagctgagagccactgaacacacagacagaacatgacgagcaggtcaggaaagcaataaagattttacagagctgtccaaggtgctaaatttactcaataatgggtttggcaccatagtgttaacctctcatttactaccagtttgagggactaaattgaagtagctgacttcatttaccttgaaatgtatattttatgacattatgtaagtagattgaaagggcactgcagttttaacaatttaaaggctaaagcatgtttaagatgaaacttgaatatttattgtatattgcacttaaagtatatagaatgttaaaatgtattgattaaatttgtaaaaggcattataaaaatgacaggtagtataaaagatgtatgccttttaaaatcaaattgatagtgtatgccatctcttctgtggtcacaagtgtaatttttttgcagttttatatggtaatttgaaaaatctgtaatttcacattaggaaatgattgagccttggatgttaaaaaaagaaatttcccataaggggaagagctggatgtttcatataatcttttgtctctaaaattgttcttaaattcttattttttgtggcattaggcaggagcacagtctaaggatctttcattttaatatgcaattttaatatttctgaaaagaaagagcacttgactagtactaatatctaatgtttcaaggcatttatttgtcaggggagattttctcttcttttcataatgtttaaaacgtctccctgcttgcaatttcaaacataagagtggatattagacaattccaagataattaatcctatccttggattttttttttttaaaaatcccttttgggaattaaagacaaatactagtatcctaaatattgaaaagccccagagtctccttgtagaggtaatgtttgttctccaatctacattctgagtcagacaatttttctgctcatggccttggatttcttctctcttaaagatacaaaaaagctttactccttaaaaacaacaactacttttcactgattgatttcatctcactatcaaaacgtggcttcacctgtcttgctatgaccataggttgatggttatgtgagtggggttctatggagaaaaatgtggatgcattattcttactctatttagagtctacagaaatgttagggagaccgaaggaggaatggggttccaagaaacagttcaaatgtagctggcatgggttttacttatattttggaagctttataataaaaatgctgaatgggctacaaatataaagggaagattcagctttactttctactttgcaacccaattagcaaatattgtttgagcttcttgttgcccttgtctgtcatcatatgtggatcttattctccagcaactttcagggcacattatcttcccagcatcgacctacaaagtttgatgagagtcacaaaagattgtcgccatcacttggtcctaccatctttgtccagtcatctctccctatgtatttgaagaactgctctctatgcttgtcctccccagcctagaagtaaaacatttggctcctttctatctccataccttcactccttttgccttcccctttttttggagggaatgctggcttcaatctgtgcccatggacaatgcctctctccatcctctgaagcctcgtactgaaggggatcgtgatggtatggtaatgaaggagatcactctcatttattgaaagtggagcaagaactcattcaaccttcatagaaagcctcttaaggtattctttctattactatctggcagatgaggaaactgacactcagagaggtcagctaactttcccaaagtttccaccgctgactagtggctgagcatggattcaaccccaggcctgttagacatcagagcctggctcttgaaaatcacactgttctatcagaaataattccaccttcactgataccccagctcctaatatctctatttcctctgaaaaagagtgctgaccatctgtgtcacccagcacagcacagaagtatatactgagaggtcattctgctctgatctgaagtgtgttagtcatcattctccatagctagactgcagactttttgaggccagtgataggttcttaatctccttatctaagctcctaccataatgtttagcaaaccacaagtcttgagaaattcatgttgatgtgttattctaagatacagttactgatttttaaaagtacacacttaatttgtatgatgaaatgacaaagtcatatttggcatggtttataaaagtagaagacttaaatttggtgttccatttagctacagactcttaaatccaatatataaattcccaaaggtcaagttttgatcactgtgagtttttttatgtcacttttttatgaatttgctctttcattcctgctggcttggacttacattttaattttgtgattaatacaatgaatcatgtctagtacagacattatctcaagttataggctgctagcaacatgaggttggtccttatggtcctcagccttttattagctgtactcttaggcccttggaaatagttaggtatttgcacattcatagaaagacacattgggaaccaggcatatcatgacaaatatgcagacatagttaactcatcttctattttatgagttaaaaatcttaggattattcaccatctgtgggagtccttctctttagcctttgacctgaaatctatagctaataagctcaagttcactggccacatctagcctcctagagtgaagggaaaggttgtctaactggccaatactgggcccatttataaacccagttcaatgttttgggcaactcaaccccagatgagcagggaagatagtctgaactttcttttgttcatagcacatataggctgatgatcataaagctgatagatacccatacacgaacacaacattaattttcatgtttcagcattagattttgagactctgggaactccgcccataaaattaaagcccagggatgcttcagtaatttcagaggataatctgtgcttggctttatgcttacccaaataggaaatgttttcaggaatgtagattgaaacagaaaaaaaaaactacaagcatccataatcaaagtcaagttgagttgggtgatttctgagaaagaagcacaatacttccctgtcactgcacatttccctgatacccatttatcaccaatctactttgctttatcaggggattcaaaatatagtggccaaatatcagcaacacacaatgaagtgaaatgagaaaatcactcttgatgtagagatgataagcacctatcaatgaaatcagcattgatttcactgccttccttcgtatagggtttactgcaggacccagattttgatgtgtgcattcagctcctagactttaagtcctggatctttccccactgacttctgaaagcctgggtgacattactgattggaaaggccgaatgctgagaaattgattggaagtttcttgcagcccatttcctgcagagctggatgtacaatgcaataaatactagttgtcctgagatgtatttctttggagggtagttttatatcccagcttcctttgtgtttattcagccaaatggaaaattccacaatggtagactttgcattctaaaaaatcagtataatgagggcagtgagggaaagagtaaaacaaaccaaaataacacttgggcaccgtttagtttcccatcctctgagacattcctcaaatttttcatttttcttgtaatataaacttcttgaaatagagcttagtgcagatcattagaagcctttagtgtcacactttaaacactctttccttagaagccctatgactgagaagagtcacttacatttagcatggatataattaaacatgtttctgttgaaaggggcattctcattatagctaaggaccactttagagtaaattgaaatggaaaggaggaacataaatgaggtataggtagcaagtagttatttgcagggaggcataaaatgccaaatgtataacaattatattttacaaccccacattctaaagacttcatagtattttagtatataagaagattcagctgaagcttagattgccctacagaacattctagctagcgcatactttttgcccagagtctttttaaaaactgaaattcaaaccacagtaaaaatctctagacatttccagaacaaaggaattaaatattttgaaagagtctactgctattaataccaaaggccaaggcaccaaaaacattctagtctagagaaaatgcagcaggaggacctcttctgaacctcctctgattttaaagttgattttatgttcagattagatgacagccctcttacttctcaaacatattattatgaaccagcatgcggcatggttggaggtaaaccagaaagccttgcctttgttaaaaacatggtataggagactctgaatcatatgaaattaaactaggttgtaagctaacgcggctatatcaacgtaagacatactaacttacgtgattgacttttacaatggaaagaaaggctgttttcaagcaactgttattgccacaatggaaaaaaaaaatcaatgaaagtgaaatgaacaagagattttgtctgagttgcagttaataccactgaggagctatggatattaaaaggtcaacaaataaattagccagagtgttatgaaataaatgatttggctcataattttattgagtgaaaattgttcgctgcctattagaccaggtaatttttatctggtgcctcaattactgtcccgtaagcaataatatagttgtaagagctgttggttcgatcgtgtgacctctgagaagctggctaggacagctgactttactatgatggataactaagcttgggctccatgaggtgccaagcttccctttcctgcaaggggatctcataaaagaaacattacagcttgattcattttaccaaaatgttcgacttttcaagtgtcagcagttaagtataaattgtgaaaccaggtatttctgagaagagttatgacaatggctttcccctcccttttttttttttatttggtctcctggcattttcttctaaatggtgtcatggtaattggtgaatgggagcctggggtgcttcccgccacagatacagtgaaaaatggtgtctgcacccttgttgactatgacctgcttggaggtacagagctgaacttggtaacctctggcgggatcttcttattccaattcattgtactggtttaagaccaacgctgtgggttaggtcctgctgagtgccttggaaatcgactttctgatcaggataaaagtctctgcttaaagagaaagctctggacagagatgcctttttcaggggtaggttgtaaagtcagcacatgaaacaaaaacggcctagagtcaaaattacccttgaaaatcttttaagtcacctttaagtcgccaaggcctgggcttttagaaaacacaaaaagccaaaaattaactacttctgtttctctttgtcttttggctgtggcttctttccctcagccaaggctgaataaataccgagcttaaaagtagagggactgctcagtaaacaaagagatgtatttgtcatgtacacatacgtggatgtgtttgtatgtttggtgtgtgtgtatacaaatgcacgtgcatatttatatttttggacgtatactatagggaaacttgagtgacacgttcccatactatatagatacataagggaggcaaaaatataatttgcttttgcttcttcaactgttgagcatgaacatcatcggttatcatatgtatctccagacaaacgatatctgtaaatgataattctcaagcctttacagatggtcctgagtataactgcaattaaaatccactgcttcaagactgttggggcttggtacttattactctaatgctccactgaagtgttactcagggctgaaaatagtgagcaaggcttaagacctccaagcatctccattcctaagggcttcagtctttaaggggaggatgttgggtggctggaggtagaaatgagtttgcctcttggttctcctgtcacctacccttgaactaatgagtaattatgttcaatgcccctgtatgcagggtatgatatgaagtaagttacccttagtcctccccatcaagaactcagtgctaaaaaggaactcgaaagagttccagcactgagctattggataacggttactgcaagtccctcccacaatgactctgcagctaaagagggaaagcatggtacccagggtttgtctgcatttacatgtgaattcttcctgccgcttccacctagctcagccctttgtgagctaacctcaggtctaggccaccacttgcctccttccctaaccaggctggaagggttttaagactgattttgtaaattggctttttttcttaaaatctcttaattctgggaggcactgcttaggggatataggctctggatctggagtccaatagacttggctcaaatccatgttctgcgatgtattagcagcgtaaacacatgcctctgtgtcctcatctgtaaaacagagttaataccaacacctggtttagtagattatatttagttagtgcttatcaggcaataaccagcaatattattaataatccccatttattttccaaggaactctggcaaaatatatgcattcttacagtcaatgtgtattgcgtgccttgagtgctatgtttgagatataatcctattttcaaaactctataaaagactctaaatggattactggttaggaagtatgggaagttaggaaacctccacttactagctgcataagcttgagaaggttacttgtcctgtataaatctcagtttcctcatctctaaattgggaaggaaacaataatgacaagcagaagcatttgccgcaaaataagtcagctaaagataaataacttaaagaggtgagaattacaactttcatgggggtcatcggcctttttactgaggctacaacttctttccccagataaattacatgtgcaggcatttgtgtgtgcatgttcataacgcacacatgcacgcacacacacacaggaattctaaatgcaatttcaggggtacacagatccaggctaaactccctggataaaaagaaatataagtagtagtggataccaagcccctagactgagcatattatcaaatggggaaatggaatctgcctgtaagttttctggtagatacaggagagagtgggggaaatggacagcattccatagcttgtgtttttgacaagagaatgcagagatgtttcctggaatcaaactcaggcatgttttttctaagagctgaatataccataagatttgccatttgtttctgtgttttcgtctgaggagggtcactttcatttcaggatataatgttaatcgagtttcctcaaattaaaaaagtaaatacacgagaaagagaaagagagatagtgagagtgagagagaggctagtgtcagtgtggaagatgaagatgttaagtcgttcttcatcctttgctgaaacccttagtcatctccctttctgctaggaggcaacgtggttatgcaaagatatcttatttgtattttcactgatgcaactgcaggttttgaattactgatagtctttgcataaagactaaaacaataaaagcataattagaatacattgtatacagccaactccagttttattttgccccagctctgtatttatgataaatcactaaacatgaatgctctttagggagggtgattttaggtctcgtctctccactgagcaaaaacagtgcctgtgactggagtctgaatttcaattttgcaagtgtacagttgaagtgaataatatttggcacaatgcagtgcacaactgagccactaaatggctgatttactaaattattattagatgagcccttgctgttccaaatgaaagtgcagtcactgtcttccttcatggtgtgttcaaattgttctgtgtttaaatattcagcatgaggctaatgtgaactgatgaactgagactataaacattcactttcaatatagatagagcgacagagatgcaacatatcatgtggccagcagaggtgaaaatgatttatatttaaggatgttgctgcctacttccattactttaaggtactcttaattagcctggtgtttgaaatgactaattcacatgtacagggagagccacttcatagagactgagattttcgaatgccagtgaaggagaagctaccgtgaggatttgctacctctgtatttccaaggaagccttgagttccttcacggcaggctggccacacagcaccaccagagtagcatgtctgccagagatactatggtgcttgacattcaatgtgcttttggagacccaccaaaagggtccacaacccctccttcccaccatccaccccactggtgttcacctcccttataattccaacctactgcacagccagccacactggtacttcaatccccatgtcactgacttctttactgacacctgctggaatgaacaacaactttttgctccttggacaaatagaaccctcctctctcttcccctttgagggcagttataggcaagcacttaaaatactgtgatcacttacagtagattagaattttttattggtgctgtgttgccataacaacatgaagacagcagatgacttaagctaagcttgcaaagcaaaaggctgctcatctggcagttaaaatgaatgcagttcatttcacaagtttcccatatggactcttagtgtatggtaatgaggagaccatatggtgagagaaaatgcactgagaacaattgggttccactggctgagtgggaagttgggagagaaaacccgggtgagagattccggtgtgctctctgggttcaaggtttggcggaggtttgtttgggatggttgttttccataggggtttcacgtttcttaatccgttccttaatatgtcggctgtgtgaaatgacaaacatcttgcaaattttgcaatatcattcatcacaaactgtcagcagtgtttgcaaatctgacttgcaagatcttttaaatgtgttgttcttaaaaggcaacagtactaagtttttagacaaagtgcaggaaaatttaagcacttctgacaagcagaaacattaacagtaatcattttaaaaacactcgcatcttttgcctgcatgtttagctgtaaataatgctcgaatgtataaaagctttaaagtaaaaatgtaataaatactttttttatgtttcataaaggataaaaaatgctttgagccatgtctacgtgttatctatacctaccaacatagagatggatagctcccattctccttactactaaccagattggggacctaggaggacagcttgaaaaaggctctgaagtcaattctgtactatacatgcttcataaaagatgaatataaatgcattagttagacacggtgagctaaattagaaggtcaggcagggctgggagggctgaaaaatcacacaaccaatgagtgtaattactcttttttaagtctattaagtggtggtgttctatcaaggctcaggggtataggacatgaagaacaagataaagtaatgtgtatttattactcccactggatcaatttaccagatattttcagctccataaagcaaaatacacaaatgcagcctttgttacttttcccaaactgctttattttctctaaaagaggggctggctcttggagaaaagacattggccctgagaaggtccccaggccaagccttctcagtagggaaatgagagaaagctggtgagaatctacataaggatgggggccaggtgtcaggtgtctgcagaggagacacctcaaggcaggagaagtgggaactcaacatagtgacggcagtgaggctaccgaccctgagggcctgagtttgaatgaatggtagttttcccgcgtgctagctgtgatgtcgtagcaagtcactcagatctctggggactctaacttctcatctgtaaaatggggaacacccacagtgcagggattagtggcccccatttactggagtcttgctagatgccagggatgcctcttggcataaattatctcattaacacctgacaacaatgccgtgaggcagctgctttacagaggagaaacctgaagcatgggaggttgagtcatgtgtaccaagtaggggatcatgtttccaaaacgcacatccttctgacttgagagcccactctcttggcctctatgatcttcgaaaaccttaataatgcagtgctgggctcacagtaggcatgaagtaaacattccttgcttcctaggattcacagctgacacgcctgacgccagctaagctcagggctcactctcactcactgccttagggctaaggctcactgaccactcacgaaggcaactaacaaactgcaagggggcggagacatttctgaccttgaacacagagagcgctccttgcccaatgtgtctggattgcatcactgcggccatcagcatctcagaatttctgatcgaccatgttccccatcccctccacctctaaattataagaaaagtcaaccttgacctcaaagttggtcacatgttcctccccttcctgccaggatccagagagaaaggcgaaactgtatgaaacagaacagaatgctgtgatttaaaaaccttagcctgcccttttctccctgtgtatatgaaaaaggaaaccaaaaaacatctggggttagcataatcacagtattttaaatttgtgtgtacagcaactatcactgatggtgactttcagggacaaaataatttacagagcaggattccgcttgctcccgttttcctatttggtaaatggtaaagatgtctgctgcccagcctctctcgcaggagggactccaataaaacaaagcacgtccaagtttttttgaaaaagcacatgcctgtatacaaaggcatattattatggaaagctgtctgcttggtctttggagcagtttcatttgacagaatgtgtgggtggttgtatgaatctagctttgtctattcacaaacacatgggtttaataaagaggagtttgttttttaaggtgtgtggtccatagctcactgaaacactcctgtttgacaaacactgaccatgatcctaagaaaggcgcagcccatttttatctccctaacaatggacagcaggagtataaatctcccaagtccacaggaataccttgtgctggctccatccgccacttcctgaccctgcccttgaactctcgctccactttaacattcaaagccaagaggacagccactcggctctgagtcacactgagagcttcctggggtgggctccggccagcccttgcacgatcaagtggctagatgcaagccgtggagtgtttccttaacacacaaatccattgtgtccttgattactctttccaaacccaggaaaaaagggttgggaattttaccatcagggacaaagtgacacgtgcctatgctatttgttcaacatttctgaacataacatgcaaccataaaagtgttttcaaaagtaagtacacaaaactcaaccctagattcccatttctctcctttcctttcttataagaaaaagaactgtctggtttccgtagacctcaaccattaaaccagatttgtcttctatttttctttgagacagggtcttctggctctgtcacccaggctggagtgcaatggtaggtatgtctcactgcagccttgaccacctaggcttaagcagcccttccacctcagcctcccaagtagcttggactacgtgcacacaccaccatgcctagctaacgttttttttagtttgtagagatagggttttgtgatggtacccaggctagtatccaattcctggccttaagcaattctcccacctctgcttcccaaattgctgggattaccagcatgagccactgctcgataagtatttttaaagtggcaactatgggccagatgctatgccaagggcacccatgagatgacctctttatccttacatgatcccctatgagttagcatgattaattatccccattttatcaatgaagaaactgaggcacagaggagaaatcacatgttcaactgctcaccaggattaggatttcctgctctgcagagattgggtggaagagctctcagaagcaagggtcccattctcactcaactggcaaatcatcatagctaccttttgttggctgctaaataagtcattgtaataaaactcgaaaaggtacaacatagcaccatccacatttagtggatgaggacattgaggcacagagaggtaaacaattttgacctaggttgcatagctagcaagtggccaatgtctgaattccactttgtccaacctgactctcctcaatacctccagtggactctagagatcaaatggtaaagcaagtgctaaatataaagtgaatacagtgcccaaatgttcctcactgggaacaatgggaagaatctggcattgtacccctgcctttgttctagcacgaagacagctaaggcacctaccattagtcagacccacatcatttatatcatcgtgctataaaattaccagttgtcccataggaaatgcacgggaccatgttcttgctagacagaggaacctaatggtaaatctctccacagaccatctataccatgggtggagactgctgtttattattatagttagattatttaatctactaaataatattaaataacctgtagatgatttaattgcttaccaagaataaattggggtggaaaaggaaagggaaggacagcacttcagtggaagtgaggttgttcttggaaattgaagcttgaaactgaaggcatcatctctgaaaactgaaggtgtttttccctcaaagtcaagatgcaggacacaggcccttgctcatcacagtccttcctctccggagcagttagcgctcctcctctccatgcgcctcacctctgtgtagtggcctgaggggtggatttctcccagacagggccagttctgacaggtggccctgcctacaagggcagccagcacacgggtaggatttgatgacgaactgatactccaaggaggttcaccaagctaagaaggatggcaacttcatttttgcaagtgttttacacggatacataaacctagaaatggcatatctctagacttactgtggcaagaaagagtccttgaaactactaattcaatttaatgttaatagttttcacttgtgtaataaatgaagctttttgccgtcagtaaacagtgaatgcaagctcaacgaattctgtactttgaacttccttcgcatttaactgccctctcctctgagtcctcacagaacgttggttgcacttttctttaatgtgctattatttttatgattagttgtgtttgggattctctcccacataaagcccaagttcctcaggtacagggatggggatatcccaaacattcacaacaggtatgcaatagtcaataaaggtcagtttccttctttctgcactggcaattaatgatgtattggtgacatatatgactctgtcttgaatttttgtttaatttctctcatatttgtgcctattttcccaaccaggtagaatgccttaggagaagagaggttgtctttgcccaatctcaagatctaccaaaacattttgagctctaactattctcctcttgccaggactaagtacggatcctcgtagacagaaatttggtgctgctttttcttttgagaattggtaagatgtagcgattaagtagcccagactctagggccatgctgcataggttcaaatcttggtttagcgatttacatgctatgtgaccttgagcaaattattatttaatctctccttgcttattttctcttctaaaataggaatggtaataataccaacatcagagcattgttgagaggataaaatggcataacagatataaaagtaagcacagtgttgcctggcacataagtgcttgctacttttattattgcttaccttacagcaccaaacacacaaaacacaaaaatatgagttgtttacctgtgaactaatttttatcagcagcagagttttctgcaaatcgctcaagtccaaattttcaggaattacaaaaaggcagtatcctcacctttggcaaacgctcagggtcaccagggtgccgaggaatgaccttctgtaacctctggaaaccataatcgatggtgggttcgttgagcgctgcaataaagaagtcacacaattagtacattttcaagaaataaagctgaacatggcttgcaacactaatggtgtggaaataaccaggaagtccaaagtttaactgatacttttgaattggatcacaagatggttgtgtgaatgatctcttggctaaactttccaccatctgctttataccacggtggggagtgacccgcccaaaagaacattaggagtaggtcttgaacagtgttcctttggccaaattctacactccttacatgatcataaatagaaagtaaaatggtatttgatgtgaggtttttagtatccactttaattcagttgctcaggtaaaagcactcaagggcttgcctggtggtatctatacattgtaaacagcaggagaattaaaagtatctgcttaactgcaaaatccttagcggacctcagctgatacaatatctcagcacaaataagcatgcaagaggctggtgagagtagaggagagtgagtagaagtgaatctttgaggtatggaaagccagtgccacccttgagagagtctgcaaagggatgggtattgaaaatgccctgattcaaaactctcacatctgaaatgatagatcctttcaccaacattgatattatttgggaccagcatctgtgaagtactagcttagagcagccgagtctccaagaataatccttgaaaacaccaaaagaagagcaaacctggaataacatttggagacaatggaccttgctgtgtgcacattgactacacactctttaaagcatccttaaattaaacacaatattaagtggactctggtctatcattttcaaaatttctccctggtatgtgaaatatcttcaggctgtctcacgtgaaacagcggagatggaaaacacggcagctccagctcctatccatagcctccacatccctatattctctaagtaaggggtaggtgggtgtttttttaaaatttcttgtcttttttagtgtaatcaaagtgctcaaccatgtattttctcacatgctgaataaaaaagacagtctgtgtagttctgacatttagctatacattaaaaaacaagttgccacacgttttgcttaaaatgcatttccattaacctaaattttaaaagtaagattcatactagtactaactttaaaaaactgtattaaattcaaataggtcccaaggctaatggaagcaatttgtataccaacccaaactgactggcccacttttcaaaatacaggtatgataatcttgtggttttaaaaggacatttaaattgaaagactgtgaatttagtacataattataccaatagaactctttaacttgtcaacttgtaaatctaaaaggctatcaatcatttctaaagaggaaataaaccttaaaattccttgattgacagtgcttactttttatgtaaggaaaaaaaaaagctgcataaagtggccagaaatccatttacaaaagtacattgttttacacaggtgagtaaaaagccaataattacacctccaaaagacacataaatcagagtaagtactttttcttcacttgtatattttaagttagagtgaactttaggtaactttttattagaaagatttttttcccccaaatgcaatgcttattgaagtcattaatagagtggcattttcatttaagataatgtaatcatttttgcaaatatgagatttagttaaccctccccccatttccaaacagtaaactttcaacctgtctcttgtggaaattaactaaaattacacccaggtgtatcaaatctttctatctatactagtatatgagttaaggcacaatatttattattccttccattttatgaattactttctaaacccttgagaagaattcttttttcaaattagacttgtagagaaaatgccatagaattctttaggcagggaagctgcaacttgtaaaatccactgtatttaatcaagagatgcatgagagagacaggaatgagcaccaaggtttaagttatttataatatccacccccacccataatgctaattgccaacaaaaatgtttaaccataaatagtagctttagacaattaaatgcatcattttaatatctgaaaacataattcagcatcctgaaaattctaattcttggttttacttttcagtctaagataccagtaaaatttgaattgttgccccaccacttcaatcattagcataatgaattcctattgtgtctagaaattcatggttgttaattgaatgactgtctgatgtatggcggggagagagatgtttctccggctatatggccagctcacagaggaatgaccgacaatatcagcaattaaaagaaccaattcaaatatcatatggaactaatagctaaagagctgaagagaagtcattcggctgccacagagtaattgaattagacatattaaactcattattcaaagaaaaataaggatttactccatggacgtgtactatgagagaggaaatatttaaatagtaaggcaagggcttttaacttatgtcccatgcctttatgatttgctgtctgttcatagctttaaacaagttaacctgccctcaatacaggtattgaatattacaatggaatcgtccagtgctgcagacaaagctaacattaaagatgctagacaaagctcactgtcctaaatccaaaggaacctgatgatttatctgattgcattgactagagaaaaaaagtaaaccaattactgactgtgggggagccatctgacaaagactgttattttaactgcccccacaaaaaatatattaaacatctgggaagtgggggatggttaatttaaggcacccgcatggaatagaatatgatgccatcctcaaaagcaatgccataggaaaaaatatttactgatatattgcttggttaaaaagtagattacaggagcatgtgtacaatatagttactttttttaaacaaacatatatagaataaagaaaatatgtctgtgtataaactgccaaatagtagttatttctaagtagcgggtcttaaagtgcttttcttcctgttctttttgctgtgaattttctaaattttccacaatgaacatatattacttatataatcagagaaaaaggttaagagcaagagattgttgctgagatggaatttgacctgcttgtataaagtaatgacataagaaactatgctttaagaggggtctgtataccctttaataaccttgcataggttattacagaccataagaaaaataagtagtatacttttggccagttgtataaatatgtgactattcataaactctctgaaaatcaacagagagggtaacagggaggaatcataaagaatggtatatttatttcatcagtgggggtagtcataccttagggacatacatctactctgcaagaatgtaatataaagttaatccttcaacaaagtgacctcattgtacccaagcgcagggctcaggaggcaccagaagaaatgggactaaccaatttttttccccctcaaacttgggacaattccgagaatctggtagagcaagaaaaaaaaacttaattggacacaattaactacaaataaagaagcatgagcatcttagattgaaaaaagaaaaacagatgaagctgtaaactgcaagaggaatggaatgatgagaacagcttgtgtggccctgcttccaaatacccagtccacacactctgaaaagggtctgagagggtgtcaccctaaaccagttaggtttagaagaatccattatcccaaatagaaaagcctcaatgtttataccatgagaataaaatggggccaatgtatgcattttaaaaattccaaaagacattaaattatccatttattcagtaatcatttttagtgcttaccatatgctcaagaagagggggtggcattcgtaggaatgaactgtttagtgtcacaacatcataagccctttaaaacaaactttccgaaaggtacacataatccaacccccaaagacagatgaaatcctctacttgcagagctgggatgcagctcagcatctcagcatctcacagccaggtcctccttatagtcacctcctctgctcctctttctgacaaagtctagggtcacaatacacttaatggggatacattaatttaaagaacaatcaggctgttgaggggccacagcaattgaattcaagctgtcttccactgaccccttcaaactcatttactggtagaaagatatttactgaacccacatagtaggacttcgtggagttgtgtacagcttatggaggggtacatctgaaacgttcctgtaaatgcatgaaaagcaaaatcaaatgctcccaaacaggagagtaagcttgcagggcaaatgtctcagctgagatttgagaaggatcccctcacccacagctatgatgtgatactggggaatggatattggtgggatgtatctgttgtatgcaccaggatgccatttgaactgtatcaacattactacttttgaaaaaaaagttaatgaaatggttaaaaaaatcaaactgttttattctggctttatgttgggactgcttatagagggctttaggttccttccggatctcatcatctcagagtcccctaaaggaaaccagcaactttctattccaaccgatctctcagcctttctctttatgggcttcaacccaggtggtggtcaagacagaacagctctggttctacaaagctataatctctaatgtccaaatgtgcatgcagcatgaaatgctatatgcaaagaaaatcgagataacacaactagtttttatgcactcatactaatcacaagcttctaaaattcaattgaaaactcataataatgagtgaattctaaccaaatatatatgtggccttttcatgcctatagtctctttttctttcttaaagaaatccacttcacaaacacatcaaataaaggaaattctctgtaagggggtatatttgcaaattaaaatcatatagtcaagccagatgcattctcagttatgaaaaatgatttttctctttttggagtttccttttaaagaagccactcctccgtccccgttaacttcttgaatacttattcctggaaacgatggaaatgagaggctgcagagttctgttcagaaacaccaggggaaaagtgctttgggtgccattccaacattggcttacagaattccctgcttttatagctcagcgactcactgccgtgctttcacatatttctggggttttaatttcctttttttaatggttgtgtgacatgatgtcattttgactggaaataaaaagaaatgcagatattaggaaggcaatattaatattctattgccatttaatgtccaaacaaatatctagactctatgccaagtaataaataaaacctcatagcagaggcaatgataaaactagcacctgggtctccaagcttccctggtgactactccatatttgaactaaaggagtaacagcagagcatttccctccaaggcagatccattctgggcatgagagttattacatatgtgttaggcagagcctttttgttccataatggccccatttttccctcagtcactaaattaacaaccagaggtaaacaataaaacagcaagttatcttcacaaatctatctttaagactgagtttaaaatatataaaccgaaaaatcagccagaaacctgaacaaggccagaaatattgttcacgaggaaatttgttgcatttccagccatttggatatttcattacctgcctagatacttgatgcacaaacggcacaccaggtcacctcttccgtgggagtgatacacttcctaagaaacccaacaccaaattccttgcaagtgagctcctgctttcccgtgaaatgcttttacagcctggtgcccctgcctcggagagagcgaggctcaggagggcttcagggaaggactcctggaaccacagaaagctgtaactttctgcaacaagaagggtgtcaagacgaagccaacataggcagaattaaccaatagagaagccagaggaaaatttccaaactgcctttgaacatgccctgatttttttttttttttttttttttttttttttttttgagacggagtctcgctccgtcgcccagggtggagtgcagtggcgcgatctcggctcgctgcaaactccgcctcccgggttcatgccattctcctgcctcagccttccgagtagctgggactacaggcgcccaccaccacgcccagctaatttttttgtatttttaatagagacggggtttcaccgtgttagacaggatggtctcgatctcctgacctcgtgatccgcccgcttcggcctcccaaagtgctgggattacaaccgtgagccaccgcgtccgatcaccctgatgtcttatttgtagtcttcaggtctcttgatgtgtgacaacaactttgagattcaaaaatcaagcaaaggaagcaaggcctctctaccacaggcacaatcagaggtattaggtgccttgagtggttacgtcctttttacaaagagtgcagccagggtaacatgcaaagaaaaggctgaagacagaaggtcaactgaaaagcaaagagcctaggaggatgaaacaaagcaggggcactcggaggaagactgatgagggaagatcctcaggactgtagcttggaatgcaaagaacttgcatatgtttggaaattaacaattcttggagaagtaaaagccatcaagaagaggaacaaagaattaagagacttgcttttgtttttcaaaatgaaatcaccttactgtttttctaaatctaaaagtaatgttaacataattattatataaaaaatagtttaaaggaggaaaacccccataatatccccattcatgtagaagcatgattgatattttagtatgtatgcttccaaacattttcacaatactgttttataaaaatatagattatatacaggcttatacctatctctttctttttgatgtttgtagcttaccgtattatacagatagacataatttatgtaacaaatcctctactaactggaatgtaaggttttcttcccaaaattttcactgacttaagaagcatttataataagcacttctcaggataaaagaatatgcacatttcaagtctttcagtatacatatttcctaactatccttcataaaatttatgccaatttacattttgacaggttactttcaaaggcatctgcaaaagaaaactaatttttaagattttgcatcttgaactcaattattctctaagttataaggacctctgaagattgtaggtgttaacagtcacaatgattccttgtagaggtgccattttaaacataccctgaggtcatataagactctttttccagtaataacaaagtgctttctagaaattatctccttggttcctacaatatgcccttgacgtaaatgttaaaaattactcctaattcaaaggtgggaaactgaggcacagaaagagttggttgcataaattagcacagaagcctcattgtttatatttttgtagtcctttattattccaagatgactattttatgttaatattgatgaacctcaatttgccacacattaacaagtcctgataccaaatcaattaaactgctgttttttgtttttgtttttactaaatatccgtgaaacaaaatcccagcactaacaggaatctctgtgcctaggctcctgacattttacacatgaacaagccgtttggtggcctgatttttattatgtaaggctcaccatgtcaactaacacaaaccttttggggaggccaccctagtattttaaatttgcccccaaatgctcaagaaactgttttctgtccatcaggttcttcttattggtctaagcctacaaggagctctcaaatgctgatttgactttagagagaaagagacacaaatgctgtctctgagatacattaaaccaatttatactacaaccggttggcattttctagatgtgtggtgagaagttactggcagaagtggagcatctcttcatgaacagacccctttcttgccctggagggctatactgtgtctaaaatgggaagtaggtgaacctccaataattaggagaaactgtattgctctctaagtgtactacagttgatgagaaaagctgcccctgttactgtgtttaaagtgctctgaacagcatggccgtccaggagccttaatttagattcccaaatttgatccaactttaaaactaaaataaaatcccttgagcaaacagaagttgaatgtacacaattttttttttgacctttcaatctttttcatttgggtgtttttttaatttggatcattcacgattaggtttcaaagccaaatttgctcctttaaatgagaagagaagaataatttccactttgtaatggatgatggcgtttaaatattggagaccaacatattctgtctttcttaacatttaaggatacgtccataattctcttccctactggcatagtttctgatataacaagagtaatattacttctataattgttcttcagatttcttcccaaagagttttgacattagctgttatcaagggggtaaaatcacccagcctgtctgataaacatgttttcttatatccccaccccagcaagtgctgtgacactatacttttatcaccccgtgtgtgttcagaatgagcttagaacagcaattgccgggaataggcaggcgataaaccgcattgatttaacacatcttgttttcaatcatgcttggattttctgagcacgcatttttcctgtactctggcttgtagcttttatctgacgagctgatcccttttcactggaaaatgaaaaggtcgcacaataagacacggtttactggaacttgaacacgcaccagggaaagtattttagataaatactgtcagacatagtggagctgaatttcaacaacacaattgctaaacaacaatacttattactctcctagaacaagcctaccagtgacttatggctctcagcaggggacagcaccgagtcaggctccaaggcgaagaaatccttccctgagccttgtgctaaccaaacgcggagttctgggctgaagtcctacttgtgattgttaatatcatggttttatgagacaactcagaaaatgactcccactgttcacagagttgtttcctccaaaccagtggacaggtttcagaagagttgtaatgaaattataacagagctctgcagacggtcagactggaaaggaaaaaacaaatcccaagaatggtgataaaaaagtgactccaaatcatccactaattccactaataagacaggaaagtacttgtaactggaagatattagaagattaagtgattatttggtaacattttaatggaattacagagaacttacaacaagtatgccatgcagcgagctacaatggccttgcagataagcctggaagtttttatcagccaaagcttcaacttaaatagcatcttgatttaaaaataaatgaagtcaggcttcttcagtattgacctaacctaaatgattatttttgctgagcatcttgatcctaagaagtctcctccccctgactattatactctagaacacttttaacacacattttgcttatacatttattgtctactacttcagagctcctcaaactttctctgttcacagtaccctgagtatctcagcaatcccttcaaagcatccctaagccaaaagcaatgcccaacaattctgtttattaactacttagatgcgaacagcttaaactttatgttccagcaacttagtaggacatacatatttgacaaaaactatataaagaaatggacaaaaaatatataacattttatttcattttaaaataatcacaatttactagtgaaacatgtgttcctggtgggcaccacacaactttgcacacctcagaatcagactaaacacagccaccttcatttttgattccatattggttttcacgtggcacttttttttgtaaccacagtaaatgctgaaaaccagctttgcaaagatatgacaccatcaaaaggatgcactgtaaggctgggcacagtggctcacacctgtaatcctagcacattgggaggctgaggcagaaggatagctgcagcccaagagtttgaaaccagcctggtcaatatagtgagacctcgtctctacaaaagattaaaaaattagccaagcatggtggtatatgactgtggttccagctactcgggaggctgaagtgggagaacagcttgagctggggagttccaagccacagtgagccatgatttcactactgccctccagcctgggtgacagagcaagaccctgtctttaaaaaaaaaaaaaaaaaagcagtataatgtaatattgagttttgaactaccttaaactggtagtttatacagtatctgatgtacttgaagtatcactgtttccctcaagtttgaaatatctcatagcatcccattaagtttgtagggacaccttggttgataagtttagaaaacatggattcactgagaagcataatattaattaaatgctaagtgccacaatgaattacattcattcatgtgtatcttgtcttcttttaataattacaacagcagcaacagcagctcacacttcctaaggacttactgtgtgccaggcactttatatggattaacctatccttcacaacaactctataaggaggtactatcattattcccattagacacagaagaaaatggaggcttggagagttcagactttgcctaaatccaccgagctaatgaaagtaggggctgggattcaaacccaggcagtctgcctcgagagccctactctgaacctgttcattagagcagcaagttaggccaaccaagggctcctcagagcagatctctaataattttggcttccaggacttttgtgatactgtttttgctattcatgtatccttctatctacaatctgttttagtcctttcctttgtctcaatttatattccatgaaaacactccagaacccatttgacttccattttcctaataacacattcttcttccctttgtcccaaccgtcctggagtaagactcagctagactgcagccaggctacataattgacaggatatatgttccttttggaaaagtcacttacattctttaagtattcctcaactgtaaagtgaagatttaatgtgctattatttgtacagtgattagcacataaatactcaataggcagttgttattactattaatagaatataggccatgtgctagaaacaggggcaggtgcaatgaatacaggactaattagacatatttacatattccccactctcaaggaactccagagtctagaggggcagaaagacacaaacagaattctaaaacagtgtggcaaatacaacagcaggaagatgtggggttctagaacagcgggtgtgttacacttgtccttgggactcaaccttccccatctcctttatgctaacttggaattacagtttaaaaaattctaccacctctggttctcaaatattaccctgaaaatgagctccatctggagtaggacacaaccattttaaaacaatgtaagttctgtgaacaaaggagaaaaaaataggagacacctaattaagacaggattcatttccagacttggggtgttttatactgtttaattaattaaataaaattgcaggcttgctgtatacaaggccccatgcttaagaagatgaaaagaaaaagatgtacaacatgcaagtccagtgccctgtgagtccccagctggaaatgattgattccatttgaaaaactcttctaggcactgtgccatacccttgagaagaacatggtccagtggggagacagacctgtaattggctacccaaaaatatacaaaactgtagcattattaatgtacactgcacaaaaggaggaaaaaattaattctctgtagtagagtcagggaaatacttagctcaaatatctgagttgggtatggaaagataaataggatttttctacggaaaaggacaggaaaagcattccaggcaataggaacagaaagagcaaagggagttatacaaaagatgtgttcaagtagggttggatgttccagtttgggcagagtacagcttaacatgttgagagtgaggtgttaaaggttaaccataagtaacagtattggccttggtgccttgctaagagcaggtagagagcaaggagtcatttaagattttccagatcgtaggagcaacacgatgtgatcaacattttaaagagccatagaagtaaaatgaaggttggctcttaaaggcagcattattgtaataatccaaatggaaaataaaagaccaactaatgatggggtggtcatggaggaaaaagtagatttcagagagatattttagaataaaatctacatgaattcagcaacatgccagatgtaaggcaatacgaagaatgggggatggctgacatttctaatttatctgactgagtggaaacagtggccatttagcagaaagaaaactatatacaggaggaaaaaaaatcatgagttcaatttcagacatgctggaatttaggtgccagaagatctaggtaaaaatatttagtagacagtcgagaataaagaacagaagctcagactgggcacggtggctcatgcctgcaatcccagccctttgggaggctaaggtgggtggatcacttgaggccaggagttcaagaccagcctggctaacatggtgaaactccgtctctactaaaaatacaaaaatcagccaggtgtggtagtgcatacttgtagtcccagctacttgggaggctgaggcaggagaatcgcttgaatctgggaggtggaggttgcagtgagcactgcagcctgggcaacaaagtgagacactgtcaaaaaaaaaaccagaagcttaggaaaaagatcagtgatggagttaattctatcaggaacaccaatatataggtaatagcaaaaaccacatgtgaaaagagaacccagggcagacactacggggaacacaagcaggtaaggaatggttagagagagattgagagacaaaacaggacaaatacacgtcaaaaaggtatagaaagaataccaggagagaatagtatcaccgaaacgaggaactcaaaatataaggtgttatcaacaccatctagtgcagtcaagcaaccaaccaggagaggtctgaggagaagttgtaaatgtaagcaaatttgtaaattagtatattaggaagttgtaaatgttatactaagatcattagcataaatggcacacacagtttcagacaacttgtggatgctttaatcctaaagttctggttttcttcagtctcactctataactcccagtaaaaagatatgaacctaaatgagtaagtgaggttggcaaacttgtttgcccaattgtagcttagcttatcataagagccatacaagaaagcgtggaggacactcagtcccagatcagtccccagtcctaaagaaaactgtagaacttcagatgcctcaaggcaaaagctgtcacattcaccggaaacaactatgatgataaaccttgagctgacttttagatttggttaattcctgttagtatatttggagcagtgaagatgaggggatttccatggttcttgatgttttctgctgacactcttaatgcctgtcttttaagaagtggattgaactaagttaatgacttaaggtacccagtgaagttctacttcttctaatctaccctagatttggacttgtgctccgtctcctcgccacaaaatattgacaaaatatagtgtataataactagaatttaatcttcccctttggatgttggtggtcttaatattggtccccagcgtcttacaatcaatagatgtttagttaagcagttcacttgttttggagtaacagttattgtgtgggcaatgggtatgtggccacttccgcaataaccccgggtctcctgacagagtgaacattacaatcacatatttgttgctattagctcgtgagatggtggaaaccaattttgaaaagcaagtaataaagcaccacataaaaaataatggtgtaattacttcttggtcaggtaatacctactgtgacgataaaaaccaaagggaacaccaagcatcaaaagtgggtttgctgtaaatttgacactggttctgaccttcagcaaggaaaaggtttgaacccacccacctaagccaggtacacagaagactctttgtgtcgtgtatctttaccaagtctccatgtaaaagcattttagtgaatttatctcattagtgcctacatcagttctcaagagctgaagagactagaccagttgctacattactgacccaaaggctttcataatctcatttgaatttaggccccaaagaaaggggtctggtaactgcattagaaagaaattgccatgtggatataatttgttgtctaaatgtagaggataaagagggagggtgggggttctaattggaatatggaccacactgtccaggagaaagtgaaaataatgttggctgttgctgttgatctataagcaaacaccctggtaatccactaacctaagtggaagaaaccaatcagcctccaccttcaggctctgattctttctttcacgtgccatcccaagtgctagagaggctttcctaattcccatggaataatgtgggtgagtgtagggagtgaaagagaggcttagctaaagttatgccctgaacttttaaggataggatagcacagtccatgtttcaggacatcatggttaagtttttattactactgctttgggttatttccagcttgggggaagactcgtggttaatatttctgtttagcttgtctgagagctgcaaatggttctcctaaggtacacgcatcattagaagactttatgacaggacgctgttagagcatagcatttgtcacagcacaagatgaagcaaaagtaggttagcttttactaataaaagtgacaattggttaaattcttaataacagcaactttaatggagataatgagaactcttatacccagaaggttggttagaaatcagtacaagctttctggagggcaaactggctattttgggtggggaggatgaaagaattttaagcttagagactggatctgtattaagttcagaggcatccccaaaagtaggcccagtggccacataaactatttttccaagtgggcaaaggcctttagaaatgccatctagcgttaccagaagcccttgttcttgctaagattcctctggacctctttttccttctaactggaattaagagactgaagttccccaaactgaatcttgcatttctctctatattgatgggtggaatggacctgcttaaaaccaacaaggaaaaaaaaagtgaccttccttctatactctctctataatcttcctgctcctattgaagcctggtgaatttagaggaaataaaaatacatatttagctccatctgcggaattcactttgcctgagaccaatatgtgagatattgttgctggctttttcagagggctgggacatatctacaggagcagagatcggcttgataaactgctgacctattctcaaatggaaaatttttgtgattatattgggacaataggtattgtgaccctttaaggacaaaatcaaatatactggattgcatttttcaaaagctaccaaaacaacttttagatacgaatacattcttctaagtctcccttctaactctagatttaacagtgtgatcttgatgtggtcaggtagagaggggcaaaggcacatctactcaatcaacttcagaactttattactgcaaaaatcttccttcagcaaacacaaccaggcttggaaagcctaagtgaccagtgtaagatcaacagctagtcaacagctgaatcacaactaaaactcaaatgttggagccgaaccaaccccagtcctctgtgtcattcctccatgtaagcctgacttaaaataaataggatcatttgttgagaagcggttctgagcatttcacttttgcaaacttaattttttcctttggataccccaaaaggtagatattcctatttcacagatgagaaaactgtggctgctagtcttgggtgaaggattggtaggcaaagaaatgaaatgtgattgaattgcacctatggaaaaagacaacatcaaatctgtcattcagatgacatcttcatatacatgatctatctcctattactgctggccatttcaaagccaaatagacctgccactttataaaacaaacaccaactaaaaggaagacaacaaatgttcccaggaccctgaaagtatcatggaccatgtctacaaagcatccgcatgttttaaagccattgccaagctgtcctttaaaggctgttttgcaaaaacctccaagactaaaaacaacatgctgtgactttacctacattcttgtaatggaaatgagataagaatagtagttcatagtaattgatgcacaatgaccttgtgccagtgactgtgctaagcactatcttacaaatcaccaactctttgctgtctctgtgaagtctgtactgttatcatcaccattttacaggagaaagacccttaggacgatagaggggtgacggatcttgcctaagttgcacagcagtaagagctgaaccagggcaggctgtcactattgttcactggcttctctgtgatggactgcccctgtggaagcatttagctaatacattggaagtaatggtgttatctttcccttcaggacaacacaggagaaaacaaatagtaaaagatgcctacagtaaaaatatctgtcttagacttgaaaaatataaatgtatatccacatatgctacataaagacttgacttggttaagacatatgttttaaaagggaaagttgccagaatggatcacacttaaatacaaaaccagtttctgtgcggtgtgtggtggtgacatcacccacaaaaaacatgggaaatgacacacgcttctccatgaccatcgtccagcttgtttaatctcaactggcaagtttcccctcatcaagtaagttgaaaatggttatggaatccagaggtagctccggataacacgggtggaattctggtatgccttcttcattaactgctcataacccagaaatgagaataaagctgctcttcctggggagtcttttaactgaaaaaccaatcttaattgaatgcacatatcagttaactatcttcggattcacaaaccattaatgccccattttcacatagtgtcttctttctggcttgtctgaaggctggcattctcagggctgtgcttagaggaatgtgagattcagcaggaatatggaagggacaggagagaaaagaagagagcatattaagtgctcatcttcacaaccaaacgagcgttctgggactgagcagtaagagcgtcaaataatgctgcccttgcaaaattgacgtcctcccatcactgctccgagtcagtggcaaaggaatcacaaataatgccattctgccctctgaataccagttaagcaggcttcaaatgtgcctactgagggaagaggaggcttgtaaatagagcctggcagatgtaaaaggatggtataatgatcaaaggaggggggaagaaaactaattgcagatttctctcttgaaatatttggcctgtttgaaagtcccactttgtctctccagagcagaaaaacctaagcaggagtttgaggtgtgtccccaaggcaatcttgtcaagttgtggcccacagcatggcaattccctgtggaagagggcctagattgactgcccttctatgccaggagaagcaagctccttgaggaagcacatacctcttcccgagtatgtggcctcttaaagtgacaagggtgcaagagtatgtatctctgctaataaagacatcatttacaattggactttgtgaaagacagaagcgtatttaagttctttctgaatttggaactacttggatcctatcaaaaacaattttctaattgtcattaaaatactggaaaccatgaagaagatccacctcccaaaatatgcaatgccatctctttagatttcctgcttttgctttggaaataaactcagaatctaatagtcttccccttggccaagattctaaaaccaacagtgaccataatcctgtaaacacagaaagagattcctaactcactatattcctggccttgaaactttggtgtggaaggcaccaccaaatcaggtcacttgagtctaggatcaaccacgctacagtgaagtcaacacttggtagaaaactgtgaaagtgggctctagtatacctcctagcaatgccattagttgtgacataagtcaataagttcctatagagtttaggatttggggaaaacaggtaatacttttgtattacacgagggaggtgaatatacactgaataatagcagtgatgagtttcttttacacggcaggaatattttcttggctgttggatttagcatatcaacaagggaggctggacataccttttctcagagtttcattagcctgctagaatatttagaggtctgggcaaggtaaactaactctcccatgtttgtgctgaagtagaggtacaggtcccactctgagtattgaattatcttttctcatgatgacatcaacattgaaactacagagagcctcttttgtagtcaacagtatgggacactggatttttatctccctttggacaatgagattgtggttagcataacactggtaaatctaacattaatgctctgtcaaaaattgttttatgaaggctagaaagaggttggagagaaaggaggtgcatccaggaatagatacaaaaacattgaaagagaaactgaaatcaattctgtaaacagcagaagtcaaagcatcgtagttgtcattaagcacctaccattataatattcaaacaataagatatttcctgaaatatcagatcaattcttaaaggagagctgttcccagtggggtttacttgtggtcctctgtccgacatccattagacagggtccctgtctttagtagcatgggttcaaacaaatgataagagaggaaatagattccattctctctgtttactttattactattgatttatgaattccctctgatctatttcctaactgggcagataatatacatttagtaccaaaggtaattatccaaaatgaatctagtttgcaactgggtgataaaaaagagagaggagactgatagattaaatacttatcattaaaaagtatggctgattgtattaatatagatacaagagctttaatattctcactttacggctagatataatttcctagactaattgtgagttcatgtggacacttgggcatattttatttctactctatattttatagcatcattttatagtgcaaataataaaagcattatatgaaaaaattatttcaaaagttttttttaaaaatctaccacttgcaaaaaaaaatcatttagggcatttaaaaaaaaatcttcataaagggatagaacatttagttaccacaaattactatggtttttaaagcatcaaagttagagaaaagagcaaagattgtatcattatacgagtataaataaaacaacttaaatttctagcaatagtgaatggataaataaatatagtaaatccacactgtgggagatgatgcagcctattaacatgtttatgaagaaattttaatgcgtgggaaaatgcttattaggctatgtgaaaaaaacaggatataaaactgtgtgtgtgtaaacacatatacagtataaccacaaatacgaagaaaatgttcatatatatttgttatgtatagaaaaatatgaaagaaatatacaaaaatctttttagtggtcaactctgggtgatggctattggatgatttgaactccttaaattctatcctgtttttctctaaattttctaaattagcacatattatttttatatctaagcacgtattagagagacgggcgaatgaacaacttagaatgaatggaaggtaggacacatgttgcgtttgcccctggctcataatgacctgagggccatcacatgccagggactcctttactgatgcctctttggaacctctccacttacaggcagagtaagctgtctgcagaatcctaccagatgtgtccaagcgtcatacactcagggatcatcacacttttaaaagacatacgtagttatagaaataccaaagtactgaggaaagagtacagtggaacagttaagaggatgaattctggagtcagacggtctggccaggttcctccacttgagtaactctggcaaatgcttaatctatgtctcagtctccttacctgttgaatcaggacagtcaagtgccttccctatagagatgttcagggattcaatgggctaaatatttgtaaaacacttagaagactacgttatacaataagtacttatccattaaatgaatacatctttaaaattctgataatattgatcagaatcaacttacaaataaagaaatggacatggccaaaatatttataaaacatttgagcatttgtaagttgctgaggcaagggtgcaatttcagttgagcttaagtcgagactcaggattgtagtggttttagatggtttttttatactgccaaagatctgtccatccatacatttttatctagaatgatgttgatgatgctaaggttcaagggaataattactatgtgcagtactatttgtagtgttttgttccccactctatatttagattctaacagaagatgtgaaactaaatagatactcaataaaagtttactgaatgaaaacacaaatgaatgacttcaccacagctgcatcaagttgtctaaatatgattatatttccacaaaggagccattgttaaatgaactttccctctattaagaactaggattgaagtatcaaatttcttagaatctaaaactttttactattataacttagaaacaattagatggcaagattaaaaggggaaaaagtatttattccaaaaaaaaaaaaaaaaaagcacagcttaggacttgaatatcttcaaggatccatttcttaggaaatctataaagatgcagaaagctttagaaatggagataccaagacagcaatggcagcaccaataaacagaaatagacggttcatctcactagttctgtggttttctcctacccagtagagcgtgacaagagaatgttaaagtaactgaaatcaagaacaatactggaaataagaacagtctacaatggcaaatttttactgtaatacatttcgttactgagtgagggaggaaaacaactgtttttagatactgtccattgttttctatacatttcaaagctcctcttcacacatgtaactttcaaactgacagtggtaactttcagcattttgtggagatcttggctccaatgcagcaaataagaagtgaaatgtcccacggttgtaaaatcttgataagttatccgtgtcacatttttcaaatgtggaactgctcacaccacacagataattatagatgaccagattgtaactgttttattgcttctttttccccataaattttaattttggaaagttaagtgaaaaatgtggtttcaatttcctacaaattgcacacaatttggttttaacaagaaaatagaaagaaagggtatgttctttaaagtgaattatgaactagagtttgttttcgctcgctcaacaccgcaaaaataataaagcacaaaatttagaaaagatgccttacaaaatggaaatcatgaactatagtaagaaagcagaaagtaatttttttttatctaaacatgatttaagcaatctaacaggataatataattgagctagtctttctccctctggtgaagcaagctagaaggaaaggataccggagtagaagccgacaatcttaatacatgtataacaggaaatctgttaataagaaaaggctttgtgtatctccatcttactctctccacaactgtcagcaacaacaaaagaactattaaaagcaatcaattttgaaaccatttaaacatatacctagaaacacaacaaaacacaagaatttataaaggaacttttagtggaaagaaattctagccctctgatgggttctggctataatcttagagttagaccaacatgctttcttgattcaaggtagtggtctgctacaactagcataactaaaggcaggaaccccatgaagtgtctcgaccacaccaaaaccaccagctggaaagcaaataaggaaatcaatcaaccagatattttttctcctttctgccaaaaactttgagtgaatgcacttttcttcattaaattgaccactgctttcacctttttagcaatgtagactgttaggcaaaataaattattcattattcaggcaaaaactatttcatcaaagttgttgatcttcattgaccaaattctccatggcctatgttactaaatagcaccaccatagctttctcaaatttctacttccaaaaatgtttactttcagacagattgtgacgaccacaaaacttacctgcatgagtattctataaacaaagttgttgtagaccaaatgttaacatgagtccctggtaaaatgttgtagccctagattttttttttctggctaaaatatagtatttgctaattttttttctaactagggtttaaagttgcaagtctagagtgcttctgactgttagaacatgaggctggcttatgaaggtccagttataagctgggacttggcaaacttgaagtattacccattgactaatacttctattagtcaaaactgtaaacttctggtcaactacatattttacatattactgcatgaagctctagcagaagttcaccatcctaaatagcctttaaaggcttcacaattaacaagagatgatttactctcttgaaatataaaagctgacttttcccacccaaaagccaataaatctttggtgttggtgaaaggccattctctacctgtagcaatcaagttatgcaaccctcaggcaatgacttttcattgaactcagacctgactgaccacagcattcacaaacatctcagtccccagtgctcaactgacagtgcagcctgatcgccacgatgttgcaatagaaggaaagaatttcctagcaaaatgctccaaagcttcaataacataagaatccacacaaggccatcttgagaaggaagcaagtgatatggtttactcttaaatccaggctggagtattcttcattcattcatttatttattctgtcaataacttttccaaaagagcctcctcaacctatgccactcaccagccttgattccaaatctatgatatcagattggatttttttctagttagaaaaagtattagcaaatactacattttgaccagatcaaaaacaccatcctgacctgacaaagacccccaaatatttgactcattgtaataagcaccttattttgctctaaacaaaagtatttagatgacaatggatgaatattggaaactctactcaattcaatgcaaacaattttaattgcaaggaatttttcttacttaaaattgaattcagttgagtgctcaggcttttccatagcatgataaagaaaatgaaaacaccctaagtaacctcaaatctctcatgagaggtcggggagataaggtattaagaggacagagtgggacaatgacaacaatgagtttgggacatcatttgtataaggtcctggactattgtagaacatattatggctgagaagtaaaattaaaagggggatagatgatgatggtgtagagtttttcttataatttcttataaactaatgtttattgttttgtttttttttcacatataaagactgcccattgcccaattttaagaagatggagctcagtaattaggaaaaaagtagaaaacacacatttaaagtaatctttcctaccctgagccccctggccatatcccctccccacttctctagttccctggactcccaggttaggctgtcttctccctagccatttacccagatttctaccagagcattttgtcactttgatttgcatcatatgccagcacagcctgcctcctgttcatccttgctctgcacctgtctcctattttatcttagtgctttgtaccacactttgcacatagttgacattcaataaaaggcagagaatgaaattcaagagacgaatagacttctactttaggaagttcattttattttcaagctcctaaatctttattgggattaactagctgaaggcctaaaagtggaaagaaatacagggattgggaaggcattttgagatatttgatggacttggaactcccacagaattttaaaaaagaaaacaaaggctgaggcctgcaagggccttggtacaatgcccttggagggagaggggcttcatggaaaatggttgccatgataggatttggggagaacctctatgtttgagggagtttgggtcaggacctatccgtggaagcaaaaactagtgcccaaatattcaaaacatagtttggtgaaagatcacctatgattctgaacgaaatagtgtagataaagacatctggaagttttcctattgaaaaaaagaaagtgtgaaatcagatacttttgtttttaaggctctctttcttaaatttcctaacttggccaaaatgtcaatggtactttagcagcttaaagagctcagcagcaaaccttactaagttctgtagttggccctggctgctaacttgctgaatgtgttgggctgttgaggtgagttctactggagtcttggttgagccccccagattccaggctctcattctggcaggctgtttccctctggccaaatctcaaccacagatcaactttcccagcctctggagatgaagcgttttggctgccttctgaccaagtgtgagaattttttttttttctgtttatgagatagactatagcgtgtttcccagggtaatcagtcatcttgacctgtgatcacaggaaaaggcagacaaaactgggagagtctagatcaatggatttgttttgtaaaatcactgaactctgttgggacaaatttgattttttcttttgccccctttatttttttaaattgagtaacttactcattcttcaaaaattacttagaatattttacttgaatccattcctgattaaaaataacctcttgaagtataaacgtaatggtttttgaattccttttttattccttcatcaatccacttatctgacaaccattacaggactttaactctctgccagtcattgtgcttgtggtgcctaacatgcaaactctatccttgcagctgcctttttttttaattccccagtaaacatttaataaagaaatagatgaatgaatgaaagaatgaacaaatgaattaactaaataatgaagagggcaaattcaaactggagagacaagcagaacagtgtgaaattcatgcatgtgccacggtttgtgtgtgcctatggatttaggacattctaccacagatttaaaatgtggacacgtgggcactaattcctgtagccttgaagttgaggcactggacataaaagacaaagttagtggagcctttctgtaaaataacatgacttctcaccctcatgctgaaaaaaaaaaaaaaaagaaaaagaaagtgggctcattccaaataccccatcacccttcacaggctgagccaggagcttgcctccttgtggctaaattggaacaatgctttgctcagtttggacccagatgtcagtgtggtggtacagatggcaagaccacacatctgcttacaaaatttgagaggagaaaagggcttcagtggcatccagggcttcaaaaggcatgctacatgcatacatcctaaagggaaggcgggctctctgctgggtaacccatagtgatcagtacaataccaccctgtttcccttgtaggcttacccctgcactctccttcctgcaaatgtttatagcctcccttctactgcatcaagtcagactttaactgtctctcattacaagagtcactgaggaaagtatggaacaaactgaaacttgaggaaatcagacttgttagactataatttctatgagggcagggattatgcacatctttgcacattatgtacgtggtatctccggtaactaacatactgaggatgattaataaatatttgttgaatgaataaatggggcacagtgcaacatttccattacctttgtgcctaaatactgaagatcatgttatacgcacaagagcctggactctgaagccagtctgccagtgtaaaagtcctgcctttgccactttctagttgcataaccttcagcaaatgctgaacacctctttgactcagtttcttcatttgtaatacagcgataataatactacctgtcttgtagtgtttttaagattagatgtctaaaaatatgttgagtgcttaaaactgtgtggtagagtaagtgctttgtgagtgttagcagcagtagctgtttgttatttattaataagaatcgggggctttgttcattcagcaagcactttttgagcatcttctagacaaggcatagtacgaggcactggaaatacacttgtaaaccaaatggaagtaaactctgagataatcacagattgagaaccacttaaagtctttaataacagctaccattttttgagttcttcatgtgcaccttttatcatgtgccaagtactttactcgtattatttcaattgtcacaacaaactagtgaagaagatatgcttatttattttctccattattgaggtaagaaaatagaggtttaaatgataatgtaatctctctatggccagagggcaaggtcttgactcttgatccattcatttacttaacatctactgggtactgctgaatacaaagctctgggctgatgagagaggacttatacacgtaagaaaatcacagtgacagtcacaagtttgtatttcaataatcagcctgtctcaaattaaaaagaagcacacaacagagaaggattacaatagattagctaggatatgacatttatcttcctgaatttgagactacactatgaaacaaccagcagaatggccaacagttgacttttgacaatctgtttgcccacaagggaaaaactagtgttttaggacaattcaaatgcacctgccctttataaaacatcaatgacttttttaaaaaaacatatgagctattagaaaagtaatcttaatattctttttaattcaggcaccaagaagctaagtaatcattgttgcaattaattgctttcatgttgcttgccactttcttttcattatgagaaattaaaagacagaagcaaattatacaatatatatttattcaaactgagatgacgtgacatcatttactgtatttgtacttcccaaacatggcgtggttattcttttaaaactaaaattcctctagctccaaactgacttagcatactccctgcagtgatacacttgataatcatgactcaaaaatgtggagctagaaaaggctgagataatatgttgtcactcccatatttatcaccacatttcctgaatcatccagcttcataatgatgatttcttttcattctttgcactgtttggcaactacatgttttgtgaatacctaaaacgcttataaatattctcttcccttggaaccaataaatcttgaaaattaaaagacaaagttaaaatgacttgtgcacttcaccaacgtctccattaaatgtaccatacatctcacaatttcaatattcacagtttaagactcagtgacgactttcaatcttactatgtggataaagaaggaggggtgtgctttgcagtttattgaaagctattttgggagttagtcttgatagttagatgtcttattctttctgcttctccatccttccccctctattcgcctttattgtcaccaggcatgagcctcttgttccatggacctatttttttagagtcagaaagggagagacagatattacagaaacaacagtttcaaggatctgctacaatgacatgaatcaatgtttttgaaatttcaggaagcttgatctactgagaacatagtcagctggtacggctcatatttctagataatgatcacagagtggctgggggatgggatagggagagtgaatcttctgggcaaatgatagcatagcgtgagcgctggggaaagtccacagatgcttggaaataaaaataagtgtacctgggtgatgctgtgagggcttacagtgctatccatttgtatactgtacaaattctaaggtacacatggctgtctaaagaagtcctctagctcccctcattgcactgtaccagatcatcctccctatttctttcttaacacttttgccaatctgattattatcttctctgcctccttgtgtattgcctgccttctttcactggaatacaggtgtcttgggggcaagaacctcacctttctgggttacagaacatagaaaatgcctggaacataatagctattcaaaatgttttaattaaattggaatttgaatattattgcaccctcccctccaaaaaaaaaataatgtgacaacaaaatattcatgtttcctcaatactacttgtaagatcatcttaaagtctgaaaagaacctagaattcttcgggaatgaaatacagtctgccattttaaggcctcactgtgatgatagtacattgccaagtagatttgtcctttaagactttagaaattctaggtgaattaataaattcacggttatcacaaatcagaaattcatgacttatgaacttgaatttcaaagtttcaggccaaatttatttaaagattttgctcaggaaccatcatagtcctgctgagtccaaaaattgtcttaaaatgtaaaacaatgccccattaaagcaaaagccaacattttccatggcccaacgtggcataagtgtattgttttcaatttagtgacttaacaagaaatacaacagccaagacaggaattccttccaaacatgagaacccattatataagatgaagatctgttcggcccctaaatgaaccacacaacataggaattgtcattagctactataaggcaatgaagaacttataaaaccagagccaatgtgttattaagaccaggcatggtggctttaaggcaatatagatttctgagctatttatttatttattattattattgcaggtcccactctcccagccgcaactattccaactctgcaggacccatgtaacaaggcgatagtatctaagaaataatgagcgaaggaatgctgttctttctttcagagcaatctcaggtgcgatcttataccgtaaaggactggatcaatactcccagcagcaagccgctcgataccccctgaattattgcttcatttttcttcttattatagatgagttgtgttattattttcctcaaatcgatattttacaaccttttttatccgcttctccataaattttgtgattactttaaactgggaattccggtacactaaataagatgcagtatctgaaagggacagaatgtactgacatgttttttgtttttgtttttgttttactcttttagacacaatgccttgtttaaagcacgtcataatcaatagccaaagaaaagtttaacataaccctgtgcttgcaaaataaaagtgcaaatcctttaaaatagcaacagcccaaacagcacaaagctgaaaaacacaaaaagaggcaggattgatcagcactttgcatctgaaatttcattcctaatgctttttctcccctcagttaaagggccaatgcaattcccttaaattgtttctcacaaaggagataactctatgcaccttggagagatttaattggcttctatagctgtctcctgctaagtgtttaaaacatcagcaaatcaaatcatgtaaactcatatcctgttctgctgtcggtttgctccaagcttgattatttcgatgttaacattagcagcgcctacactcaacgaaagagatcaggaatatactctctccccgagttccgggatgacttgagttaattctatgcttcctatgaaataatgtgtgttatttggcagagaatgctcagtggtaactaaataatcattacagtgcagccagtggtaattacatggtaattcacattaacttcataataagcactgtatttttcactatatccatctgagaatgaggcagaatcatagtctttcatttctttttaatgctacccaaaataaaaataaagtaaaatcatttgaagggcaggaggacaaggaatataatcctggtgagttaagctagagatttcattaaagaaatacttaaatccattaagtctaattagacatgacatcccaggattcacaaacagtggttctaataaactcattaaaaatttttggtgatttctttagaaaatgggagaatattatattataggctgttttattacattaaggttttataattttatacgggctcttctctttttatgtaaaagcctatggaactttataagaatagttctacttaaatcaatgagtcttaaacaacaatgtgcttcttgtaacatgtacttaataatgcaataaactattctaagtagtatagaataaaatggggagtactttattctggttggctaaaagatagcaggatataggggctcaattccttatagcattgcagtgcacaatttatacctcaacccccatttacatacatattatttaatttgggcaattatgaagtcctgaaagcacttttctattaccacctggatccttagaaggattcacaccataaatgcatcatatataaatgtataaagcagccttcttagaagaaagcagcgggaacaactttaattgaatacttatattagagattaaattaggtctgtttttaaatgagctacccttaattagctgcagttggaaaaggggaatagatatgttttactttttactctactcattacctgtagcatcaatggacaactggccctttttggcttttcaccaataattgagtgcctttttaggaaggcctggaaacaaaatcttttctttgaatcctaacacaagccccaaataaggtttagaacagaaatcccttatataatacaatcttgattttttgttttgttctgttttgtttttgggacggagtcttgctctgtcacccaggctggagtgcagtggcacaatctcagctcactacaagctccacctcctgggttcacaccattctcctgcctcagcctcccaagtagctgggactacaggcgcccgccactgcgcccagctacttttttgtatttttagtagagacggggtttcaccatgttagccaggatggtctcgatctcctgacctcgtgatccgcctgcctcggcctcccaaagtgctgggattacaagcgtaagccactgcacccagctaatttttttatgaattgggatatgccatggaaaaattgaatgataccctcctcacctctaaccgcagtataatcctaacaacactttctggactcgttcattgttagccagtcaacgttcctgtcgggcatcaaacaaacagtaacttcactgggccaggaacacagcacagatctcttctcaaacaggttttaatcttatccctgatgaccatcatcttgcaagtatttctctctcattggcccttaatgatttgcctctaaacccactaagcagaagatcaccgaataaaggcatttacatcttatctcctcaaggaccaccaggggactgaggcacaaaggagggtccacagacattttgtggccaagagggaatttcaccaaaagtctccactgggcattaaattacaagagtgcagcaggggacagtatatttgggtggaccccactaagtccctccccaaatggacccagggaatatgatccaccagttccaatgaggtcttccaacaatgtgctggtgtctgacatgccctgctcttacagtgggctcccacaaaaagatgagataaaggacatgcctttaaattgcgtaactccacttcacccacagtgaaaatggcacttggcttttctgtggggctttgatttactcagaggtcaagaaaacccccttcttttttgtcaacagacagaaaagcatgtaaacaaatcagaataatgatgtccatgacaccctttttgtaaacatatcacatattggaaggtccaaggaattaagcgtctataccacctcaccctttccttgagagtttactgaaagattcatgaaattagagaaataaagagtttatcaaacgaccatggtgatgtttgttgattgattttcatatacattcaaaaattttatgtttttatatatttgcatacttgggaatctattcacaaagtaattagtaaatccatttatatgtgatctgctctggttttgtaagcaaatacatcctgtgttggtttgggaaagacccttcccttatctgagcctcagctgcctcctctacaaaatgttaggattggtccaggctatctctgaggacctttccaactctaaaactcaaaattacaggcaactgttctcttggatgctcttttgataagatccaccattaatcaggcacttactgtatgccatgcactgtactaagctttttatatgcatgaccttatcaaaccctcacagcagtcctgtgatatattctcattcctattttgcagatgagaaaaatggagtctcagagtggttaagaaactggcaagaatttgggccaggattcaaactgggatctgtcatgattctagagctctatagtcatacagtttctttataactaggtgagcctaaggaaaatatatgtagtgtggagacaagctcttggctgataggtggaagaaaaggaatctggtgtaaatatctaccactaactgacagactttagccaagtctttaaaactctgtaagccttgttttcaccatctataaagacatcaacaacttggacaactagattatcttgaagactcacatcccatatatttaaggtcacatttgtcagtcattccttcacacattttttaatgcattgatttgactaatatttattgcatctcactccgtgctgggcactgtgaatacactggttgagaaagacaaggacacggccttcaggaagcttataatctagtgagagacacaggctacacacaaggaagcaaagaaataattcagattgtatcagctggtgatagcgctgtcaataaaagaactacatgtactcaaagtgtcaatgctggggaggcagcttgaggttctagaagcccccagtctaactagtgaattatgttcatagaaaactaaaaagtggaataaaactgggataagtccatttggtaggtataaaaatctaagatattgaaaggtataatcaactagttggaggatacagatctgatatcagacccatcactagatggcttaaatgaccataagtgaaccgcttcacttctttctacacctcatttttacacctgaaaatggggctaaaaatacctgtctttcctcataaagaacaaaaaggaattgatgaatgagaaaggctttgtcaactataaaaatgcatttaagtacatttacttgtttctacaaacattatgatgaagaagagacacatagtgtcagtagtcagacctgtactttgacccccgatacagaacattccagtaagtcacaacaatttttttgctttgatgctagtaattttattaaggaaaatttctaaacctttagataaccctcctatgtcttctgagctaaccaatgcaaatgtttcatttttctagtcttaaaaaagtagagaattatgagaattacaagcttgctgaaaacagattattcagagacactccttcatctaaacctcgctacaagctcaaagagtcatcctggcctcattgactattttaaaaatcaattaaaactaaaaggaaatgatgaacgtgtgtagaatgactgggaaggccatattttgtgcagatatttaaatgtgaatatatttttggcattaaacaaagatctaaattaactccataatgactgggagttggtgcttcctgcagctaaccaccgaggctgatcccaggtggctatgcctagcaagtcaggccttccacccgtgatgtaaagaagttaaccacagttgatgttaacaggaaaaagatgaacaattacatgtgccaggttgaacagcagtgggtatgaggggaagtcgctcttctgttgttgtttctgctcatgatttagggagtgccagtttctgtctacctctcaccattgagagatactgcagaaaaactcaggcctgatattaatgggatggtttccacctgcactctcagtaccttgaataatatgaggtccatgtaaaagggtgagcctactttattcaagtcaaaaatatctgacttgtggtacagataattcaactcataccaaggattgcacagggctgaggacccagcaacgggaaagaaatatcagcatgctgaactatatatgggcagatcccctgccctccaaaaaaagttatctcattaaatatttgagtatttttaaagcaagatgctttctcaattatgttactttaaatcggtaggggcatgaaataatcataatcaatggtggtttagtaatgcttacggaggtgcagaagtcagtcaagacaaaaaggattagaaagttaatataaatgtagtatctttttaaggaggattgacctcttatcattacaagcattcctcaaaacaagccttttaaatatcggtttttaaaatattgctaatggttacttatggctgagaaaaaaatcttccagtgaaagcaccatgcatagatttaaaaagaggtgtatcacaaacaacttagaagagactataatgggagaaaaatggctctggctttgatttttttaaaacaactgatggaaaaaatgacttgaaaaagtttgattaagggtggaaacccaaaatgcagaagttgtatttgtaaatgttgtaaattatgtatgtgatattagacatgtacaagtaacaaaatttatatgtgaaatattgtaagtagacatttgataatgtattggtatctataaatatgtatatggtttacttgctctggaagccctaaacttcactagaaaaaagggagaacaccaaatattcagaatcacactatattctggcatagctgatgttaaaaattctaaaaaaagacaagatatggctgtccaatgatagaggaatgatgaagcaaattatggtgcagccatcagatggactattatacacccaccaaaatgcattcagggagaatttgaactaacagaggaaatgtgtagtgtataatataaacaacaaagcaggacgcaaaactatataaacctattgtgacttgctgataaaaatataggagtattttttagtaccttctttgaatacccttgaatacttccaaatagtttattggctttgaaaagcaaatcatgttatatcatactaaaaagattagaggttcaaaactttacagtcttgcattacattggcaagaatacatatacagctcagttcctacttttattgttaatagctttctaatcccttaccagaaatttataatttagaaatggcaacacatcttaaagattaaagccatgtgataaatagttcatgtcccttaataaccaaatctcatgccttagattgtgagagcttatctgtctcttccttctatatggtttctatattagaagtaagtactcaaaaacattaacagtgattatccctgagggatgaaataatggataatcattatttcatacttttttgtattttaaaaatcttccatataagtatgcattatgttcacaattatataatttggttaaaatacttaaggctccagttcctgtcagaactcacgtgtcctagaaatacctgccactctcccatcaccaacaactgcatttcagggaatcaggtaattccataaattaacaaggtaaagtagcatgccaggaggcttactcagtgcaggctctggtacccttcaccagggttcaagtcctggctcctccacttactaaataacccaggaagtcacttcacctgagttttttggtgttaaaaataggctaataatagggcttgtcttacacagattctcaggggtggcaccagggggtgggggtggggattgctttacatttagtaattgtagagaacaagaagactgggagaaaagatagagttagggtgaaaaaaaaggtgtggaataggagagaacaacaggagaaaagtcaacaaatgtcaaaagcccactgaagtgggaaaccagaagagcagggagagaaaggaggagctgaaagctctagcaagaaatgctgctggcctatggaggatcagagaggggcctacatttacctattttttgttacaattttggatttgattacatttcagatatcgttagggttttagatgagttccattttaacttacgaaaagtacagcacgtggtgggtcccgggaagcaggggagcatgattatggaattcatttaccttggaggttgtttagcttgaaaacagaagcagtgccacactatatagctaaatgcttttgggagccgctcccaagctctcaggacactgggtccttggagcaacacacacccactcatttggggatggctgataaatttcagatcctgaccccaaataatccaggtgtaggacttattgaccctgtgctgtgggtttttcagaaagaaaaagagaggagaaaccaaattccagggggctatgctttaacatgaagataatgatatatctcagtataaggttctgctagggcataagatgattatcaatgactaaaaattgttttaaattcataactccctgatatttatgtatttttaaatgaaaaaagataaataatatgatgtaagatataattattatggtaataagtcagatatatgcataggaaaaatactgcaaaatatatatcattaaacaatattaatagctcacatttattgagtgtttatgtaacaagaaaccggtaggaatgtaagcaatttcaatattattttaattatgttttattggtgcttcctaaatgatctgaaatcaatatgcataactttgcagtaaagaatgaaaaacaaaagtgaatgccctagcgggtcccacgtctcttcgttaactttaacaatgaacaggactggcatccacatcactgcaaacacagataagtaaaacgaataatcctccatcaaacatttggaatacatcttaggaaaagaggaaaagaaatttagagttccacttcctactcctattccacaatatttgagaaaatttcaagatatacagtcaaaagctgaagggttaatttatcatgatgttcggtttaaaaaaagtgaaaacttgaatacttccaaatagtttattggctttgaaaaccaaatcatgttatatcatactaaaaagattagaggttcaaaactttacagtgttgcattacattggcaagaatacatatacagctcagttcctacttttattgttaatagctttctaatcccttaccagaaatttatagtttagaaatggcaacacatcttaagattaaagccatgtgacaaatagttcatgttccttaataaccaaatctcatgccttagattggaccagcttatctgcttcttcctactgtacggtttcattggtaggaaatacttcatatccctattacatgaatgatgaatgggaccgttggttatggtctgttatttgcttggctgtagtcaatatgttttctttggacagggatttctgtgatttatctctctcccggccttatcacttattaactctgggtagacaggaaaaagccaaggttgtatataaggcctcgtggccatttagacctctaatgtcagtgaaaatatcccttttaatgatcctgttatactggctactcaagtcctgattacactccactccaaataggaaataaaggtcatatttcttggaaagtatatttgtaaaatatgcaaaataatatgcttccttcagatcagctttattctttgcagaaatggctctcattttatagctgtcacggaagtacaatggttactttcagtgacttttgttgttgttgttgttctcattatgacaccaacagtatttaactgtacaaatgccagcagattcagaatcactgatcacatcagcatacatctgatcagggaaaaatcatatgttgtggaacaaaaaaaaaaggagaggcttgggacctaccctttgtatcacaaaagcaaaaagaataaacactccctctgccttgaattcttttctttgtgtgtaaatggttcatttggagtaatatttaagacatgtggacaggagcagcctgtgaatttttctttcttgttgggtctattccaattaggacactgctaaggcagagctgctagtcaagtattcattacccagccctctttcagctgaatccctaagtgaaaacaatctgacaaaaaagaaaacacattcttgccttcctttctccaattctttctgagtttgcttaggcttgtctttataacaattaacatatgtatagaatattacgctatgcaaaatattttcatggccattttttcattgatattcacaagatccttgggatgcacagaaaagtgatggccctaccatcccttaagttgagggagacaaaaatctagcagctttaacccctctgtctccctcatccccacatctaacccatcaagtcctttccatttttcctcttaaattcctcttgattcctctcactccattccatctccactgattaccacccaaatcaaagtcaccaaatctctttcccagactactgcaatgacctcctaagaggccttccaagatacattctggtctcctatgcttcttgaagccagagttagtttgttcccaaaatgtaaacctggtcacgtccacctgtcatttcagacacttcaaaactgtccattgttcttaagataacaacaaaactcctccccatggcttataaagttttgcatacccttgtccctgactacttctcgcagccttctgtctcacagttctcctcctccctcttgattttccagcctcactgcaattcttacagccgtccaaggtaccgtgtttcctcccacccagggccttctcatttgctccctctgctggaaggctcattccctaaccccatgctacccccacccttcactggttgttgggttagctctttgtcatccttcaaacttcagcttgtgcaatttttcctgtagagaaatatctctaactgactggtcagggctcttttattatgtgctgatcaaaagcgctgtttctttctggacacgtaccaggtttgaaatagtaaacttatgaacacccattttccctcttagtctttagaataaagaaaacagggattgtgtctggttttgcttaacactgtttcaggacttggcctagaactggtttagaacattgcctagaataagacaggcaatccacaaacatttgtgaggtgaatgaatgaagtaacaaaaggaagtggtaaaatcagaacagaacacaggtatttttattcctattctaatgcctagaaagaaacaatgtctttactcataatcaaagctgacacatacataacatcaaactctaatgacaaattctttggattttcaaaaatatatatacccactatctgcttttctcacttacttttggggagcactcatactggaccaggtactctcaggattgcattacatacattaacccttttactccttagatgaaggtactattaaaatagctccattttacagataagaaaatgaaattcataatataagccaaatcccattttttcatttaaagaaactatgttctatgtatgtaaaacttcaagtagaaagggacagattcttaattaacagctcttatttacattccatgttatccagaggacaaaaatcaatgaagacccattgatcctgggcaatatgtcaatgatagcacctattgcaagtaaaatgctgagccaaatcccttcaacatagtgtataaaataagattgaggaagagtttctatttcttcatgaagcttgtggactttttatgatttgtctacctatgaacagaacaagagaactaaggacaaaaggaagtgaatgatgaatgggatggttttagcacctgggacaaaagagattcaaggacagagactctcccagtcaatcaagatgagttacagggagcaccaaagtcagtccgactgactcatttcacaatgaagagactggagtccagagcacataagcaacttgtctcacagctagcgagtagcaaggctgggatacgatgcaagcctcattgctatcagcccagggctctgtccactataccacagcggtcagagaacacttcagagaggtaagagtttgaactggatccttcaggtgaatcaccatgcccaaagtagctaaagtgagctggaggcacagcaaggaaactggtttgactggagcatcataagccctagccccagagcacagtgagccaaactcgggacttgggctacgtcttacatacagtgagcaaagagggaaggtttctctgcagggtaatgacatgaaagtggctattcagagcgtactgtgacaaagaatttatgtaagaaaagactaaagtgcaggagatccattaggtgcaaactctccacttcttccctaaaaccaatgactttgttcaagcccaaggtggcagcctttattttgtggaggaggtttccaagaatgagaaacagagatttctggtgaaaactctggaagctggagttgaagctgattataatctaaatacttttgaagacagttggtgataggctgtactcctgttgctaggacctccagaggaggggctgagatggaaataagagaacaagcatgtgttgttccctaaaaaagttaacaccagagaactttacaaatcaggagtatctgattaaaatattagctgtgtgatgcattcctgcaaaaatatttgttttaagcaaattattacatttacacttatgcatttctttttcttgctactttatttacactttgctccttttatttggggttgacaggtgttacttgtttctttaaactgatgcctatagttgtgttactaaaaatcccaaaagacatttcttagatttctagggagatgacaaggatgataaacaatccatggaaaatagttactcctggtagggactcagaaacaaaggaatgaatcataatggccaccatttattaatggaaactactagtatctagcctcatgctaaatacagttccatgattctaaaactttacatatgtttccctgatcctaaaaacaaccccagcaaggtattattattatttccttataaagataaggtgactgtggtttagaggcatcatatgatgtcccaaggataacctctctagtaaatggtagatctgagaattcaatctatatccatcatcttgaacctaagcagtcaatcagtatgcgaggtactatccccttaggagggagggaggaaaggatgaggggagtaaagaaaagagagaggaaggcgaaagggagataggagagatgggagagcaagaagaaaataagagggatagggagaaaaaacggaaaacttaaaagtcatagtaaaagatgtcaagttccacagagcatatgcagacaaaatagcccctcctatgtgcaaagcaacgtgttatgcattggcaaaggatgtggagttattctgggcacaaggtacaaacaggaagtatttccacgaagaattctcatttcgaagttagttcacaggctaatacacaggaatgtgggttagtccttccacaggaacaggaaattgggtgaaaaatgtttggaattggaaaagttagtggtagaaaagatctgataagtgacctaaccagacatctgagttgttagatgatcattcatcagggttttcaccaacttttggggggtcaggtggtgtacagctctcagggtacccctaggctgctcaaaccttgtcctggtgtcccattctttcagtcatatattccccgagaatatatgaaaattcttacagaaaatataactagaatgaaggcaacacatgcatttggaattggccgcttcttatcaggaaaaccaactacaaaaactttgaggaagcagctaaaggtgcctaagagtcttttattagcttccaaggctacttagggattagcaggagagatcacgattcgaaaagatccaagccacttaaagatgtaacacctgcaagaaaacaagctgtgagaataataaaggtattagggagagcccttacatggcagtgaggttatagtggatttaattcccactggactgaccagaaacgataatagggctttgaaatcaatcctgtgattagatagtgtttttgtttccttctcttagaaaacatttattgaaaattaaagtcagccttgccctacatttacataagaataactggacacaataaagtaagatctagaaagtgctattgagcttttctgcttctaatccagtcaggattcactttccagagtctgtgactctgattggacaaacacaagggcatggcacattagcagctatggattcctcgtgcgtctctggtctgaagaaccaatgagggagagatgtacgcttgcttaccatccttacaaggggagccagcttgcaggcaatctgtgcttggtcagattcttccctccccaaaaggtctgcctttattagtatagattaggccatgctgttcctgccttttttctttttttttaatgttatggacttttagagacatttacatctacaaatgccaactctctcttgcatactttaaaaacagcaataaggccttagtttggggtgttacttttcagctcaataatatttttcaagggaaaaattccaagtgatatttcactaacaaataagagggttagctcacccaatccagaaaaccaagcctcacatcttgaaatactatggatgttaaagaaaatgaagtgtgaacttctgtgggtggacaaaggagggggccgtacatttgcaatgatctgagcagttgtttggatacaaagaacagagaggttttatgagccatctctatacccttactattaagtggtgacagcagaggtaaactgagtaaatcacagaggccagtagccccagccatgaacaagcaacgcatggtagaggcatttaatgctaatgatcaaaaggtccatgtgtaggtcaccaatgaacacagattccctttcatcagaaatgatgtgatgtcacaataactgttaacagccaagtaactataccagaggggaaatcattgtgccaatttcttcagatttttatttttccgatatggggagaggttagaactctcttctagaatatttaaaaaaaaaaaaaaaggcttcttgtctggtgcccacagtttgaggccagatcaccagaagcattttttcataccttaaatttcccacagatgtatacatgtgcatatgcgccaacttattgctcttacccttaactacttttctaggcttgaaaatccaacacttttttcttaattccagtgtgatatagattttctaagatgtgatttcttaaactgatggcaatttttttttttagtgtttaaaaaaactccaaataatgatggatccctagctcttttctcttgagaacttaagtaatttaatgagggtgatttttttttctaacttttatggccaggtggctctaggggatattttgttgaagactgattaaaaataatttcttctaaatgagacctgaccacaaaatggaaccattaatgggcagggacgttgtcaccaaagcggaaaccatgcctgattgcctcctgtacctcccaccacacaagcattttcttctttttcttctccttttcttgttcttaatagctgagtaaataagcagccagcgaggcctaatgttttcggccaaaaacagagtccaaacttctcagagaaaacatttggcctctgtggttttgaaatatgttccagaacaccgagttcagtgggggaacattgtgaaaaactcccatccattggaatgatgctggggaatgttacagtatcagaagtttcaattggtccttttcctgcagccccataatgagacttgtaaaacacacacacacacacacacacacacacatgcacacagacacacacacacacacacacacacacacacacacacacacacacactgctatgtggaagttctcatgggaaaaatgaatggcaagaaatcctagctttaaaagaaacagctaatctgctagtttgattattcttcaaaacttacgctgaaccaatgagcctaattaaaaacacttggcctacttctataaagcatcatagctttctctacgcttcgtttgtatacaccacaaaactccagaaagactattattttttcaagtgctcactaacaaagtgctgactttgttgggatggctgagctaatttcttgaactcagtgtgaaaccttagctaaacaaaattgtggtaattttccttaatttgtaaaagtgattggagtgcaaacaaaattttcctcttgggtcaatcctataattttcagttaactaaaactaatcgtcaggcaggcaccaaacctgcattttgtttaaagggctgggaggcatttccaagggtcaggatgcattaattgtttttataatttcgagagagagagagagagagagaaactgggtgactaagaagtatgtttggttttacttctaatattgaaatacaagggaaagatgctctgaagtaaaatgtcacagaaaaataaaattcgtccacttaattgtatggttataattacaatttgttaactgttatcccttcactgctctgttatctctttgtgtgaaagcaacttccgctctgtacttaatctggtcttgtggtcttttactgaatggaaaaggaaacctgggactagttcgtggagacagctaccactatccaaggatgactgacactaagcagagggcccagaaccgcactccacctgtggttctttgagcagcagcatcagcctcacctgggattgcttaagaaacaggatctcaggttctacctagacctactgtagcagaatgtgaattgtaaaagatccctgggtatttggtttgcacttcacaatctagggatctcttagcgtacacattgggcactcagcctttatacttgatgtcattccacagagatgctgcctggttctctctgtctgatgggagggaattcacattcactctgaaaccctagcttcttgccgcaaggcggatccatgtgccaaggctgttttgggaggacaaaaatgcagcatacttggaaagaaggcaccaacccagaattaaatatgaaaactaccaattgtatgtaatacaagtgccgtgaacaggctagaggaaagacgtactgttcatgaaagcacaaacctactccataaagccaacaaaccctaacaaggtggcttaacatccagaaactcaggactagctacacctctttccccttctcttatttttcatgtggcatctttaggtatccaaccagttatttcaacagaacgcgccattcaacatggacacctagaagaattcttaatacaataataaaagcaccatgtttggtcatacatatggtaaaatgaagaaagaaagcaggctttaactagattttaaaataaaatacatgcttttatacagacaagataaggggaaagaccccacaagaccacggcagttctgtgctcaccatgtgctgtggttcttacctgtataaatgaatctgcctggtgttcctttgcagaactgcttagatttgtaggacagtgtgacttccacaacaccagggatgtgccgaggaggggtctgcacacggatggcatgaggagtgatcaactggaggagacatttggggggaaaaattgtcattgcaatagttaaaacttcacagtcttcctaatagctctccataaacaaagctttaaaacacataattaacctgtctatgtttaaatccaatcttgatggaacctgcgtgaaagacactgacaacaatatttacaaatgctctgagtacagccataacaatattatctgggttttcctacatggcaggccctctgcttcctggtttgaacagggaacctggcctaatgaaatgatttatctactacaggatatcctttggaaaatctctgaagcagacacccaaatcagagccgagctttgccgtgactctccagaagctgatgggcctggtgtttgaactgagcctgtcaacatgtggaaaacacagaggtagggaaacagcaggccaaggcactgtgattagctgcggagtgcacgtatgaagtacccctgaagaccatttggtgtattaactaccagaggcacaatcaaagagctttacaggggaaagcaaagaatctgcctccctggaatagcttatggatctagcagaactaaggactctccataaaagggaaagggaaagggaaggctggggaggctgcggaatgatcactggtccattatgcaatgccacgtgcacaatgagaaagttcatttctgaactctgttggcaatcagattacaccatgaagcagaatttattttgtattactcttatctttgtttacataactaaaatgttattaatggccataaaactggcattatctggttctttgaaaaatccagccctggtatttgactggttgacctctgatggtgctggattctacatgttctctttctatgggattctgcaattgtctactctttgactcctttcagatgcagttagctcaatatttgtggtattgagtccactgcatacagtggataatttatacagtatacatgagtttaaactaacatgcttgttctgttctcatggggataacttagaaagggctcttatatcaatgtgcaaaccaggcccagtttgagtgttttgcccagagaatcacagataacaccatgagaggctggatgcggccaatgggtccctgactggataaactgttctaacaccaagtcctagggaaaataatttgagaaagttgttattgctaaagcccacaagtaatttatatcaaatgttccttcttgaaacaagaaaaagtcatatctgcataaaaaccattttaacttagcaattacaaataccctgtattatatcttgtaatataaaaaagccctaaatgactgttgaggtatgaagaactatttatccctgtactaaatggctccaggtttctaagattttgaaattatttctcttttattccgcttctttgtctttttttttcctgttgttcttagcaccttctaatttgctcttgtaatctgtgagcatggaaatcaggaaatcgagtttaataatgtagagagaataagaagaaagaggctctgaagggcagtgaaagatgatcttccccaaatcaagagcatgttaattgttgagacactgttactgcaatgttgggaactaaaacttgtagagtacccaggaggtatctaccacattgctggatattttacatacaaacactaatttggtcagaacaatgactgtatttttatccttttttttttcaggtgagaaaacagaatcttaaaattaagttgttgcataagcaactttacccttgtcatagcaagtcagagcaaaaggcaacactgatgcagttcaaaaaagtcacgggacaaacacttcctttgtaatcatagagaaaaaaattgttcatatagaagctttttaaaggtagtaacaaactcagtttttttctgatccaaagactttgtgtgtgtgttttctgtacctatgctctctccatttttcatttattgcctggagctttgccatgcttttggtggtaaaggatgttccatgttgttatatttcaaatagaaggtatgcttctaattttaacacgtacttgggatatagagtaccattaactcacaataatactgataagaactttcagccagttagaaaacacttcacctgctctccttgttctcaggggaaataaattttaaaagatggaaagatattagtaaatagatggatgaagattctttttaagtatagggacttaatatgtatgagttgctataccgaggaacaaaattcacgggctttataaattgattagatatgactgcaataaaactacagactgagagtgaggctttagcataaagcattaggctcaggaaatgcaaacaaattttcatttacaatttcattttcaattttaattaattgccctaactaaagcagagattccttctaaacaacaatccttcacagatgaggtagaatctgaatcataatagagaataaatttgttgatgttttcctagctgtgaatattagtctgggaagaatctctagcattgacacatgatattgatgcttatggaggaaaaacattttagctaactttgatcaatttgaaagcacaggcttatttactaatcactcaaagaactgtagaatttattgctggaaggaatgctagtgatagtttaaagctaatcttcttattttgacagataaggacacaaaaatctagaaatgtctggtggctccgaaaattgacccaacatgctagaggagggacagggtctagatctagggtgtagaactccggacccacaaatcacaaaataaatttcacacattgttccagcctggttgaacccaaggcagccactcaaagcaacagaaggagggagggctagtctaaatttttcaaactttcatcattggaatatcactttcttagttttgtcatatctatataccacctatacaattacatacttaataatttaaaaagtgattatctttttatttaaaaaacttattttaaaagaaaactttatgtcactaccataattggaaaactgatatcaactgcaaaataagaaggtattgtagatattaatcttgaagttaatataaattatagctagatattgttgacaacctgaaggaatttattgaaaagggtgattagctagtgttaaatattaaagacttttttgccctgagactttatccctttaataaaaatcataattatggaataaaacaaagattaaaagagaaacaaaaggagtgatgaaaagagaaaccaaaaggagactaactttctcacagtgtgattcagttctatttcatgtctgtgtcaaatctaaaaatgtctcctgtactaccaaggacccatgccccattactttggtaaatactgttctaagtgattagagaacagattcattctttgacttaacttccttaaattacaagccaaacaatttgggctagaaataaatattcttctgaaactctgtagcatctgccactactctttcccttccttggaacactccattttcttatgagacaataatcataagacgtaagacttgcaaagtgtctgatggtttaccaaagcactttcatgttcactaattttttaaaatcatgtttgtggtttatgtatttcagatgagaaaagttgatggtcaggcaagttaatattatttaaaacacttggatgaaaaccaatctcttatacttataaagaagtattttccagatatcttctcttattcattgattcctgattattttggttttcttcatttgctccacttttctgtcaacttgttagttgtagaaatatcacaagttttgtcttctttttttttctctatttgcctagcacttcttgatttcactcattagctcagccacctcagctaaactgatttccaaatctacacttgtagacttgatctctttggctaagcatcaaattttattagcaacagagtaacagaatctccccaaataagtcttcttgccatctcaatctcaacatgacccaagctaaatttatcatcttactacctgtaaatatatttcttgtttctgtgtctcctgtctcagttaaaggaatgttagcctttgaattacccaaaacagaaaacttgagtttatcattatttctttttcttcctttatttttcttcagtcatattgattctgccccaaactgggccccactggctcttctctgcttcttctctttctcctgttcaggctgtcactgtttcttacactattacaacagtaggaaaaattgccttctaaatggtctccctctacttctactttttccaccataattatcttcttcaaatacaatctcatcatattatgccctgcctcaaaccaaaccctcagctgccccctttgcctattacatagttcaaactccttgacagaataatatttagggttcgccaaggcctgatggccagtttcccttcctaggcacacttcccactttgctttaccacatattggagtaaagggcatgtggatacacgaaaacaccattcccttgcccaacagttttgctttctccatgccattctttcctaaacattcttctactgacattctacttgttcttgaagaccccaatcatacgttccctcttccagtaagttttacctgatcctaagggtgaaagttgcctgcatttttgaggaatttatactgttatgatattgatactataatacttagcagcctattttgctttgtgccataaatagtgtcctatacatctttctctcattagatatttcctgagatcaggaacacagtctaattcacatttgcaacctctaaagtagttaacttggcctggtgtggtggctcacatctgtaatctcaacagtttgggacgctgaggcagaaggatcacttgagcccaggaatttgagaccagcctgagaaacaaagtaagaccctgtctctacaaaaaaaaaattttaattagccaggcatggcagcatgcgcctgtagtcccagctacttgggaggctgaagtgggaggattgcttgagcccaggaagtcgaggttgcagtaagtcgtgattgtgccactgctgtccagcctgggcaacagagcaagactgtctcagaaaaaataataaaataaaataaaataaaaaacaaattaagtagttaatgacttacatacaagatattttcaaaatatttctggaataaatatttacataaattaggccagaattctactaaatcattgactccactgggtatcataatcattatccatgagtccaggtgagtctactgttcttaacctgataatactcaactcttgttttctacctaagttgcttttaatgttagttatctgactagctcgacactcagatctcaatatgagcttgagaccactgcttgtatatcatgtaagtggtaaaaaagaaaaggatgtctaaatgtctgtaactccagtgagaaatgataagatgaaatgaaaaaaaaaaggtttaaaaattaatacttaaaaagtatgccacacaagatctttgctaaatggtaagagtgtttatttctggactgataacattcagtgtgatttgtcttctctgtctgcctcttcctcctatgtgtatgtatttctgtgtgtgtaaatgtcccaaacttgcactggatcatgtaaataattatggaataaacctatttgtacatataaagccattatttttattatgagaaaaatgttatttaaaaagtagaataacatcagtttggggcaatatgtattacatgtgattatataagaattagatgcgtatttgcacagaagaaaggaaaaacttcaaaatgttaatggaagttacctctagatggtagaggtatgggtaattttactttcttctgtatgcttctctgaattctccaactgctcaacaataaaaatgcattaatactatattcataagaaataatttttctatgtggcagtaagatgaaacacacataatctctgcaggcctccaggtgaggctgtcagcatgccagggacctgccggcagcaacacttctgctccctctaagctgcctgtgtgagcattttctcttctccagactcagaccacagaacctgaagaatcctgtgggggttagccaggcgagatatgcccactgtggcctctgggtacaaagtaaagccactgtggccatgacaagatggagccagacatgaaggtggttgaatggggcctctccttgacagaagagctgaaatcaggagagagaatgcatggtagttcatgcagctgtgcacgtagaactccaaagaggcagcctgcaaagtctggaagcccagaagagaggcagggaagaggacaatcttctacatgcgtattagacagcctcccatcatatcaaaagtatggcccacatggtaggtaaatgagagtatctagtgtttaaaaatatgagtggaagcatgttgtagaattccgcagcttttattatctatattgttctagttctcactaaattgatgatggtaatgaccttgataacgacttcaactataatgaccttttgttgtctttttcccatatgtcaagcgctatgttaaactctttcagtgatttacatcctgtagtattatggggtaggtatgattattagctggttcatagatgagaaaaataagtttcaggaaagttaagaaatatgatcaagaaaccaactggaagtggccagtcggcctgactaatgaccatcattatacaaccatgactatctgttcatatgactgttcattgtttttccataattcctggtacatgtactttgcatctgacctctgcctttgaaagcatggattgtatctgcagcttttcccataccttgaaatgaactgggaacatagtggccactcaaaacaactttcctcactggtgaaaggcaagctgagaatgattcccaaggaaaacaaaaaagcaattccaagataagcctttatccatgttttccaaccaataggagtaggtaaaataaatgcaagttgaagttgcaagccacaaagccaaaaaataactggggttactagaaagcacaccagcgatttctcattactaggtttaggacctaatattttaaccttaatcaccttcaacacttaaaagtaaagaaaaaaagtccaaaacaagcaaagactcaaagagaagggataaaaggaaggaaatgtttcttctctggaaaaataatgagcatttgtggctagaaaaagcctaaagtgggcactggcaaggtggtttttagatgttacccattgaagggtctgcgttctaaggcatgctagcccattcactcattgacaccctctgtgcctcagtttactaatcttatactgcaccagctcctatgtgctctgtggaggtgctgataataatattatacatgctttatgtttgggtagagcttctctggggaccctaaagcactttccagattaattttttaatttatgtattaataattctcacagcattctcccttctcctcagttaggataataatatccatctcttttgagataggcagggggtactgagtgatagacatgaagcagacacttaaataagaaaactgtaacataaaagcataattaaagctctagaaccaaatcaaactacggatttttaaagagataccaaggtgttagggaacaaacaggcaaacttgttttccctccactactctgaaacatgcatctttttggagttagacacggcatttaaaatatattattttcagggttgctaaaggaagctgaaatatgaaaagtatatattcttggcgactgtgctggctgaacctccatattatatctctatttccctgaagtggctaccacataaatcaggggatgccagctcttcttctgagttccttggtgtgttttggtttgttccctaatcagagttctctgggtttcataacacagattctttcattcccaagaattgcctgtctcaaaagcagtgtatgatttctcagagaacgtgagaaaaagccagaggaggcatttactgtttcacaaaaattctggtttccttttgtcctttcaagaaaataactttaaaccgatgtttaccaaaatatgctgagtcacatgaatccttaaagataaactttatgtatgaatgtcaaaggagacttttgaaattaaagtctcaggaattgagttaaatgggggacttaaaatctagcttttgaatagtcagtcatgttacttaacactgaaatttctctcaatatagatatcgacatagactcagatggatggtagagagatgtagatatgctttcctattcattgtccgtgtccccctaagtagaatatcagccccataaggatatgaccttggccttctttgtttttgctatgtttccagtgtttaacaaggccctggaactagtagtcactcaataaatacttgaacattgaatgaataaatatcgtgatgccattagccaccactaataattaagataaagattcactaaagtttcttatgaatctacaaaaaggaaataatcaacaccactccattcagaattctttttactaaaaaattcccaaacaaacaacaacaaaaaaaaaactttttactttccaccacaaacttcctggtatcctcattaagcattcacagaaatatactgcccagttctgaccaggcatctaaccaggtcccgaaatcaatgcagttaattgtacaaaacaaaatggcaacaagatcatctttcaaaataacagatttgggagaaaaaagactgaagtaaatacattatgcttccactacctctggttttgtgggttatttatttatttattttgtaatttattttttaaataaactttctccagctctcttcccaggatgtagatcttgtgccagttgggccccattaaagactggatcccatcctgaccatctgggagctggaaaagcaagggtgagttcctgaggcccagggtattccagaaggagagcatcagacaccagcaacgccagcccctgtggtttgaggctgcacaatgagctctttctcaaggcttgtttttctaaattcagtcaagaaggaacatcattccctactcaggcctggctcagtgtcctatgttccttgcttgtttgtttgaaaattaaaatataaaaggaaaaggaaatcagaatgcatttatggaaggggatgaatgcttgttatcaacattggcaattcacatggcagaatctttgcctatggaattagtaaagaaaaatataaaagccaaaagactgataaagtagtcagggaataaattcacctttcaccaaaagacttgtagagtctctccaagcttaaaaacaaacaaaaaaagatgtcaaagctttacgatacagagactcactctaacattttttgtggtgtttgtcatatctagatatgatatacattgatactagcacatgcaaccagtaattcctcacttaacgtgttcattcaggaactcagagatgtaataaaagtaagcactacaaaaaactgaagccaaaccccttttaataatgtggctgtacaactgcttctgctgaaagtctttcaaggttgccttatatatatcctgctgttttaaatagaatatactaaatataattgccagctcttttttgattactcagggccactgtcattaatgagctgcacagtaatatagttctgtgtttgctttttcggctttccatttcttccctagacatcaggccatcagctgtcactgagcctgtatccaatagcctgcctccacacatgatcttcctctagtttgggcctcctaatttgctgtgacctaggaaaacagataacatagtttgttaagaagtattgttctcattaacccaaagctttttattttatttacttttttggcttgcttctggtttcatgctgaattttagggagttgagattattataacacatctctggataaatgaattttattacattcatattagatagttaagagatagctatggagtcaggtggactttgattcaaatccaagccttgtcaataatcagctgtgggacctttggaaagtcactcaacctctgtgaccttcagtttccttattggggaaagggggagagagtaggatgggacttgttatctgatagtttattacaaggattaattgacacaattcctgtaacaagtgtaggaaaaggcatcacttgtatcaatcagtcaacacgtgttacttctattactactcaatcttcaccatcaccaatagatttacattaagacatttatgtgcatacttattacacaacaattatatctaaatataaactacctacccatacatgcattagcaaaacctggaccacaatctgtctagtactgacactttcaagcattgtcaactacaacagttgctattagggagcatttgtttgactgaatgaatgaatgaatgaaaggggaaatagtgtcattcaacaaattttcactaatgcctcagaagtgcaaagctctgtgctgggcatcacagaaaattaagctgtatttatcctggatcctgcattcaaggaagagggaatgcccttaaatcaggataattaaagatggaaaggtataaggaacacagtatggtagaaataaggcaacataagaatttagacagaagagaaaatattctatacctggagtcatatgggaagattccagagaaaaaggtggtattttacaggatcttaaagggcagagggatatgggcacagaaaggagggaaaaggatcccatggagagcaatggcaccagcaagacagggagaaaagttactgcaggtacaaggagcagctaacaagtcaatggaatagaacataaattaaaatgaatgttggttgaggatgttgaaaagaaaggttggagtcaaggtggtgtgcttgaatcccaaagaagttgtggctttagaaaagagaaagccagtaaaggttgtataaggtagaaggctttatttagttcagggtatcagggagccaacctagtgatcagcaatcagcaagaaaggaatacagcactatctagatatccataaatattcattttcttcataaaagtcacatgactgcagccaggtgtgaattctgtcattgattcatatgaaaattagaaattcatcacacttctgtggttcctattttcaagttacagacacgtgtacctcctgaacacgctgtaaataatgagctgaaaatgtcatcttaaagtctttttttaactatttcataattatcaacatagaaaatagatttcaagtgcctcagtcatcaaaaataacaatatagactaaggcttcttaggaataaagtgagcatggctgtaactatgtaactatattaaaaaggccattagaccatttttatctgttttttttttaatatgctggctcatttagaaatgatttctcataaaattacttgggcttgaaagttgttcttcaaagtcatattcaaagtttaatgcaactaatccagactgcttttaaatttgttaacaaataaagtttataattttgcacaaagcaacttctatataatagatggtcaataagcacaggttaaatataggacatgaaacatatttagaaaaaaataggcaactaggagttattttaaatccacacatttaatcaactttgaattaaatttatacatgtaagcctcaatatatgtaaaataaatggacacaactatttacattgtattacatttctatcatgacattttgaaagaggtaatatttgacataatgtctttctccgtcttaattttcttttttattttagtggagctgtatctcacataaaaggtggtatagataagtcttcagagtgttagggcaattatgtataaaatttaggaaggtttggtaaatttctggaagtatgttaaaagcccatggaaatttcatgagaaaatctggtataaccaaaagctgaatgggggtgaagctggatgtcaagagaactgggctctgagcccagcattaagtagataatatgctcccaggacaagccaccctaccactgtgaagtctctttttcctcacaaaataagaaactatacttgactgaaaaaaggtttctcaaggcccttaaaatgtggtgactctacatgtggttcagtaagagtcaaggccgggcaaaaaggcctgggaaacttccggtggaatacctgtatgcatcttagtcaaccactcttgaatatcatagggaagccaatcctcttgtttattgacaatcattcctctgagctatgtgtacaaaggagaatggaaagtagagatagataggaagaaagaaagaaatgaaggactgcatttaccacttggttttccaattttttgatttaagtggcaaaattgcttctgagcccctaaaccaccatttacccaactatattcactcacaggtctcccccagaggtttcttttgacttcatgccccgtgtctgggaatgtagctgaagaaagcatgcatctggataaagacaacgaggagaacctgtgtgagactaattgcttcacacacgaggaaactttggcttcatccatctgagctaagtggtactggcaatctttaaatatagctgccctacaaaatcatatagcatctaatgccaagtgtgtactgactaaaaccagatgcaaaatatgagggaaattttgttcaaagccttgcagcattggagaataatggctctaaacattcctggtctaatctgaatgatattctgcaaatatttaagatggttttctcacatctatcccagtccaaccactttgtgattgaatttcatgacttggctccattaacatgaaatcaaaatgcacttcagccatcaccaatatatctccctgtaaggtgatccttggggaaaaaaaaaagagttctgccttcacaaaagtttgggacatgctgaatactgcatctaagtatttgcggtgcatgctagtacctcaaacgttgtgcaaagccctagaagaaagaccagcagaatttgactcagcatttcccaaacttaccaggaaaaacctccctctctcatctcccaatgggtatctattaatatcctgaagaactagtcttccataacattatctagaagacgaattaggccaacactgtggcgtaagtctcagatttatatcagataccagaatctgaagcatagagagtaaaaatattgactaaagacctatcaatagggagatgcagttttgtggccaattaaattgttttgatgaagtttaaataattcttttgcaaatcaacatcacatctgtgtattgcaagtgtgctctgaaagaaaagaacaatagtggaagaaaaggagcagtttccacctgccaccactgtccccttctgactgtgggaggattctcaggggaataaactctaaaaggaatcactaggctgggtgcagtcactcatgcctgtaatccaagcacttcgggaggctgaggcgggcagatcacgatgtcaggagtttgagaccagcctggccaacacggcaaaaccccgtctctactaaaaatacaaagattagctgggtgtggtggcacgcacctgtagtcccagctacttgggaggctgaggcaggagaatcgcttgaacctgggaagtggaggttgcagtgggctgagaccatgccactgcactccagcctgagcaacagagcaagattccatctcaaaaaaaaaaaaaaaaaaaggaattgctagaattgtagcactgatttcaaagaggatatagactaagtctttcattttcagatgagaaactgaggtccagcgaccaacaatgactaaatctatatcctctgattgggcaatggaaggacaatcaatacccaagtctctcaattggttccttatccactgctaccccatgcaatctcaacccttgcagcctggaatattattctctgctccccacgaaacccaccattgtacttttttttttaattgacagcttaaatactctaaattgtataaattctgtgataaaataaaagggtcatgagagcctaacatacctaacacagagctacatccatatgtaagaggaacttgattggtcattcaaaccatctacttctgactacaccactctctctgctttccagaacttagcgtgaattgtaaactaccaatttaatactagattatataaatatattatgtaactctctaatttgctgcatggaagcaagttgtctttccaaataaaacaccagatcccacaaagcccaactttaattacccatggtacctatcccagtgctagacacccagcaggcaagccaaccagtgctcactctttagaaattggaggaattcagaggagatattaaactaacaattagttctgcacaccagaagcaggagcccctccctgctccaaatcacatgttggtagaaaagcaaaacaaccaagtgcggctctggtcaagaaaaataatctcaccccacattaaacatcacacatcaaccctgctagttttcctagatttgtatataaaatactaaaacaattttttaaaagacttttagagtaggacagggcaaggagcacaagaataagagtaaaataatttactttctaaaaagagggagaggagaaatcgcaagaaacaataaagaaagaggaagggggcaaatcaaattcacaagaacgccatgtgaacttgggagctcgcagaaggcagagctgagttaggagcaataaagtgcccctttcttcttcccacccctcagggggtgatccatgagctaaactgaactactcattggcagaagattggattggtagggaaagagcacagattagagtctgttaagccagcctgattttctctggctctttaaaaaattctttagctaaaaaaagactctaaataatggcattagctgctaatctaaaatgttatccacttgtcctagcctgccagcctgcttcctgggtgtgttgggtatagagtaaggaaatgcagaagtgataaaagtctacttaaaattagaaggcctggatcttagacatggcacaaacctcaagatcatgtggtctggggcaaagactttggatggacagggatccagctctagagatgaggctaaacaggtgaactgtcttgccctagcgtaggcatgtatcctttacttcataaagataaattctacctagaatccagtggtgccgatcacaaacatatacaactggaagatgaagggaagccctcttacctctctgagtctgtacatgccaattctacctgaccttggaaggtaacagcaactgttaaggcacccccagcacaagacatcatggcaatgtgagcctatcaccctgatctgataacaccctatgataaaaatggtggcacaggctaaattatgaaagttaagaaggtaagccctggggttggactgtttgggttcaagtcccatctctctaccacttggcaactgaaccacttacttatttaacttccccaagcttcaatttcctcatcagtaaaatgagaacaacatcatacgcagtggtgagaatcccacaagagcactaccaaacatttatcatattgcctggcaggaactaagtgctcagtgaatgaatgttagctaatattagtcacactctgcattttctgtagctttttcttagatgtcttctgatcaaattctgattctgtacaatgcaagccttgacaaatggcctcaaacttggttaatatttttctgcttctacaaaaataaaaggcactcatgtaattttattcgattaaaaacaaccatcatcactactacaattactattactactttctactactataccacctggcttatgaaacctcattttttttctttctttcctctttctgtcattcttccctctctcaagattgcatgtgctctcttattaactaggacttttccttcctttataaaaaaaatatggtatagttcaaatccagtctctagtcctatctggctgtgtaaccttgggcaagctttttaacctctctgaaactcagtttactcatatgtaaaattagaataacaggagtattgcatacaagcctattgtgaggcttaaagtaatacccataaagtgcctacacatgatgaacccttagcaagtctgagctatttctccattcccaccattatacaatggatttctttatttggggcagtatcaaattctctccctgcatgaaaaggcagagaaaattgtgtgtgccaagtagcctgtacgaaaacctaaatatagaaatagtttagaatattacaaaaaagggttcacttctacaaggatcattcttctgaacatcaggacaatcatgatgataacagcccaatttaaagtcctacatccaggtacccaactgctaatgcagttggatttgcttgttttaaaagaagatctgcacaaatattttgggaaacagtttgcaccaggacagggtcatagttgatttatgacatagctacaaccaagagcagcacgaaagcaggggctggacaatgaaggagcatgcatcctccaccctcagctcctggctggacccaccctgacccctgggacagagtgaagaggggctcctggcacacacaaggcagtggcactggagggacagaggagggaggaggacaaagatattacattaatgggttttccttcctatgactttcatcaattttgttatatagaaacagatcctttaaagcaatttggataaatccaagttacatgctaacctccctttgctgttcccaaaacaggtcaagaaagtaggaaagtgagaaaaaatggagggaccttgattaagcgtaaggcagaggtgcaaatgcatgatttcctgatgtgtccttattccatattcaatggagtccacttgggttaagaaggcacaaggttttacaggaagcttcagactaacccacctccttctcaaagggtcagtaatttttaatgccaattttgagctccactttgactacaatgacatgaaacaaggagtccgtattatatttactcttcccatctctcaacttccttgataagcaacagaaagaaagatggaaaaggtagaagatacagcccacaagacctgggacagtctgtcctcatgaggactgctgtctccagcaggaggaagacagcaggctggcagcaaaacatgccatgaatttgatgcttctaatttacaacccaatagtttcaacaaaacatagagtacagttggcaaggggaagttactccacctttcatacctgaaatgttccatcttgcctaaaaattagttgagtgggctgggaagctcatctctgatttggctttatgagaactttgattctacgaccaaatgcataccccttgtttgctgagtagaaaataccaaggcagcagcagcacaagctagcaaggggcctgcctgagtgggttactggcagtaagcagtatacacagaaggcttacaaagaacagcgtctgttctggaaagacaaacatacccaagtatcacagtcttaactttctgctcatctgcatggcccctctagagagaaaacaacacaaagaaataggctaaaccagtgtcacgggagcacagctagaaatggaaatctttgtgtggccatatacaaatcacttacattctataggctttgggcagctgctctctggctatgtaactatttgtcttggagcttcactatccttatcaagaaaagaaatatgctacgagtatctacctcgtagtgtagaaagaagggtgagatgatctacctcaaggtttagcacattgcctagcatatggtaagtctcagtaagttaggatgactacatgcttacaaagcaaatggggtgaatgaaccctatggtaccttgtaaccctaacattgtttttattctaaactttagtgaagtgaaagagagagtgctcggagcatgctggctaagaaactggggctcagaactgagaacacaatggcagatttgccacggcatctatataacgggatgcatgttttgtaatcttgagctgatgctgatggttgccagacaagtcaactggtaggttaaaagaacaatcacagtgcttggacagtactgcacaattagaacatagtcattttcatggggttgcagtcacacactgagatgcttgagagctgtaaattcctagagctagaaaaagccctttgtggttctaggttctcccagcaaatcactctgtctgatgaatagtcaccaaataagtcaagaaccacctacacctggattatgctgccattgaatgatgttccttgaagatcaggctaccgtagactctttctgcaaaatagtcacagattacacccttgctaaaacttgaatgggctttttctatacatcttgtgactttgcatctcctcttcaattcccaacatacaataggacctccacaccatggcaagcccaagaagacaaactgcaaaacagaagctctcccattgcttatgggccaaagaaaggaagtcattccagtagtaactgttgcctcctggtaaacccaaaccaactcttctagtttccccaaattctgtagactgaagctggcccacccagagcggcaccactagagtctacacattctattagaaattcaagtatagacagtatcttcaactagatcaagctattagatattaatgttcagacaacacctacctcactccagaccagcatggtaccgaatatgacctgtaacccatcaaagaaattgtcccctatgatgatcacagtcgcacctcccgtcgtccatccttcactcgggctgatggctttgatacagggagtagctgcttttcaacacacatgaaaaagagaaggagtctgctgttagaaccaaactttaatgatgaagacttgagaaaaaggaaaaaaaaaatcttttatcttttcactaacagaaagtccctcaagatctcagcatttcccagccacattaggacctgaaacttcagggtgcaacttcagtttttaaaagcattcttttcattgtttctattaagatacatatattttacccaaatctttatcaaacctgaaactttatgaaataaaacacaaagcaaattttaatttgtgaaatgctaaggatttttttcttattaaatatgggtgactttctggaatatattggaaaccttacagaattgcttcatagttaaatatatctcctgaaaagaaaacttacgtttttttagataaacattaccatccaataggaaactaagaaagagaggagcctggagcgggaaatgattcttgctccatgccttctgtctgaaacactaacattgcaacatgtctcattaaaaatcattacgattttttttcaaataaatgtcatagatcccattttacagatgtgaagaatgcaggtcactcggggtgaattatgtaaccaaatagctgagtcagggctcaaccacagagttttccatgacctttgctttgctgtctttcccaggcataaaaccctagaattgactttttcaaaatttcatatctcttttctttccattataaatggcccttggagatgggaaataatttgcaaatactgtgattccaaatagactggaggtggtttgtttaatgagcatggcatactttcaacagaattgctgggcataaatgtaattcttggattgtttttaaaatctctcagggtgcaccttcgtgccactgagggtttttaactctacagtgtcatgcttctgttctcatgattatttttatgaacaacaagaaagcaacatcctaaagggagatattgttcaaggagagaaaatgggaccctcatctttaataaaaagtttattaagtatccaagactgactttctgagcattgaagccaatgagagcactagttaattttaacgggaaaaaactggcaaaaaaatatttggactttgtcaaatttggcaaaatgtcatgctttaacttttgcaagaaggaaagaaaatattaagtccagcccggtgggaccattgctcacgtgccaccacacaaacaaatagaatgggtttgattttgattcaaattaatcttaaaaatttgcacagagaaatttggaaatatccaaactaaacatttcatgttggctgaactcatagcaatgcatttacaactaaaactgggcagttcagatgacttttctcttctctactttctcccaaaaacaaaataattaatcaagaagatgtaaatgattcgtgacttgacatttcttgtctgattttttaacatacatagaggttgtgatcagtgttccacaactatagggctttttcttaaacaaaagtgacctttaaaagtaaaaaatgtttaaatgcatgattaagtactcccaaaccagtggtaccatatgatgtatgatttgaagcaagttataagagaaataaactatatttaacaactacataaagttctaaaaatatatgcagtttggaaacattttgttaatgtccccaaatatcaattcttaatttataactcagtctacttagttgctagaatggagtacaaaaggtgttatgatatccctagtacttctgagaagaacaggttattggtttaactgaattggtcttgagagtcctgactgagtcaaactgtggaatccaatggggtcattaattgctgaccctgagattacccacacagatcacaaaatggtctttgtgtttattatcagttttagctttggaatttctgttaatttttatttttttaatcacacacacatatttctttagctaaatacggtctcctgcaggctttctcatcattgcacaaagggaggtggaagggggtgtttctgtgtctttgagaaaccctcctacaggaaaggccttaaaatagcatggccaagacctgctggttttgaacttgaccccttccctcttttttcccacttgttatacgtaggatacagaagtcacgtgggtgtacatgcatgcgtgtgtatgtgctttcaaacacttcccaaggaaagttgcaatgttttcaaatactgtgagcaattttccagaagcaaagctatatgtcaatgcctcagaggcaagaaagagcatcaagcttccagagataaccaggtgaggaaacaatatttgacaccattgtcttagttttagagaaataaagccttaaaggaagtaccccaggaagaatgacacacccctcagtccctcctacctctacactcagcaccatccaccatccctgcttcgagactatatgccattcttagagcaggtaagtcattcagacctttctaagtttagacctctaagggttccaaagctcctcctatacatctgttataacatattagtcttgaggggaagctctgtgacacctccccactgacaaatttcaaaaatatgtaaaggaatcatgagctatcccagagagagaggatgaggaggggaagctagtagtatttagtaactggaggtcaaactgggtatagtggctcacacctgtaaacccagcactttgggaagccaaggtgaaaggatctcttgtggtcaagagttcaagactggcccaggcaacacagtaagactctgtctcttgaaaggttttttaaaaactagccaggtgcaagcctgtcatactagctactggggaggctgaggcagaaggattgcttgagcccaggagttcaaggctgcagtgagctatgactgcaccactgtactccagacagagtgagactctgtctcttaaaataaataaataaattaattaattaaattaaattaaagaatgctaagtatccaacaatgcatgaatgcatgggatagtccccataaatgaagaaccccaacatgtcaataatgcaatgtagaaaaccctgtgaccagcaaaagagaatcaggcccaagagctattgttaagaattcacagacccatgtagaccaaggcaagacatacaaacgaatgcagcagctcaggatctcagaacaagcatgagattaatggccactgtttctcaacatctgtaatgcaacgggaaggtgctggtgaattgcacgtgccccagggaaaggtgacagcactgctcagcttcagcctttggtgaccccataaaaatgcaggcctagcatcgtctgggtttctggtgatctttccaaagaagccaggaagccacatttttatgtcaaatttttcaatctttcaatgttggaaacgaattcagtatttttttaatgcgtaggccaaacaaaatgtttgtgggctggctttaactcacaggctgctattttacattttaaccctactcacaacacaactgccaggctaaaagaagacctggaaatacttgcaattgtggctaaaactataggtacccaaatgttcattgcggtattgacagcaaaaaattcagatgtctaggtgctcccagtagggggtggttaaagaaattatggtatattcacacgatagaatactaggagtgtcattaaaatacacaaaacaattctataaactgatatggaaagatttcaaaataggttagcaggtgaaaaaaacaatttgcaaactaaaggacagtgtaattaagttgatttttaaatgatatatatgaacctgtatatgaaccagtatgagtatgcatgcagttatatgtgaacaagtatgatggacaaaggcctggaaggaaggatatgtataactgtccccagcaggtccttataaaaagaactagactggggttgacagaaaaggaggactattaacatttattccctatatatttgtatgatttaaattttttcaatgtgtacaaataaggtactatgtaataataatttaaaaaattaagtagcagcagaacatttaattctatgagagcaaacagttgtactttttagagcaaaattacattttaaaaaaggaaaataaaacaaacaaaacagctgcgctgaccctgagcctccccttctctcctcattttggatatgttttctctgagaaagctcagacaacatgcaaagcagccaaggacttgtttcttacatttgggatacccagagagaaacagaggggagacagggaaaaatcacttttaatagtcacagtggatggattcagtggaatttgactgtgaaaagatttatgaaagagttcaattcagcacagggatgtgataatcaatacaagtctatctccaagcaaatattatggaatgtgggggcggtgtttgaatacaaaaccacttttaccagcaaatttttgatttaattaatacaagattctttcttcctctccaatgaattttcacactcataagtatccgcaaggccagtgacccaatttctggttttaaatctcattaaaaataaaagtttagggttagggggtggggtttgcctctttttttaaatcccttcccccacccctcaccagccacgaaagtagaggagattttccttccttcaaactatgacaataacatgattaccctaccacagtttagcataatggctctgaaatgctcatggcacattgcagagttaaaatggaaattattaggtagctcttctttgttataataatgatcactccacaaataaaagctcttctcccaaaggtactgcaaggcacaaaatgctaattctgaagattatgtgtgtgcttttattaaatattactatgccctgcctgtttgagggcttctctgctctgattgttttatgagtaccatgttaatgtcattcccatcttgctagcagcaggcacacattttagcgtttgtatgagagttgatcaaaggccacgtgctgggggaattgctgagaaaacacggacaagcgataaaaatctaacagattaattggtttaaatttcatttcagggtgttgaactttggctcaggactctaatactacaccgtgagtcagggcctaattaccagatttccaatttgcttcttgaacaatggtcatggtgagaaggaaaagagagggaagaattaaaaaaaaaaaaaaaagaaagaaagaaatcgttcagctccagtacgtatttaacaactaatgttctgtgtgcagacaactgcaccaggggacatttgctatcacctactctatctcccgagcatttatatttccttcgaacagccacagaaggcagaagaaatcagagatgccctcggtagtttaaaattttctgatttacagaataagtgttacatgattcaagtgcctgcacactcgcactgggagcatcagtctctttattagcaaggtgaatttataagctggaatcgcacttcagcctccaatagaaatgatctatttctttgatagaaagcaagggccaggagagccatgtttacctcgggttttatgggtagccttgggaataagggttaattgagctcagaggtgcctgcccattgaggtgaattagtggtgtgtgcagctatcagcagggccctagggctgctcttatttttccttctgaaatctctctgtgctgtgatcaatacctcacttgtttggggtagccatatagatgacccaggttcagcatttatcatatcttatccccaaaatgaggcatttgtgacaatcgatgtgacattatgaaagcctaattagagatatattgtttggcttttttctccattcctgtatctaaatacactggagaaacaacactctgtgagttgataaaatgtacaaatttagaaattttctaatctaaatctaaatctaaatctcaaggtgatataaggttcttttccattcccattacatatggtgtaggaaaacgtgcacactctccttttccagaattctattaaccagaactctctattagtgagcatttctacaaagcagaccactgatgcttacagtggaggtgaaaatactggcactagcctttactggcttctgagtaaagacagaaatatgaaattatgttaagttgattttaacatttggagtatgactgtatttgaaaatgggcaagagctccagttgttcaaattccacatctagcacctagtgcaaccttgaaacagtctcttaccttctttaagttgtagtttccataagggcactcacctcacagagttccagcaaaatacacagaaaatgcctacttgtgttttgttgctttactatgcaccacatagtatgctagttgctgctataataattaccatcagctccccattaactagagtttatttacgagaataccctatactctcatcagttcagattatgtattttattgtaagactttcctaagaactcccagttcagctgcttgctaacatatccaactaaatgtactgagtaggtggaactggcaacagtccctccaaagtagaatgtttttttaaggatctcatttgcctggaatgaatattaatgggaaacttttcagaaatgaggaatcgactttaatgttattgtcccaaatttttgagacttggcagaaaacataaaacccatgagctcagctcatttctacgggatacttgtgacctcgtaaaactcatgcttttctcccttttatctccttaattttggtgatgttgtacttgggagaaacggagagactattgagggcacaaaatattccacttggactcagcgcacagatatctcttcctcctgctcgatctgaatgcttgtttttgctggtgttttttttttttttttttcagtgaatgatgaccttcctgctcacagctccttagcactacaacctgccttctttgatcctgaaactagcagctactggacaggcaagaggacaaacagaaggttttcttccagctggaagactggacctctgtattttcaccatgcacaggaggcaaatctattctttgtttatccattctccaactggatgctttagaaaccagaagcaattagaatgcctgacctgaaccatggtaccagagtatgcaaacttcactttcagaatgctaactccaaataaacaaataaactcagccaataaacaaacaaacaaatttgacagtttcctcatgcaaggtgtagcagcctttataacacttatgctgttgctttaacttgtgttactagggatttgtttctgccttactttattttcttcagtaattgcattatgcagttaagcattttattgtttattagggtttttatttcattttgttatttgtctgcatttattgtcctgtccactagcatatctagataatacttggcaaagattcatgtattatatatgaaaaagagtcgtgtgtgtgtctgtgtgtgtgtgtgtgtgtgtgtgtgtgtgtgatgtttgtcactttaaggagaaatgtaacccatgatacagagatctctccatactagatgcaattaaacctattaaatattaaatgaggagattgagaatttcaagtgattttcatcctttattccaaagtgacttcatttggcaagaatgccctttgctttgacagcattaatggctctcgcagaaaagaagaaaaggaaaaattcacaggcactatttggaaatgtagctccaatgtccatctacattaaggcagtgttagcttagtggtgaatatctagatgtacctaaacttagcaaaatagtgtctaagttccaatttatgccatttgctaattatagactaagcccaaattatattctcttcctattttgcagctttcttattttattctgaattagcaaaatttttcaacaatcaatggacatagcacctgagcaagggaaggacaaaaatgctggtgcaacaactgtaatccaaaacattccagggcaagcgcttttggattcctgagtttgtctgtcggagatctggaactgtgtgcaggttcattacacggggttatttgacaatttagcagtaagaaatcttgacattttgatgtacctgtaacttctaaattgcacttgaaagacttgttgaaggctttttgatttaatgacacacaacatagcattgtttcataatatgcaaaaattgtttgttaactacactgcagctcagaattttataactcaaggtgtgactacactgttttccacctcatgtttgatctgccaaatccaaaattaaaatgtacaaaatattaatcctagagcagccaaaggcaaatattgtcatcagttctttgggtttctttcccacctcttattctatgactgtcagtcactccattgcaaagcaatggggaaaaattgtcatggagggtaagagaattttcaaaatgaattattcatggatccaattgtgatatttgttgcaacaatagtacattcacgtgcctctgattatacaataagtaaataactctcttcatcctgacaaggagaacttttatgcacaaaattatttttagtccaattctccttattgtcctgttgtaagaaaagtttgggaaatgaaagccaaggggaaaaaaggaaatgaaaataaccttccaaaaatggacacccaatattgtgaaaaggggaaacaattttcaggttaaaaaaatatgcaactgcttcttcaaggactatttaagtctttattcacaagcagtcttcctgggcctggaaaatcataaagccaaatatgagcaagtctagtggaaaatctgtgacgctaatcttggctggagtcgtatttttaacaggccttgaatgtgtgtgccggattatccagatggccatacaggaatcggcctgataggattaaacctttatgctgaactctgctccatctgttcgccaaggtttgcctttccttatctgaatatgaatttttagcctccttatgtctggaggcaggaccaaattcagcaataaaaacatagatgcgtgcagataatttagcatttcattagttactctcagttcatattaccttggtctttttctaggaaatgtttttgctatgaattttgctaagaagaaattttaaaacatgtagaatctacttttttgttagagggttttgtctttctcttcctattgaattctaggaatcattcaattcactattgtaataggagtttacgttgatgtttgcccacaaagataaaaaagatatggtatcctcttagcagaatttgactgtaagattagatgatgtataattccaattggatgaatgatccaagcagaagatagtcacatgtgttttcttctttttttttctattacaagaggatcggtaatagtcatcacttaacaaaattagctacaacactgtttctatcattttcattaagatttctatgttttaaggaggcatgtttttttttgctggggcaggggtatgggtgtgggagcagaagctataatttgagcttaaactggagtgaaaaaagcagacatctgttttgtcctccatgtatatatccctagaagcagtgaagtcatttattgatcaactggaaaagttggcttatggcaggcaggtttcaggaaaaaggccagtgggttgccattaagccagagcttggtagatggctctgggtttcaactctatgacaaagacaaatggagggctctgactaccaggcacggtggagagggccagtgacaagtttcccaggcaaacaaggtgcgaacgaaagaaaaagttgcatgagagagggatcttttagaatcctacttgtgagctggtttatagcaacatgatcattagatgtgctcagtgtgttcacgatggaaatctcaagagatggcagcctgtgtgcccttggccctaagaagagaggatccctccagcagtctagcaggattccacaggcttccttctcacagtaccctcactcaccctggctcttggctctatgctgtcgtgaatgtgggagtcaagcagctcatcaaataatgtaggcttttccactcacaagtacagttattatacttaagtagtacccttaactgaacatttaggggacagagaacagtcagacttcctatttaagcttaagatgacttacacttattgctatgaatgtgcacataaacattttgtaaaacacatgtcttaggctcctgaaattgacaacaattctagccaggtagtggttcccactttggaagtagatgcccctaggtgatgaagcctattataagtcatctcttgtaagatgggcaagttcacacacacaaccctactgtctatcttccacattctatcctaaatgaggacagctgactggatgtttgatcccattactcaatctgcttttgctttgcccattacagtagccactagctacacgcagctatttacatttaattttcaattaattaatatgaaatacaaattatttcctcagtcataccagccacatttcaagtagtcaatagttatagtggctagtagctatcatattggacagcacagagataggacacttccatcatcacaggaagttcaattggataccgctgatctcaggatcaagttttcataactcagcctataactgataaagactaatcagagctacaatatagggggtgccctccatagactaggaactgtgctaggaacaacgattaatctccaatccctccaatgaggagcacaaaatcaaatgctcacagggctaggcaggaaggtaagtcaatgaaatgggatgaggagatgcaatgggattggtggggattgtggctaaatgtagagtatgtgcttcatccaaaaggaagatgatttctgagttttccctacccgttgccatttgagaatgtggatccagcactaccagctcttctgattataaaagacattagtaaatccaggttttcatataatctctctatcttcaattgccagcaactaatacataatttctgaaggtgccatgcaacccaaacataaatatggctgaaggctggattcagttcatgatctaccactgtgcaacttatataaatcctcagagggctcagagtcatcttttactgattattaatttctgcaatcattgaactaatactgtcactgacttaccaaacaataaacataatcatggccaattctgctcctgatctttacgtcttctcccaaaacacacggaagtcccccagttggcctttctttgctatgcagaagattttctatacgcagtttgagagatgagctcctgttcctgaaggatttttattgtcatgcaagacagcatagatagtgactttttaagaaaaccatgttttgaatgtgagcagcattttgaaaccaaccttgcccaacctttaataatgcacaagtcctgctttgtgcttttcggaatagttctgcttatatttctctccacaaccgaggctgccattgctaacatatttcagtgaactttcattattcagagccttatcattttgagccagtttcctctcctccctgacacatttagtgacactgcaatccagcgtttgttacagcacagatgtttccgtggtgatgatctgtgatgtcataagcacaggaatatgtatcattgactttgcccacataagccatgcaaagaatgggaagtccactttcatctcaactctatgatgtactgactcaacttcctcaaaaattactctttggggtctgggctgttctgtctggacatcaaagagcaaatactcgcacttgcctgtttgtgattcatttctactacataattattagttatatgcaaagtccagtctacctatcaaaacccagattaaccttcctcaaataccagctttcaaaacttagccagcgggatcaagtccaccctcatgagtctggcccattctccctttctagcctcattttcagcctcagcagcagttaagagcaccagctctggattcagggggcctcagctagcccacatttcagcttcaccatttaccagcttgggcaaattacttcactttttgaaatcctcagtttctaccactttaattgaggacaataattataagacagcccacctcataggattgttgtaaggtttgaatgagttaatctatgtgaagagttcagtacagagtgggcaaaaattgtgagatgatgacgaagaggaggaggaagaagagaagttgctgtaggagaaggagaaggaaaatagggaagaagaaaagaaagatggtaatgaccagcttcccaaatccactgtctccaaacatcctttgcatgttcccagcatatttttttatgaaagatataccacttacttccatcacccaaacagttacttgccaaaaagatccatcttttgcatgaaggtgtctctttctatcccagtctacaaaacactaaccctttagtgaactcttcctatctttcccatttattatttactgcacttttccttgaactcatcttgatatatgcatgtgtttatagctgggcatgtatatacataggcaaatcaccccaactagtcaacgcatcccttgcagacagggacctcattcatttacaaactgggtagacagtactctgcactcaacccatacctgacaattaactagcattgttaagtttttaaagggttttaccatacattatcttaattattctttatatcaaccttgagcagtaggcaaacagaccatgttcctcattccactttacaaatgacatagctgaatctcagggattcaactggacttgagactttgagaatccatgttgattgatatagtcaaatgtttaaaacacccaaactacgcttcaactttggtgtttatctgaaatttctgttcagtttggctaaaatattcacttcaatcatacaaatacagccaaagtcccataaaatcttaagttgtgcaatttcttatccccaagatagagggtggatatttattaactttacagaatattactactctatttccaagtaaagttattttccccctaagactcagacccacatatgaattacagtaaaatctctctccaccttcttctatttccaagttcagaaaatggcatcctaatataatagcacaggtgccaatttaaatacaggaacattgaaaatactgccaaacttccaggcttagaagcttttctgttgttacatgttgggctgctaaacacacactgagtctgaacatctaacacaaacgatagcaacactatgagaaacatttttaaagtatcaggcagttccttttaactttcatttttaatctggacattgtccattccaatggtcttcactatagaatgttgcacgtatcatgaaaataataacaatttactaacaaatagactattctaaaatagtaccttaataacactttcccccaactctctttttcttttaaacagcaaagattggattccacaggcctttagctaaccaaatcaaggagagtttctaggattctgccaaagttgaaaggtagaggaatatgaggtttgactttatagatttgttgcacataatagttactggaaaagcacagctggtttgatgattccgccagaagattttggcaaagaaagaccaaagatatattttcttcctctatcaagaaatgatccaatacattggaactggctgggatatatccccctcacccaccagcccacggataatacacccaacagcatttgcctcaggcccagcacatagtaggtgctcagtatctgttggcttctccagctatgttcaaaagagaaacagataaaaaacaatgaagaattaaagatctcaatttgtaccaactacgttcattttaattatcattcttctaaatagtagcccaagtacattgctctctgttcatattcaacatttgcactatcttgaaatttttattactttgccccaaggacgatgaaagaaactgaagggttgagaagaggcctcaaatctgacactgtctgtgtccctgttccctgggtcccctgctgcatttctccccagaactgtggatgaaaaatgtgggtttgaacaactggtatcctgctgattgcaactgtcaattaaataagccagcaacacaggagcatatgttcgcatataaaatattgattaatttcacagattgggataaaaatatattagtacttgggttctgctttcatgcttagcgttcagatatgcactcagtccattcagatctatttctgcaccctgtgggctcaagagtgttacttttgtgtttcgcttttcttatctttctctggttgcccatgttagtgcttctgttataactgaccagcagcatacgtttaagcaggattttaattactaggtcatctcccagccgacttgcccacggcaggccggcagaaaagccacaatcctgcaatccatgcttcagattttctcttgtgtccctccaggtaaatctcttttttttgaggatgctaaaatcatgctgatggcatcatattcatctgataacaatgatgaccacctaatttctataaagtatcatttctgtccactgagtatttcaagttgcagggctggcacagggagtttgagatggggtgcctgatagtgtgacgtgataccaggactttttatcttaacccagaaaagcaccttcccatatatcactgcacatgccaactaacttacccttgggatttagcatagatctggcttttcaatttgcctttgagtaatgtcgtcaatttgtttcaattgaagcaagtattatattacatgctcaaatagcaggagaatttctctccacgtctgaagtccaatgtggaggggaggttagcactgactaaacaataagaaaaaacagtggtgaggacccctgtgtcaactacttggagattcaaaagctgcagataaaaacctaactttggccacgaccaaatccttaaaggatggcctcagtttcccaaatgtgtttagtaaaactaataatactagtgccctcccatggctgttaagagcattaaaagagatcatacaaagtgctcagcactgaacttgatgcagagaaagtacttaacaaccgctatcgtaacagtaaggccatgatcacccaaaacactgctctaaatgctaccattttatggacactgagttctgttagctcatgattaagaaactgcaatggaaccacatctcaaagtcaaagagtaaacaacctatggaaattttccaagtttagtttctcaaaaatggatctcagacctaacctaccttccctatttgccctccctacagcttctaatgttttatccccacgtggaattttgaatatgtgttcccctctcctgttcattctcattgaaaattttaaaagtttccctgattcttcagacttggctgagtcccccagttctaagctctcttaggagtctgtatttgtaccttatagcacttaaccatcattgcagtttaaatcattccgtgtgccattatttgtctaatatcggcacataaatacttacactcatgtgacagtctacgtcataatgctaacaactgtccctgccttatcacctctgtagccctattgtctgatataattggcagtcagtcaataaacatgtgttagtgttaaatagatgaatgattgaatgaataagcaaatgaactaaagaggaatcactggtgttattaagatgttaaggaactaaacagagtagctgaaaagttaagaattcttccaaaagttattaacaattgccactacacccacaatgggcttcttaggttgacaactggtggctacgtggagtcccatttcctgggtcgacctagcccccatttcagcagcaggcactctattctcttgggggttaaaattagcaccagtaagctccccctttagtgggctctaatcatgcaaggacccaggtggatcttgctgacagatgttaaggttagaaggaagggtagcagccagatgagaaaacagagccacccccttccggaggtaccaggacttcctgcctttagacccggtggttcctgcctgcctgcccctcccccatgcatcagtttcaacacagttgctgctctttctgtcatctgaactcaaattctatctcagaaattgatgggcgatcctgcccttgacaacacaatgtcagccttgctcagtgtccagctggttccgtatgtattatcataatgcgctgcctgggtggaccctggctgattttctctcctgatgcaagtcctctttccaaactaatttctgctctctgacatgcagaccctacttgtttaaaaataaaaaaacagcagcttgggagttttattttttaaaatcctgttaggatatttaagtctattctaacagtaaactgagcctaaaggactttcttttaaaaatgatttgactcaaaaaaagaatgtttcccagggtcctacactgtttcctggtgacttgaaagaattattacttcccccaacccttacagccctctctaacagcatttcccaaacttcagtcctgattttcctctatccctgtaccacttacactattatttacttaatagtatttagctgctatgtttgtttagatcaactttttctttaactttagtcttgccctaagcaataatagctgtgagatcatgattttgaagttggagttattgttttgtttacgcattaacataaacacacaaccattaaaaatgtttaaatgtttatcctccattttctaaaattatctcacctactgcatgggaaatagtggtctgaaagctcactgcaaactatcaagccgcttgtacacaacaccttcccagctgaagaaatccagggagaagaatgcagggtgagagctacctaaggcacaatggctatgtatgccacatttctatggcttttccaggcctcctagaaccaactgttaacctcctgcagagatggccaaggtggagggaaattggatcctttcacctgggcattttggtagccacttttccaaggctgcaggtgtgtagcccctcaagacataaaagaacctctcacagaattagctgggttcaaaaaacaaatcatcagagcttgaagggctcttccaagacccaccttaattgatgaggaaacagaggcccagagaaatcaaagtacatactcaaagtcatgtagtaaggtagtggcagagcttggttttaatttatttctgcacatataactgaaaatggtcaaacaaaaatatttcaaaatcaacccctggccactgcttctaaatatctcatcttaagaagggtttatgaacagcacatcaaagcttccacttgcccataaacatcatttgaagcctctgaaattctcaagtgaggggagctcctgtgacagataagtatagagacagcttggtttgaaacaatcaattaggcaaatcaatgcaattggaattatgatgcttttgtaaccaaatataagacaaaaaaaattaggcttaaaaaagttctgaccaggctggctcatacctgtaatgccagcactttgggagaccaaggggatgtaattgcttaagcccgggcattgaagaccagcctgagcaacataggaaccctgtctctacaaaatcaaaataattagcctgatgtgatggagtgcacctgtagtcccagctacttgggaagctgaggtgagaggatagcttgagtgcaggagtttgaggctaaagtgagctatgattgcaccactgcacttcatagcctgggcaacagagcaaggccctgtctcattaaaaaaaaagtttttacataaagtcctgtcatttctggccaaaatataagtagaaagcaacaatctttcctccccaaatctcccctacaacacacaacacaccacactttgtgcttattaaaattagtaaggtgtgactcactcatttattagctcaaccaaccaaatactggaaatttcccacagtttacaggtttgtcaagaaattcatataagaaactagcctccctatatccaaatcggtttcccatgttatttctagcatgaggtttacaaactcttcagtatcctaacggttgtttaactcatcatctcatcattttctcatggactccttcctccacaccttgtacacgtgccagagagcccatatggtcaacaaatgatttctagggagatgagttaggacattcttgcaaataaataaaatattaccagcatccttattatcttgccagccccacagaaaatatactagtcatcgaataaaatcagcattttttaaaattcaactagcagaatgtgtcccagccatgggaaaaatttccttcaggtttctgaaggaaaatcaactataaagtaaatatacatgatgtgccccattttttaaaaagatatgctctgggctaacttttgaaaagtctgttgaagataccagcacaattgccttgcttgtgttaagaaaaaaataagaacaataggataggagatggaaggaatttctcatactgtaatgtaacagagcagtagattagagtgcagacttcagcatcaagcttcctggatttgaaccctgggtctactacttaattgctgtgtgactttaggctagttattgaccctctctttagccttggttttctcctctttacaacagggtacttatagcactctgtgcctgtcatagtagggctcagggaatgtttattgttattattcttagcactgttattaggcagacctaaggtcaaattccaggtccaattctaattagttctgcagctttgagtaagttattgattctttctaaacctcagttttctcatctgtaaaatggtgataataattattatatatcatgagatttgttggaagacttgatgagatgataagtaaaatagttagcatggtgctggcatatatagtaaatgatccataaatgctaatagtttaaaaaaacaacaatagtggtagtaaataataatagagtaataaatattattacctggcctggttactgtcaagtatggcaaaaaagtctgagcactatttctcatttgttatcagtgctattggtggtgccatggtcaaatgagcagaacatagatcacctgctcatgaacccttcagtctgtctgatgctgagatcctgctggctaccatatccccagtgttaggatttccggtgttacctgctttatgaattactcagggaatacactggaaatcagtcttcactcacatcgttgtgcattatcttgaccacttaccacatcctttctatttcaaggaaagacaaaaggcatcttctcaactgcacaaagtaaaagccctgatttgatacctgaaaatctggggtctcagtgctctattttatgacacagctggatattcttagccctaatgttttgctcttacacctgtcttcttttctcaaatagggaaatcaattggtaaattgtaacatgccaccctcagtcacaaaagatgacaccaatatttttctacttagcctgggcccttcaccaagatgatcttgccttagtgggcttggctgggattctgcatcaaaactagccacagaagggctgttggctatgtgggaagctatgcatcatccatcatctgcccttgaatgtacatttctgtcaggaagctggatttattttacagacattcttctcagcatcctgggaatcccagaaagactggaggcaaggctaggccaatatgaaatggataggcattggggtggaccccaaatcctctggcatgtttatccagtgaccaggaaactatgcaaaccctgaaatgcacatggacaagtacaaagagtgctgaatggattttgagagaaacaagctatgtttaagcttgagcagattatatcccctctctgggtctctgtaaaatgaggaagagtgaaagaaatgaccttccatccttcactgacttcactcagtgtgagctgtggctcaggcattgcccctggtgggaggggagagagaaatttgggagggtatatttttctctgttgttttagtttattttcactcactaagttttggtggggtaatatacattttaatgggtcaaataatgcagcagtcctctactctaaagaccatgaaaaggtgagggtctccacaaatttaaaaagatgccaaaaggtacactctttctaagccacttacgaaaaactaaatcaataatacgaagccatctgaaaaaaaaagaggagaaaggactcttaaaatgtttgactttctatgaagaacacatgccctattgatacaataaggagtaattagggggacagctccaaagcacagccaactccctggtgagtttccaaagtccagcagcgaagagcaaagttataagtaggtctgagcaaacttgccctgggctttcaccggatctgaggagcccatgtaattgaaactgagttcatcaaagccctgcttgacctcctccccacttcgcaattgccaccaagaccatggcctgaccagcccactttggcctgcatgatgtagccctcacagccaccctagtctcatctcctgccactcctcccttgcctgggcgcaacaggagccctctcagtctccttttgttcctggaattcacctaagcaaaacaacccttgcacacagtttcctatacctggcaatttttttttttgtcccctttgcctagtgctatggtttgaatagatgaatggttcaatgtccctactaaaattcatgttgaaatgtaattgcagtttcaacagtattacgaggtaggacctttaagaagtgattaggtcatgggggctctaccttcctgaacaaactaattccattattgtgggagtgggttagttataaaagtgagctctcttcacccacacttgcttgccttttcacctttccacaataggatgatgcagcctggaagccctcaccagtgctggcatcatgcccttggacttcccagcctccagaaccgtaagacataaactccttttcctcaaaaattacccagtctgttaaagcaacagaaaacagactaagacacctagtaaaaacctactcatctcttcggttttggcataaatgagatttcctgaaacaaggcttccctgacacttcattactctcctctgcttttgtggtccccctttgatgcaccactctaattttgcttagtacctctcctctctattcacatcatatattctgtgaagacaaggactgagtctgcattatcctactgcacctagcttaatgtctggcatgtagtgcctgcttagtatgaatgagcgatttcaagtccaccttattgacaccttatcccttggctggagatccagaggaagggttctattagaaaatgccagtggatttctctgttcccaggaagctctatttctccaaagtcacctcctgcagaaagtcatgtgccaatagctttagttcagagcaccataaaatagtacatgctaaaaggaagcctagagaggaccccacctggctctcactggacatacaaaactgaggcccacagaagcaaagtgaccttcccagggccacttcagccagagagcctgatcctccttctatcctcttgttaggaccatattatacagaagggaaaagagacaggctcaatttgaggtagtctctccaagctcaaaccatctttctccacatttccgtaaaaacatgaaaacaaacaaacaaaaaaaccaaacaaatgaaaaacacatttaaatgcagctggtcacaggaagtcaatggtgctggacacccaggggcaactgacagaagcaaaaactgcctctgtctggatcaaaaggattatagaaggtcatatgctaaagatcaagaacaccaccatattgtcagggacagttgtaatgtgacactgcaaccaaaaggtcagaattcactggtggtggtgaacacctgactctatttctccaaagctataattacagccaggagatgggcccagtgagtctatcatcagtatttattcttcaaaatactttgagtgtgaccaaactccactattgtttttatttatcttgaaatcttggcacatttatgttttatgttgcagtctttattataactttgaagggaaatttaattgatttgtatctgatgcccacaaaagctaaatttcaatcattttccatttttaaaaactgagtatgttttaaagaatctatcttcaatctaaaaaaataagtaggaccccaggtcagagctcatgaacactaacatgtttatattctaaaaactcttgactaatagttccattgtttttttttccaaataaatatgaaggatgcacatattcaaaacaataacaaaaaaaaaaaaaactagatctaaagaataccctactggggacttaatcccactcctggaaatggctcctactggtgggtgagctctagaacgtgctcacatttctctagtcaccatggaggaggcaagtcctccaaaagcccaaaaaggggagaagggaaagaaaaagaagagaggaaaggagaaaaacacatgcacaccaaaataaaaaaatacatatatcccctttaaaaaaatgagcatttaaactgcttgtcagatggtttcctgacaaagccactagagtgtattcacaggcatttgcataaatgctgcctgtgagttcaccatagctgcaagcgctaatggtacataaagtaatttagtcacttctcccggcattctatgtcagaatgatgagcacgggcactttgccttgttgcatattagatcattagataataaagtgttagcgcatgcaagctgacaggggctctgcaccacagtgttgtgagggcaccgcattttgccacagggggaagaaacagagaaactgatgccacagttggccttgaattcaagtaaacacaacctggaactcaggggaacaacaatgccaatagcaacactcctcaggcccctcaatgactccccagaacacagtcttcatgaacttgcccaaatgactggaagacaaggcaagtacacagggtagcgctgaacatagccttgtggcagccactcagctcctttcatcccgagctcatgctttttcaaaaattggaactgagagagcagttacattttgaggctgcctgtctccacgactgtacatcttccataaagctattgcttaaagaagaaacctcactaggctaaatggtcccataaatatccagccaaagaaaatcttggtatttatgaatgaagagaaagtacgggggaagaccattttccacgatctatagcatgccaggattcactatctttggaccatgcaagagtctatgaaataaatttgcctttgtcaactctcatacttgaattacagggtcatttatcagagcacaggggtttgcgagtccatgggtcacataagaaagcccatgcatgaatgtaaagcacgatctctgtctctacttatacacagaaaggtgagccacaaaaggaaacttcctccaacagtctgacaagcaggatataaatagagatttgcagaatagcccaaaataattcaggctacctgtaaattagatggtaaaaagtccagaatgggggagaacgtaggttcccacaggtcacaagaggagaacatgctttgccgtctcaccatgcggtagctgtttgaaggcggtggggggtgggagcggagacacagagggatgagggtgtatgattctcaaagtcttttaaacagagcattttgaaataggacttttcaacagcaaaataaagtattaccctcacatcaacatgaattagcatctaggtccactcccacacattaccaatgaaagagttcaatagtcatcctttgctgagtagatatttatgtgtcagcctgaagtgtctaaatgagtgggtggttttgtgtggttggttgactcactctgcagagaagcagatttctatgctattgtcattactaagaatttgaacatgtctaccctttctttccactggagagaagtgaaataaggcttcggtgaaggcaaagccccttgctgaaggaaataggacatacctatgtccccaaggatggccaaccacttacacagtgaaatgtcaccattttttgaaaaatatagtaatatggccatctgtggactcataaactgaagcaggtgaataaaatgctgactttaaaacttagaataatatgacaccccaactgaaatattaacactcttagaagagggaatatctgagctgggaggaagcttagagctgtgttgatccagaggtctcaaactgttgacctgtggctgcattcttcctaagtggcttttttccccctctcctcccttcagtgtccaaaaattttgtaattagttaccaacaattaaaaattcactgttgccaaactggaacatctggccccacttgggctctcattccccttagcaacaactggctggggccgaggggcaccagagcgtgtacttgcctgtcttctcagcctccacccagcccacttccctatctacattacctgcccccacccaaagcacagatttttttttaaactctcctacagatcatcaccttcattttaacaaggaggaaatcaaggatcccaaaagctaaagcgatttgtccaaggtcaaatagaggccagagtgaaactaaattgaatttggggttcctggtacctatttcaagacctagtcctttatcatgctgcaaaataacgttactgatcctcattgcctagagggatcctttagagaaggctatattctatgtttgcttttggtttttgttggagggataatttgcctggtgtcaggagctttctcactggcttcccaagagcagaaataggagctgggtgtggcctgagcatattttgaaagtgtgaacccagatttcaaactgacagtcaagtctgtcaccagactgggcagtacctattgcaactaaccacccacagtcaaaaacataacttcaatccttaagcagcactctccaaatcatgcccactgagtatttccctaattttttcttcctcctttcacctaaacacctctagtcacacaatgccttaagtgactccaagggtattataaagacaacattactgtaaagtgaggatcagaataattttaagtacagaaatggaactaggaatgtaatcatgagcaggtgtttgaaatggcctcctgcaaaatgtaatatccatccatctcagcactaatgaaaccataaagaagcagcttttgaaagatgatggtttactttaaaaagactgtaaaactggatgtggtgaagaatcccttctaagagcattacatctggctaattaataaaaagtacagttcgtgtgttccataagcacaggggaaaaagccaggcaaaaatgatgagagtggcgtgtttattaaattgggatgctggcagagaagggagttttctaccttgtaaattatgggcaactcctggcccatggaaaaaagcaggcaatcaggtgatcatttgtgtggtagtgttctgaaaagaatcttgctgaccctagcaaactggaaagggaagtgagggaaatgggttgagagtttgaggcaattgaagaaagtctaatatggtgactggtatccagcagagcctcagtcactcattcttggatggacggatggacggatggatggatggatggatggatggatggatggatggatggatggatagatggatagatggatagatagatgaacggatggatggatgagtggagaggaggaagagtggatatattacacacacacatgcagcactgaaaaattcaggcgtgcccctaacccaacccatggttcttctgagtggcattcactttccttgattcaaatttttatctggtttccttcagtcctctcaaaggcaccactgattagccataattctcaagacaaatgggatttctccctaccaaagtctacttacagacagcaagttctatcacatggtgaagaggtaagagttaggtacagggcacaggagggacatttggtctgggcttcatattcagaaagcacctccaacctcgacattgaacctgatctccaaatgaagttcaacaggtggtcacagagatacaccaggagggtggtaaagaggatgggttcattataaaacctcaatggtcaattataaacatgtcaaatatatcacaattttagtgataccaaattgtgtggcctttccttatttttcccttggattggcctttccttattttgtaatccagtgggagcttagaataaagcaatggtccaggcctccttctttctctcaacctgaaaggaggcaatatcagccatttccagagtagagagtggtcccacaagaaaggtgggcctcagagatattttcctgtctttaaatatttgccaccatatgttgaagagaaaaaaccctagaggaccaatcttattcaaaaagacttttgaaatttgaaacagaatagaacatgtggtggagtggaagaaagaaaccaaatatattcacagttaaagtagcaatgccaaccaatgaaaatgattcgcctaccatgttccagataagagggcgtaccttccgaggggtcaagcctccgagccctccgcccatgcttggaattattatggacaaacatgttatcagagactgccaggacatggccatccacattgactgtcgtagacaccacgacctggagacataagaaagaaatgaatgaacattttaatataaaagcgtggtgggtaataaactcaagttaaataaataacagctgggagctgaagaaaattgcatagctatttcacataataactggtgcttatgctgtacaagtctaacaagaggagctattgatgagtgggtctttggcatggaacgcttttgatgcagttttaagtaaaattgcacagtttatagttatacagcagaaggtacactgttaaccataattttaacaagaggatctttattagcatatttttttacacaagggtggttgtgtttcacctaaattacccttcagtttagacactgaagcatatatcacagttgatcatgcaaataaaaatcttttgaatctttaaaatatttctccccactgtgtcagggttaagaggatagagaaatgaaaaagatttcagtaagagcagggatgcatttttctctcctggatgtctttttgagatttcttgtacgtttttctttccacattagtttggttcatcagaccaaagtccccctcactactattaccatcaccccaccccaaaaaattcctgctaattaagggtcttagatctgtttcaaattaaaaaaaaaactggtgggaatggcccaagacataatttagacactgaaaccatctcataaagtgactgtgaacccagtttgccagaagagacacaggcaaagatgttgtctcagagaactttgactaaaacaatgagaagaaatgacctacgcttctccttatattaaatggggaaagggattaaaactgaaacccacagagatatgtttattcatgcgacctcttacaaccaaatataataattgtctgtaattgcagcttcagctcccacctcatgctttgacatgggaaacagcaatcagcccgctcccgtttaatccacctattatgttgactaattaactttgctcgacagtttatttcttcctccattatcagcccctgtcagccgcaagcaccctgcagcataggggaaacctcaggctctttgattgatcaccgatagattgacatgcagattaatttaattagaatcacctcacttgagaaatgaaagacaatggcaagagggctaatagatctgctctcataatgaggcgagcctccagagcgaaggctgaggatttctgatttattttgctcaattccccagttgcttggaaagactctcgctttaattgttcttggttttgagaggcattagcctctgaagaggtgaaccgctttacaagggttggcacagatggaggcctcagtttctgaggaagccttttctccaagttggctgaagggggcatcgacttctgaagagtcttgtgtaacactctttcatcagctaagctgggcagaggggaaaacgccaggccctggcctatgcctgtgaattgtcagcttggacgccagtccccacagtcttcccatacttaaaagttccactgtcctcctcgttgacctaagtgcatcctggcaaaatacgatgaatttcctttcccagagcctcaaagatgcccacgaattgcaggctatgaacacatcacccatactagtagcataaggttgattttgttttctaaatctacttaattaaaatgcataggaaacagttgagagttcaatcagggaatcagagtattctccttagccactgtgaaaccccaaattccatctagaacaaatcatttgggggatgacatgtaagtttgatgcagaagtttgcagagtggttcttctctttattcatgattgaccaaccagatctgacacagccttatgtgtaaacacagcttgtatgtttacaggttaatttaaaagaaagaagaagagaagaaaacggtctactattttgccttcaaaaactatcatatgcagtggcaaagtcaatattatttaaggcaacagaaattcacttttctttttagagagacgacttcttaggacttacaattacataacagagctgggtctttcaaagaaattttgatttactatgagaccacaattgagcggtcactggagtcgttagctgaagaaactataaaaggaatcccaaaccatatctgttttcagtgtcaggaaatacagaaagtggttattctagatgtctgtcttaggaggaaaaaaaaaaaacaatgacaattcaccatgcacctgtaagacacaagctctacaaacttaaggcttaaaatattcagtatgtttcaaagacactgtcatctaatcctacattgaacaaaaatgtcaaaaacggttaaggaaaaaaaaactacaccccatatgtttttcttttcttggcaagagaagaaccaccagggccacatgtgtgatagaatcatttggctgaaatgccaatcaaaattggaaaaaagataatacagagaatctttatacttttaatttctagaaaataagcagctaatacgttcctcaaaaactcacagcacaacttccctaccacaaaacaatttctcccatttcaatttggaaatattcaggatatatttaaataaaacatatgctaaaattaatccacagagcgacttgtaaattaaaaaaaaaaaaacactgtgagatgcaaaaggggtactgaagtgtcctttaaaaataggcccatggtaggagggaaaagggcctttacagtttaccacataattaataaggtgctgacacattcacacaggcaaggggacagacaagcctgccaaatcttcaaccttcctaaattttgtcaataaaacacagcctaaatttgagacagataaacattaaaaatgattttacctttggacacaacaacactttccttctttctccccttttccactcccctgcccagagaaacagatgatgagaatacgaaggaaaagatatgtttagaatttcacgatatctgttataattacacctttactttctagaactgcactgtccaatacagaagccaaatgcctggctatttaaatttaaactaaacgacattttagattccctttctgagcctcaatagccacactgagcgtttcatagccataggcgactattgcctactgcattggacacggtgaacagggaatttttttatcattgcagaatgttctataggatggcactgctctagaatggttttgaaataaattgtgcacttgattcttgaagatgtccaagttatatctcctgaaataaatatcagcctatgtaaacaggtttagatttatacatatatgctttaatcactatatttttggaatgaaatttctattagggggctttgcttcttaatgtggcaatctagagatatgctgattaacactcagcatgttccagggtacttttcatctgggccttcctttctagttgagagtattcgttataagagaacgagaagggcaaaaaagaagtttctagctacccatggactttggatattttacactgatgttttcaatttcttggctcatatcagtggttcagaatctcctctgttatatccttttctggatagatatccctaaaaggtattattccaatccccctctatttagaatttgaaagaactagacacaaaatttcatccttggctctcaagctttcctggttgatgtgactttggccaggttaacttctctgagtcccagtgtccctgactctcaatgggaataaccaccatacttaactcataaggtaactgtgaggcttaaattaattaaagtggccagcatggttcctggttcacatggagcactcaataaacattagtagcagtaatagagtagtagttgtcaatttgtgggtgatgttaaacaagaagttcaaaagaatgtgtcgggttgataacctgaagtatcttaatgaccgtaaagaagacccagcatacactgtaattttaaataaaaggatacagaaagtgtttcttctatgtccactgctcaacacaaacgtacaattttaaagacctttgtgctagtaacacattattacacatttaggccttgcatgaattgcggttttcattggtttatataatgtcgctttctagaccctatctgtatcttagcctcttacatttgaggctttattataactaaatgaaaccttactattctgaaaatagtctgtaaatgagatgtctcatcagttcagtctagttttcccaatatttcccatcaatgaggatttctcaggagttttgttattggtgagtacttcctcaccatcacttctcaggcagcccctcttcccttcatgtcaggcaggagaccttgtatgtcctaactctattatctaagattcatgaagcataacctctgtctcatgagcagattttcaaaaagacacaagcagctaaattcaatcatgagtggaagatcacattaacaaaagtagcagtttgtggggaagaaggggttatgacaaaagcaacccaacatgttgaaatttgtatctttaagcatttctccaacaaacacagaatcagagcaaagattagaccataaatatatttttgtaatttaaatttagaatattgtgacagttaagtatttccttccaaaaaataaactcttcctcacgttaattttgaatgattatttaaaaattccaaatcttggttttcagtgctgatacatggtaactcagtaaaaggaaatcagtgttaaagttagtctgttctatgcttcctaacctctctgttttttgcttgttgtacttttgcattaatttagggcccctaatcacaaagctttaaaaatattaacttgaagtacactaaatgaaaagcactgggcagcatttcatggaataatactcagcaataaaaaggaacaaactattgatatcccagggaattatgttgagggtaaaaagccagtaaccaggggatacatactgcatgttaagggctgaattgttcctcccccagaaattcatgcattgaaggcctgatctccagtaccttagaatgtgactgtattttcagatagggctttgattactttaaaatgaggccattagagaggtctctaatccaatcctcacaggaggaaatttggacacacagagaaggtgagtatgattactaaaaaaggacaagatgagggatccttgtggtgatgaaaattccctatataaggactgtggtgttagacaaagctagacacatgatacaattttatagaactaaaaatacacccacacaaacaagtactagtaaaacaagggaaacctgaataagatggtagattacatgaatgtccatattctggttgtcatattgtaaaataactttgcaaaatgttactgaggaagactgggtaatgggtacatgggatcattctgtattacttctataactgcatgtaaacctaaaattatgtgaataaaaatctcaactaaataaaaggcattggcaaccaagatgtccttcaatggatgaatggaaaaacaaactggtaatccatataatagaatatcattttgcaatttaagaaaatgagctatcaagccacagacagtcatagaggggtcttaaatgcatattactaaataagaaaaagtgaatctcaagagtctatatactgtatgattccaactatacgatattctggaaaaggcaaaactatgaagacagtgaaaagatcagtggttgccaggagtctgggagaagagagggaggaatgggtgaaggataggggatttttagagcagtgaaaccattctgtataatactgtaatgatgtatatgtccatgcttttgtctaaacctatagaatgtacacacaaacagtgaactctagtgtaaactttaaattgatgttgatttttgagacagggtcctgctctgtcacccagactggagggcagtggtgtgatctcagcttactgcaacctctgcgtcccgggctcaactggtcctcccacctcagctcctgagtagctggaactagaggcatgcaccaccacactcagccttttttttttttttgtattttttttgtgaaaacagggtttcaccatgttgcccagactggtctcaaactcctgggctcatgtgatctacccatgtcagtctcccaaagtgctgggattatagtcatgagccaccacacccggcccacaaaactatggattttaataacatattaatattggcacatcaattgtaacatgtatcacactaatgcaagatgttaataataggggaaactgggggttaggggatggggatggggttgagaaggtattatatttctgtaaacctaaaactgctctacaaaataaactctctatattttttaaaaggtattgatcacacttctaccctcaaccccctatagtctacattctacattctacctgtcagctgaactactttgcagactcgtcaaatgttagagtcacaagagactccagagatcagctaatctagtggctcctaactaagagtttttgactgtaataatgggtgacattattgcacagagggaatcataaaagcatccacagtaaggctgcatactgaaatattcagttaactttcccttgtctgggaccctatcaactccatgtggaaactctggttatctcatctacatgagaagctctcaactagcagttttacatggctttaaagaactctaaagagaacgtgattcttaataaatgcaatttgattgaaaaatatgtcatcataggaggttcataggagaaaatgataaaaggagtcctcaatataagttatggcagtccagatttgtccaacacctccttttacagcttggaaaactaaggcccaggagtttaaaaaaacaacttcaagatcataggacaaattaagagcagaggcaagcctgaagggaaacctgtagactcacagtgcagttctcacccaccctcagttctggcctttcattttttttttgagatggagtcttgctctgtcaccaggccggactgcagggcgtaatctcggctcacagcaacctctgccacccagattcaagtaattctcctgcctcagcctcctgactagctgggactagaggggcacaccaccacacccagctaatttttatatttttagtagagacggtgtttcaccatgttggctaggatggtctcgatctcttgagctcgtgatccgtccatctcggcctcccaaaagtgctgggattacaggtgtaagccaacacagttggcctctggcctttcagtacacagtcctggcttacatcctctctctggactctcctaatacttccagtacaaatctatggtgcctgtgtgaccgactacagtttgagtattatttacataaaaatagtttgcagcagttaggtcttcattaactttgtcctttaaaatatccttggctgatatgaatgcgatattctcagaaatgttcctgattgctagcttctatctggttgaaagattccaaataactcattaaaaattatggaggacgcgtgaacctacaggatgtcatggagtggaactgctggagtaaaggagtggttaatggaattacattcgcactttaaggcttgaggcaaaaccagctcttaacaggaagacaagaacagacacttctaaatcctcagatacatgtgctaagctaatctagacctttggaaactagaattagcttctgtctcctgaacggtgacatatgataaacatgaaaagctcacaagtcatctgaacctcattcctccctctgtggatcaggatacttttgactactcttgagggtgtcattggtgtttagctggtgctctctgtgtgtgtgtcctcattggccattttaggtaggaatgagacaaacaggattgtcatgtgtgctctgtaacgatggggctatggcatacggacatggaaatcaggagcaagaaaatggcatattggtcaatggctcagattccagagtcagatgatcctgaatttgatccccagtcccatcacttacttgcttgtaatcttagatgagtcacttagtcataggaatacgtggtgagcccactatgtgcctaccatgtgccaaacattattctatgcactgaagaagcaacaatgaacaaaaccgataaagcatttaccaagcaggagtttagttcttactggggacagagagagagtcagacaataagtaagcaataaaagcaaatttcagattgtgataagttctaagaaaaaataaaatatcttccacctagatgattcctaggtgggagatatttttaattgggtgattaggaaaggcttctttaaggaagtgacaaaaaaagaggaaattttattttttgtatttttagaagaaatggggtttcgccatgttggccaggctggtctcaaactcctggcctcaagtgatccacctgcctcgtactcccaaagtgctcgacttacaggtatgagccaccgtgctcagcctgaaatctgaataaaaaatatccagtcattcaatgtgtcagaagagttttccagggagacagaatagaaagtgcaaagatcctgaggcaggaatgagtttggtgtatgtggggaagaaaaatgaaggaaggccaatgtgcttgacaggactaaagcaaataagagaaaaagtggtagaaaaataagtaagattatacatgtataacacttagtatgttgtctgacatataactagagctctacaagttacaacttaaaaagtggaagaatataaggataccttttgctggtaaatcccaacaactataggcatcttcagagccagcatccattggtaatcactgatcaaaccaaacacttttacattcatcctttaatgtattttacatttcctttaaaagcagctgtgtttaatgtagaaatacatgttctctaagtgcagggcgaccactcatcaaatgctgttcataaagattccttctcagtgatgcacactttctgccaaggctcagcataaggctcatgccaagatacatatttgcccaataagccataatggtttaatatatcaggttgaaaatcaccatttgtatttaccatgttatgtgacttaatcctgtattctgaaactatcattagagctgctttcagtataattaatcagcatggagcctcttgaaattattctgtatgaagagagtgatcgcagctcgggcccctagcattctgttggtagagaatttaattgcaagatgtgctatttgtcaaaacaatataacaatataagtacatccaagacaggggctgggagtcggtggaggagaaataaagaagcacatattcttatcccttttatgtaagtgtatttaaagcagacagaaactgcagatgtcaggcatgtattttaagaatcctctaatcattccctaaaacatacggatccagagataccatggcttgttaagcaaacagcaaagattctccaaaatttctagaatttacttgaaaaggcagggagttgccttttaatgtcataactcatgtcatcattttaaaaagcaaaacacatttttggtgggaatttgggatgaataacccagtggtttctcctcttctttactatccaaatgactaagatgtgaggcaagattgtttgcctccttagataaacatgaggtaaacatgagttttgtgtttgctattccctttgctcagaaccctctctggctcttcccaggatggtttatccttattcttgatctctgaacttgagtgtcctcacctcagaacgctttcctggtcacctactttaagagaggttgtctcccttctctactaaaaaaaaaatctaaaaattagccaggggtggtggtgcgtgactgtagtcccagctactctgaaggctgaggcaggagaatcgcttgaacccagaggttgcagtgagccaagatggcaccaccacactccagcctggcaacagagccagactccatctcaaaaaaaaaaaaaaagaaaaaaagagaggttttcatctcccaccccacactgtttttctctctcataataacctgtttaattttctttatagcagcagttacaatttctaatatttgtaattgttaatttgtacacatcttcattgcagctaatggcaattattctacatacatccattttcttgtcttcatgggctgcacagctagaccatgcaagcctccctatgattgcatatgaccatgtgactgacttctagccaatggaagtgagcaaatttgtaagccaaggcttttaaaaagcacatggcacccttcatgtgtccttctcccatcagaggactggataaagacagcagggttctgtagaataggagaggcataaaataaaaggagtccaggtccccaaataacctcaaggacaacacctgctcgtcaaccaggaacacctgccttgtaccattatgtgagcaagaaataaccttctgctgcaggtgagccattcgatattatatgttctatttgttacaagagctagtatcatcccaagaagaatataagtttcattagggcaaagaccttatctttcttattcatcatgatagactcaccacttagcacttcaataaatattactgaatgcacgcattcctgcatgtgtgcataactatgtcttctatttacattcatatatagttatagatctaatatttatacgtgaatatagatttatagccaatggaaaaactttattgaagagataagatgaatttggaaatttatactttacttcagtctccaggtattatggtatctattgcaatgacagcttgaacctgattcttgttcttcccttaccaccctcattctgccagtccccaaaaggaaagctattgataaaaatttaaatcttaaggttgaattgtctggctcctgtcggttaaaaatcagaccgaagcatggttttaacatagtcctttgacattagcatctttttagtgtcaagacgaagaaataggattgtttagtcataagtgaatttctccctgtgtcgtgagctatttccatccccagcttgctccccttctctttcctccagccttcctcatacccaccagtccttaacaaagcctgtatccactgttgtatttaagcaaatttcttaccctaactacagcctagggatttcaaaagaaagcatccattgtaaattaaaaaaaaaaaaacattgtgccagattttctacaaggtttattccatactgccttaaagtatgaacacagcccagctctgcagaaagtgattaatttcttgaaaacactaaggtcacactaattgacacgacctgtgtaattaagcaatctctgtttacacagcagaagcccagccactgtgaagctgagtttgcttgacagaatgtctttccatgtcaagagatcaacaacctttcttatgtcctcctcagtcacctacacaggcccctgattgctgttcagaggagacacgctcctgcgttgctatatgaagatcaggctggccggcaagcatacaaagtgagatggaggaaagcagcggcagtgaccactgcacagaccctgcttagtaggcaagagagggtgtcttcagtcagatgtgccaggactcaggttttcaataaaactggtaaaagccacattgacatgtaaggaggagaccagagtttttttgtgccagaaagacactctttcactcaccctcagaggcaacagagacataaaaatatttgaaaccagcctcccaattagtgtgctatgagaaaaatgctaaaaagtataggtcttactcataagcaatcttcaaccaatatcattatgacacacacctctgtagccaggacagctacagcaaagactaatcctccctgtcttggttcggtcctaagacttgggaaatttagtaggatttcttagcagactactctgagatgtcttcggggtgatttactcatgccccatctaggtgaggagctctcttgccttggagaattgaccaaaccctttacaggttaagtgaagttcaggttacctgctaaataatagcttgtttttctaaagtccctgcaagtaaaaattgatcaacactgtagctgtactctggaaaaatgttcatgtttcctcacttccacacaactctaccctctgcatgatgaactttgattgtgtgtcaatgttcttcatgcagatggcacctttaggctctgctaggacaaatatctcttttgaagacccctctcaggctttcctgggattccagcacatatttgtggggggtcattagggctctcagatgttacgagatctctttatagcctcactaaatatctgctcacagactatggacaatttttttttgttgttgttccaaaacatcagaaaatatctgagtcagactgcttggattataccactgccttaccatttagttgatgtgtgactttgggtaaattgcttaactgttctaaaatgtttcctcattttaaaaatgggaataatccacatttccatattcttaataagggtattttgaagataaacatgataactcatgtaaaatactttgcacaatgtctctcactaaagaagcaccaaataaatgttagctttatcatcatcatcgctaccaatatcgatagaagcacataaaggtaaacacatggacacatgcatttatacacgtgaacatggaacatgctgaatatagacacagttatcttcccagcatttaatgcagttaggaatgaaccaagacagagaacctaagaagcttggggtggaggcaaaacgaacaaacagaaaaacacctgaggatgacagtgagttcagtttggggctgactgagttgaagttcctggaaatatccagcagacatctggacagttagatctaaacctgggtgtcaggtctcagagattctgataccagagttctcagtgcataaatagtggttaagatgctgtgactggagaagatactggagagagcctataaaatggggaaagatctggacttcagaaggagacctggaaaaaaacaatatttacagaagacaaacaaacagcatcccttgtagggagttcagaatgagtgactgttgttatataattcaagaaaaaaaaatggattcaaaaagggtgtaatgtctgccagcatgaaataatacagagagaggtaggagtaaatagtcatgaaagagaaaaagactgaagaagaaaaaataaaaggttgggttagagagatttgaggttttgctttaactctcgaggcaattcatccatcctctaattacacaaatatccatgcacctgcatgcatgaaacccaatgttggttgtatgaaaataataaagaaatgtattaatgtacagggataaaaaataaaatgtgacagtgttcattctgccatgggttcctccatcctcttctaggcagcaaagagtgggtgatgggaacaaagcaggttaaacctgagacccaataaggaatttgtcattgttaataaaggaagacacggctcatccttaactcaaaaactgactctatggtggccaaggtagctgcccctattgatctattttaggacccatttgagaatcacaggcaagagcattgtcagtgtcagagttcagataaatcatatttatttgaaagacagtatggactttgtgctgggcagctctcacacttaatcaaagtgtgcaatttttgggacagtggcactgtcaccagtaagagcttgtcagcggttatcagatataggactaatcagtagttctcagtcaggggccattttgcctctcctctctccaccaggggacatttgataatgtctgcagacatttttgggtgtcatgattgggaggtagatgttctctactagcatctggagggtagaggccagtgacactgctaaacatcctacaatgcatgggggcaccccccatgattgaccctaaaaaggattatccagtctaaaatgttaactgtgcccaggttgagaaaccctagactgaactcatgatccatcttcagtttgtcacatggattttctccaaaggcttgcatttgtattttatcacttacaaattagctatacatgcaaaatattgctttctttcatatgtagtgatataagcagaagtgtcaattttcctccattttacagttgaggaaactgaagctccaaaggattataagactttccagatatctatgttgtgcctcctcatctcagcagcctttctactaaacaaagaataactattttgtttgcaaaatagaagctttgtagatgttctcaaaaataatagactaaattggtttctcatcttgtataacaggtatatttctataattcaaccttttcagacattttactagtaggttccacaaagaaaagagagcccctggaagttctacacggatgctcttttaggttcccagtgtcatcaaagtccatcccaaactctgctgccctaagaggtacagcagagttaatcctggtatacattaggcattagacatgtttattagacatacactgtttcacgcccagctatactttgctcctaactcaagctttggtcaaaagaaatataaggttcatgtcaagaccaaagcaagctacaaaacagtttattccaaaattcagcctcatgttgcaagaccctaagcaacacacacttagtagcaccacatgtgtggttttgccagcttaattgcaaagttgactcaaacataacacaaaaaatcctctatgggaatgagaacaccaagtttgaagtcagatgaccggaggaaacattttgcaagaaactagaaacctccccattcctggccaggcgcagtggctcacgcctgtaattccagcactttgggaggccgagacaagcagatcacaaggtcaggagatcaagaccatcctggctaacacagtgaaaccctgtctccactaaaaatacaaaaaaattagccgggcatggtggtgggtgcctgtagtcccagctactccagaggctgaggcaggagaatggcatgaacccgggaggcagagcttgcagtgagccaagattgtgccactgcactccagcctgggcaacagagcaagactccatctcaaaaaaaaaaaaaaaacgaaagaaaagaaaaaaagaaacatccccattcctgtgtgtcaagccaaaaggtggtgaagccaagatgattttagagaaatacctcagaatctcaggagagattacttttttctaccgcatttgttctttaataagactaataagtctcacctccttaaaagaaatcatcttggagactaagagatattgacatctccaatcaatgctcaagatcatctttcctttttcccatcagagaatgaaggtgcagctaaaatttttcaagattctctcagagatcatacatttcaatctacacttaaagctgactaaatatacttaagagcatactttaaacaccatgctgtttccttgatggaccatatgagcatacataaatggatcgttgctctgacagggaaactaacattgaccatacaaataacttagccattcggtggagagcagcacaagggtctaaaactttgcaactcaaagtgtgggcggtggccttggcatcatacaggagcttgttaggaatgcagaattccagtcccaccccagacctctattaacattttaataagatcctcaggggattttcagcacttttaagtcagagaagcaccacgtctagactcaacaaccttttctaaaatccaagtaccattttgtgtcttagaagtaaatgaatttgtttgtgagtcctcttcctttagtaaatgtataattaaggacatttctgaaacagaattgttatccatatcattttagagatgttatgcttcttaacagggccatttataataggcagctaccactaacaatttccaaaattggaagaggtgagcagagagaagcaaaggaagagaaagccattactgtaaagcagagcagttttaccagttgtactctttactgttttttgtttgtttgtttgtttttgttttgttttggtggggggtataggatcttactccgttatccaggctggagtgcagtggcatgacctcagctgcaacctccaactcccgggttcaagtgatcttcctaccttagcctcccgagtagctgggacaacaggcaaattcaccacatccagctaatttttgtatttttctgtagggttgaagttttaccatgttggccaggctggtcttgaactcttaaactcaaacaatctgcctaccttagcctcccaaagtgctgggattacaggcatgagccactgcgctcagcctctttactcttatttactggttttctacatacaaaattttagacaaaggattcatcatttctatgtactttacttaatctgtgggggtttaggcaagtgagtccactcaggcagccaaaactagactcaaagaacaccattgtttccaccagtgagcacaggtggtacagttcccactcttctctaatctaaacaactgctagattgcagatacctgggggaccaagggcctcagctgctcttcacctctgggaaaaaaagctacgtatcttctgcctaagacttttttatcctctcctgatattcatgccattattgagattcaagaaagataagtcagacccacctggaatctccgcatgtcacgtgggtttcccgcattctttaggcaattttggttacatttgaggaaaaatttcaagaagaacctgtgaagaaacaaatcatcatggttagcatttcggtttctgacacgggagggaaaaaagaggtaagtcacccctgggttgtgcattcgattctctttacatgttttctgaaatattcagcatggtgttagagccaatatttcatttgtggctttagcctttgttttgtttccacgctggaccttccttatgacacaaacactgttggcactgccaacagatctcacagaagaattaagccccaaggaagtattttcactcatacagagggaaagctttcatcataatttaagttaggttccaattggatataattgtctgagaattactcatggtccccaacgacaacatgcagtttaagccctataaactcacagatgatgaactggcaaatacatgctggatgaatacaaggatttggtaaccactttttatcttagcctctcaagtaaaatgttttaattagtactacccatgagaaataagtaaaattcacaaactaactaaactcctttgacttctcaaatacctcctgtttttttttttttttttttttttttttgttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgccaggccctcctgtttttcttaaactgtctgctgtagacaagagctagctgtgattgaataaagattttcctgcctcactgccaccttggtttctgaattggttctgtagtgagattcatgggttttacttgctaaggtgaccaaaggtcccaatttgccaagaaaaatcccagtttataccagctgtactggtgtatatattaatagtacctactttaactctcaaaaatgtcttggtatgggtgataaattatatggtcaccctataactttctgagttatttcttatgtaaccatcacagttgttaaagtctatcatggaaaagcagcagctactaaaagtgtcatattggggcattcatgtctaccacctgtaattaaaccttctacctgcccaggtttgggaaaagaagtatttccaaagatacctaagttttgcaatctcttttactactaggcctagatgtgatgtgcctgtggatttcaggccgaaatgtttcctaaaaatatcaaaatgcattaaaatgctggtcaactgaattcttgttgtaattcaattctcttcccctttcttccacttcaagtccacactggagtaaaatccccatctcaacacaaatagattatgaagaactatcaccctatgatgcctcagtctgaatttggctctgactgcaatgtctgtcaatcatgtaacactgggatcctctataacaacagcactgcacgaagacatacagagttcagccaatttctgaatatgaaactgagagaagtcccagatgaatccctctgctccttggtctcttagaatctgccaagatgggagtatgttgtgggaatcattctttagagacaaacaatggccttttcaaccaaaagagtaacatttaaaaatgcaaacatcgtcctaaaatgactgtttaacaccacacaacatttgactgcccatcaatgaaagcaggcctctaaataatcacttgccgctacttccagattctctccacagaagccaaagttgatcaacctttcgtccaagacaaatggcttacagaacaccactgaagcccagctgtgtgaaacaaaatctgattttgagctctccttttccggtaccaagacccacactgtccttgcacaggacaatcagccagtcattgactcttgcccactttcaatatgacagatttggtaaaggaaggggggttaagggagtggcccaaatcctaagtgcctttgcactgtcttgttggtctgagctcccagaaggcaagtgctgggtagccctgctgatcacacatggctttcagaaaccatttaatacagtggagctgactgttgtgatccttgaatcttgctagggttcaatcctatatccatagacactgaagacatgaaaactggctgctgctttcaagaacagtcagttagaagggcatatttcaaagctacttcaagccccaggagagggctgattatcactaaactgacaacaagagtgggtgtgatatggtgaaaggccacagccattagaaacacccagaataatgagattcatatcctgactctgacaggtactacctgtgtgactttggataaggagctgaacttctctgcaccacactttccttatctataaactggtgcaataacaggccttactgtatagggaaactgtgaaaattgcgataaggcagagtaacagatacatggtaggtatgctgatggtggcagtcatcataagaatggcttccgtgtattgggtgcttaccttgtgctcagttcactgctaagaacaaatctgttttctcatacaatcctcctaagtaacctctgctattaatcccattttatagatgagaaaactgagattcagagaagtgaaataacttgtccaaagctaggaagtgtgaatctagaactcaaattcagacagtgtagctccagagactgtactcttaaccaccatgatgtagtagttttagtaatgacagaagtagtgcagtaatgatgttaatactaattgtactattgatagcaatcgtactgtaacagcaattttgctaataagagtaaataagattaatcgaactactaagaataattattagtatcatgatttccacaacagcaacatgaacattatggaggtagacgtcattgccattctcccttaagagggccccctgcttgcttccccagggttggtaatatttgctgcccatgtgtgtttaagccatttgagcccagacaagacagccagattcaggttgtgctagaaggagctgtcagcacaccctctggcttcttcaagtcagacaactgctagccaccatgagggggtccatctggtgccaaaatgaattttgaaagacaggcaaacaggacaccagctatgccagggagaaacagaatcaagggagcagaggatcttctgcctcaaagatgagctggggcagggcgcctgtcagcagcccatcgttagcacaaaagctatgccgggcacacaccagatccctgttaccctaagctggcctgtcacttggcatgctggcagagtcccccgcctgccccctcaacagtggatcacttgctgaaattgaaagcttgaccatctgtcgtggggaagacacggccatcaactggtgcctgaggcctcacacaagcccttatgtggaaaagacgctctgaagggccagttcttttggggaaagccagccctaccccagagggagcctcagaaattctttcaaagttttcccctaagtaaaagccaagtgcctgaccctttcggattacagttccttaaaggaactgagaggagttagaaggaggagttaaaaatatccccactgagagacagacatggcacacgaatttgggggatgacttatcaggctaagtttataaggcctttgtaaaccgggggacatgtgcacgtctgctggcctacggagaagatctcagattccgagggggcttttaacaaagcagaggttattgtaactcaaaacctcacttttgtctaatgaattgctgcattttgtgaggcgggtgtgtttgataaagtgttgtcaggagaaaaagtgtggcagccttaccccaactgtgggaaactgacccacagcaggacaaagcccctattgaccctgtagagttccaaggagttccataaactccaggaaacagcctgaccaggatcaaactcctttttaactcaagccttttttttttttttttttgagggggaaggaaggaggtaacgagaaactcgacatctttctgttaactttcagtacaaataatatcatcttgtgttcatgtaatgcgttaattattcagagcacttatattcccaatatctcactaaatcctcacggaatttctataaattaggtgcaccaggaattatcaaagccatttgaaaggcaagaaaaacaaagacaacaaaattaagggatttatctacagtcaacaaccaatctcgtaaattgaccgaaaggactagtcatggtatgtgttttccatgaactctaggattttataagtgatcttaatcatcacttagtctaacctcctcattttgcctatgagaaaaattaggcatcagaagacatgacaatattcacatagttagtaatgaatatcagagctggaactataatccatatgtcctgatgtctagttatataattttcccaacataatattagcttctcaagccaatcctgtaagagctgaatgcctgcgctcttaaactgtttagtctactacctcaaatgggaaagtgacagtcataaaaccaaaaggtgacatcctattaaaagttttatttgggttcatcaatcaggccagtgtaggacattagcccatcacggaactaactgaacccaatacaaacatttgtagaacaaaattgcttgttcaatgacatacctgtatcaccttttaccaaccaacagatattagtatctagtttgagtagctttcatgtgaccagcacggtactcaagaccaaaaggcacttctggactcccccaaaaggaaaattaattcaattagtcagcaggatctgactcacctacataaggatataaaatttttaaaaaatcatccctgcatgcatagtgcccggcgtaagacctagaacccagtggtttttcagtaaatacttgctcaactaaatggagtctagggtctgcaagggatagaaataagggtgtttttacagtaaagacagcagtagaatatactgggcaagagcttgcattggagctaagagaagcctgagtgaatttcaacaattcctgaacctcagtggcctcattaaaacatgagaataatagtacctctctcctaggatcactgtgcagctttcaccgtaattttagctttactccttaattaattgggtgactttagataaattatttaacctctctgtgcctcaattttctcatctgtaagatgggaggaacatcggaacctactttaaagagttaagagaattaaatgagttaacatatgtggagtgttgaaatagtacctgccatagaggaagtgataattattttcttcatcatttatccctggcaactgctcactgcctagcactcagagatgttgagattttcagatacaaaaagtattcttcactctttaaatgttaaggtcaagaaaagaagcaaagacctatgtacccaatgagaactataggtttcattgaatgacctacaaaaagaaaaaaaaaaaaaagaagaagaaataaccaccaaagaaagataataatgactacagcagctttacccaaaggctaagacacataaaggaaaggggtagtgccttaaatcgtggagaactccagccagtcagaactgaagggcacacacagtaaaactgcccattaggcaacagcttgtacatcattaattattatgtaaagcattgcaatcaatctgggctgagcaggttgagtttttacctcccccaacccaaattctgaaaaatcacgtttggatttttgcagctgctctcataatgtccatgctagacaggaaatgcatcaaggcacacctaaactgagacacaaaacctacatttgcaatcttaaggctcctcgaaagttcctcttgacttatgcctgcagatggttatgtggcagatgatccttcccgcagatattcaggacacggagacttgctctggcccaatgcaggaaacagctgtgtggaaacaactgtgggttcccttctgtgtgaagttcaagctgctcccaccccacacacactggagggtaaacagcaaaatgcctcatgattaaaaggacctctttggaaaagttgtttccatagacggcaccatcacctttgctttgaaaaagaaatgcagaacctcctgcctccatgtccaagcctactgcccagaaatagccaaggaagtctttctaagagtctaaggattatctcccaaattgaaaatattgaaccaaaaagcacctatccctacccagcccacctgagctgccaggggctttatccgaaggtcatcactacctcctggtagccttcaaagacacagagctctgagaagaggtaaacaagagtctcaaggccctgaaaaatggatctcccttgcaacagagcaggccaaaacagtgagaaggagaaaactctattttcaatgtcaaagaaagcgttttggttcctagcacacagaagtagttgtagagtacagttcatccatgtgaaaatctgatacccataaggctgccaaaatcccaggatgccacaagggcaggctgaggaggctgaacccatgtaagggtaaaggttgctcactgccgggctgacttcctctccttttctgatattaacatgcattcctgagagagaccctctttgacttaagcaccaatcattctgtttgagaggtggggtgggcagaaaggggaggaataagatcctggagggaattctgcacagatgaagcaaattctctcctctctccctgcagtggagggtggaatggtaccgagttgtggcactatcttggggatcccagggggagagcatgtggctgcccctattcttggccactgatttcaagaagtttaccttttccactggccaaggtcctttagatcttgggcatttctggaaagtgttctcagcctgaagggatgaacatgatcaacctgaaaagcattcattacctcagagctcagagtatgcccttgagggaagggcatcattagtggcaagaatttaaaaaaacaaaatggttttgtcatagcacagcagccaatgaaagaatttaaaaatagttttaaggaaaaggacgcactccacgtaggtctcctcatactagaagtcaaatctgaaaggcaggaaaaagtcttgagacagtgaataggtagaggacaggacaactaaccagttgccaatggggaaagaaaaaattacaatttcttagaaatgacacagagaagggaggttagagcaagggggctgtagcttaacactgacttctggctatctggcccaacttactcccctagcaatgtctgactggaaatttaagagagaaagaattctaagttcatgtgtggtagagaagatgtttatcctcacggatgttcttttacacagattactcaaatgccaagtgtttcttgccaaaacatattaaggtgcaaactctggccctgggcgaatatttgaagtcatcctaatgatttgaaatgtggcagaaatgaggcagatcacaaaaccaagtgtccgtctgtccttcttggaactggggacagactgaggacacatttgttttaaactgtttccattacaaggaaccaaatttctactgggaatcatggccacagagttcctgcagaccaagggacaggttttgagcaaaggtatcaggacttgcacttctggattactggtgtaaatctttccccaggctgaaaaggatgcacaggcaggtggcaactttgcttcagtaacagcgacccaccccacaaagccaagcataaaaaatgaggcagaaggagcctcagctcctcaacttagcagttactacagcaaacacaagcactgcaccatgtgtaaggccgtgtcctgagtgctttgcatgtatcagtttactctgtacaacagtcctatgagattctacttcttttctcattttacagataatgctaccaagaggtaaggtaatttgcccaaggtttcccatctagtaacaagtggagctgagatttgaacataggcagtttgactccaaagcccacatccattaaactatattctttacatgttatatatatatcgtgggatcattgaccattctggttatattcttattatcatcaccagattcattcaaaattacaactgaagccagcataatcatttcactagaaatgccaacactttcactagattatagccaattataaattttaatattttttgagtttgctcccaaccactctcaccctatttgtgatccctcaaatgcattttaaccataatgaaagaccagtgggtgatctggtaacagaaccaacccaaatatggagaacagtggccaaaacaaaaccaatgtaatctgggtctcttgggaagtgtcaatgaacatcaccataaggattaaattatactatatgtaattatgatagtcaccagtcactacttttgtgtgtgtttcatgcagacagaaagccaggggttgaaaatgaaaggctgttaatatctccttgttcagtacatatgtgtttagcattttaaagcagattcatttagaatctcacgttagaatttcacttttcccttctaaggactcagagggtttcgatattaacttcccctgtggaggtgacagatgtcagagagagatcaagaagttcaagtccacagtaactgaggcatacagttctgcctggatgctcaacttatgattcaagacttcaaaaagtacaaatgttcgttgtcacacattcattcacttactcaaccaacagacctttccagagagtccaatatgtagtgatgcttctcattcaataccaattttactaagagcaccatgattttggttcaagtttttctccaaaagaaaagtaaaaaagaagacaactctttacattcaaattcccaggaaaacttttgactcttaggatgatagagtattcaagtaattgccaaggaagattgaatacttttaaaatattaatcagttgtggctgttctggcaggggctagatcagtgaatctttcaaagtccctaataatgccaataatatgctctcctactcttcacttttcagcattctttgctaagtcacaccaagctacatcctgtgccctgaacatgaaatctccttcctgccttcaccataggctgcctccctggatctgaaatgcctccctcactcccacaccatctcagcttcccatcatcccacttatccctccaggtgcggtataaatgtactgagctcatgaaaccttcccagatacccagagctagaattaatccctgccacctacactctgttacagcacttgtcacacttggtcttcactgcaaggcctgcagttgcttgtataatggtctgcccctgcaagacaccacggacttctgatagtgcctttccattcctgacagctccttgcacagctgtacatgcaaagcactgaatacacagctgacttaaactacctgcaaatattaatggcagttagctttgaattatagcacaaagattatttctttcttctatattttctgacttttctatgaataggcactactttaatgaaataacaaacaactgcattgtaaaacttcaagtgaatatcattcagcacagaacctagggatgttggccccattctacaaggaataaattaggaactaaagattacgagtggctttctcaaagtttctatgctctaagatttaccatttaactcaaatgtgaacagttaagagctatccatctcacactctgtaaaatgtacatcatttattagtttcatattgcataattcatacatgagtatcaactgggaaggctccacaccattggtgtccttaacttcctacttaatattttaaactttgatgttgagaaatttttatctccaagttaaacctgccattgttttcccatcattcaagtgtaacccaaaggaataaaaggccatataactaaagtctgtttagtttcttctccaaaattctacagaccattctgttgacttttgttgaaacccttagttaaaactcttaatgatttactatttcttcattcagcctattttcttaggttatctatttattcattcagtctgtccttattcaataagtatttactaagcacctactttgcaccaaacagaaggcatacaacagacaacccagtcccttcccttgtgaaagttcattgaagtacagttctcatgctgtcttcatcagaattacctcagaaacttgtcctggcagagagaaagtaggaactgtatgaaaatttctgtacgtactctttcctgtgggatgagtccacttggaccagaggggcatttgaagaattttgatgcacactaaagcttgagaattgatagctagttgattcttaaaattaataataccatactatgtgataagtgaaatgatggagctatataccagaaattgtgaattgcctgggcatctcatcatgtgcaattgaaattcagcataaaaacttaagtagggccaggtgtggtgactcacgcctgtaatctcagcactttgggaggccgaggcgtgtggattgcttgaggtcaagagtttgagaccagcctgaccaacatggtgaaaccctgtctccactaaaaatttaaaaattagccaggcatggtggcgggcacctgaaatcccagctattctggaggctgaggcaagagaatcacttgaacctgggaggcagaagttgcagtgagctgagatggtgccagcctgggtgacagagcgagactccatctcaaaaaaacaagtcaaaacactgctgagtagaaataaaaataaaatttccccacccatcctctcttatcccagcacaagctgcagggaaagaaaaaggttcctagccagacatgatggctcatgcccataatcccagcaatttgggaggcaggcggatcacctgaggtcaagagtttgagaccagcctggccaacatggtgaaacctcgtctctaccaaaaatacaaaaattagccaggcgtggtggtgcacacctgtaatttcagctactcaggagactgaggcaggagaatcacttgaacctaggaggtagaagttgcaatgagctgagactgggtgacagagtgagacgctgtcaagaaagggaagaaggaaagggaagggaaggggaatgggagggggagggggaggggaggggaaagggaagggaagaaagaaaaggaagaagggaaggagagggaaggggagaagggaaggagagaagggaaggggaggaaagaagaggggggagaagggaaggggaggggggagaaaggaggggaggggagaggggaggagagaggggagggaaaaagggaaggggagggaaaaagggaaggggaggggagaagggaagggaaggaaagggcagggaagaaaggaagggaaggaaagggaaggggaggggaggaagggaagggaagtagggaggagaagtaaagggaaggaaagggtagaagggaaggaaagaaaggaagggaagagaaaggaagggaagggaagaaaatggaaggtaagggaagagaaaggaagggaaggaaagggaaggagggaagggaagggaatagaaaggaagggacgggaagggaagaagggaaaaggagaagaggggaggtgaagggtgtggaggggtggggaggggaggcaggggggaggagaggggaagggaagggtaggggaggggcaggggaaggggaggggaaggcagggaagggtggggaggagggggagaagggagggaaggggaggggaagggtggagaggggaggggagggaaagggtggggaggggaggagaggggaggagaggggaggagaggggagggaggggagggaaggggttcttgtttgcgttagaaagctgatatttggaaactttatgcttcaaggaaaataaataaactcacttttcaaccaaaaaaaaaagtacatatagacaaaagggatcagctgaaaaagctattccccaaggtgtggggggtgggggacacagaatcttgctaaggatgaaaagtattttgaaactattttaaataatcattacccttttaatattcaccgcatctgtctgttcacttttcccatcataccctcccttgtcccagtctcagcatcttcatgtgttgcctgtcatcccccggcctcacacatcattggggataatgaatttaatttgagcaatggatttcattgaaaaaaaatctctgcatcccaacatgccacacaagctgagctcagataaaaacaagtgactccttaatttggatttaaacctcaggaccagtctacaaataaaaatgaccagcgagcatcatgcccacagagcactgacaataatctcctgtgctccaaattattctagtctatattatagacgatccaataagcctgtgtgttctagtccataaaaatataagaagaaatttatcattttgaaatcataatgcaaaatagagtctgacactttattaagcactatttctcatgatatcataaggatgctgatggaaaatgaaactaaagcagtatcagagacgaacaatgacagcatttagactttctgagggtgctttgtagctcacaggtcactcgcttgccctccccgcatgtcacttttgaacagcttcagtttaaacctgaaacactgaaaacataattctgaaaaaagctttcattttatcacaaaattggttgatcatttacaaaaaaatgctggaatgggataagaaatgatctaatccagatattcttaacctgcagtcagtgggtggtctacatggcatccgtgatcaccccaacattgtatgcaaacttttgtatacttgttttcctgtggaatgggtccagaggcttcagaggacaggagtctgaattgactgccagaatcctttttattctgttttgataacagtctgctattctcttttttagagaacaacttcgccctcactcaagagtctttacatttcagcagcataaactcattccacacttggaccaaagaggcacttgtgatttaggcctggccagtcagagtatcataacccccaactatatatctgctttagagactggcatgtgacccaagtcaagccaatcaggctctatctgagctagtctcaggatttttgtttgggcggctttaaaaaaagagatggaatttccatttatgagagttgaacccaaaaagatgtgcagctggggttgctggaaaattcaatacatttgagatgaatctataatagaatataatccattcatattccaccttgtagagatcactggaaaagtgagctttcataggtggggaggagagaaggtaagaagagcttacatcatacaatgccctccaagaaagataaggagaagtggagaaggaggtgtgctgagagggtggcaggagacgagacagtctcaaaaatgtaagagagagaatattcaatagagtgctggtaacttttaggctccacaacttcaatattcttaagtctatcacatgcacacgcgcacacacactcacatacacatacatttatgtatatattttttatttcacatacagaattgctattaactttcaaaatgatagaagcttttaaattcagagtctcaaatgcagaccctacagagcccaggaaggtcaatcaatgagtgaactaggctgcatgtaaaaccacagagagtactgggaattatcagaactcaagagtcaacgtcttgtcttcagggacagcttgactcttctccagccgactgactccacagggcaatatgggtacagtgttgtcagaccctcctatttgaagagaagctggaaatgcatattgttaagtgtgaaatttgccaatcttccaaaccacagaagggccagacaaaacaaatctggtagagggatgcagtttgcatctccggccctaaactgtaataaccaaagtggcagcaagtcatttgtctgcaagactagggcagggtcactttgtgcccattttaaaataaaaacaataacaaaacaaggacccctgtggctacactaaatgggactcctctcattaaaaaacaaacatagttcttgcttttgaagcaatggcatgttttgtttggttatttttaaggatcgcatcacttgaaattcagatgtagtcaagcttgattttctcccagacctttggcagctgacgggttgggtgaagggagaagttgggaaaagcatctggtcccagaagcaaaagtgaaggcagtgcatatttaccagcatgaggctgtccacagacagtgaatagagacacagggaaaacctccaatacccacctgttcacagctggatttcccagggcacttaatttaatcagaagcagtaacttttagtagcattttacaaccaattaaccatgcaggaaacaaaacaactgactcggtgccttcctccttgcttctaaagagactgtggcctcaaaagtcagcaatttggaactctctgtatgaaagaagacgccatcaaacccagcacaaacaagttttttcccttcctacatttaatgggaggacccttgaatctggccaggccttgttggcatgggaatcactcccattttcacataaagagctcccattttggtcagcacatgccaggcactgggcatttacacattcattctaatgaattcttaccaccaccccttaatgttagggcctactatattcccatctacagatgaatgtactgaggcgaggggaatcagtaaaagaaccccaggtcacatataagtgaaagaaccaggatctgggcccagaaaatattgttcataacagagagcaaaatcttagcatagaactcactgatttcccctgcagcgagttaaaagtaaaaccacgtgataagagccagcttctggtattaatgaggataaacttccttgtatcaaaaacaggtattcaaacttatgctaaattctataggcaataattttccactaaatcaataacaattttttaaaaacaggctataccttttaaactgtgcatcactttaaaaaatcatttctaacttttctttaactgatcctcacgaaaagtcttgaagtatatgacagggagtggataaagtcacttccatttgacagatgagtctactgaagctccaagaaatcaggtgacatggtcagggtcacccagctgattagtggcagcctctagttcccattcgtgagcaccccagccatgggggctacttttcacatccacagaatgccaagctcttccccaccctgggtcctggagggatttggccctagttctctcccacccttcaggtctctgagatgtcatctccccaggaatgtcttcctgtatcctacctcagtgatccccctctcattccccatcatcgtcatacccagatcctattacggtgcttggcatctggcagtcaaatatttgctaagtgaatgagtaagtaagtaaatgaacgcctgatgaattctcaactttctgaattttctaactcataacagtgactatgcatcaggactttctccccagcacctctggtcatctgtagcataacacatgaaaacaaatcctgccccagcaatacttaaggacccacctgctgaaacgagaccatggtgggacaccccctgccctgctccaaacacacgcacttgttcttcaatgtctttctcagttgactccaggctagattcttaagcatggcaggaagagccacacaaagtggaggatataaataaaaatgtcataaaacaatagtttattaaaacaaagtagagagtcttcaaatttaagaaaagaagaagctacaggcaggtatagcaggctacaacagagatccttaattcttctctgagttttcatccctgtctctggggttcttctgctgatggctaccagatgtcagagaggggcctctgagagaaacctgacacaatcccgcaccccaatttaagccaagaggtgtcgtgagagagcactgggtctgcttgaacctagtatgtgttccctctcaatgagtctacttccaaaaccattccctgaacgctgagagtgttttgagtgttatttttgatatggaaggctcttctcttacaaagataatgatgataaattgttctcaaagtgaacagcctgggaaaatatgggattttatgtatgtttccttgaattatggaagcaagtttgcctgcacactctagtggtgtggtgattcttagccaagatgactcagaataccaatttcctttgatgatggttgattcttttagaaggaaagattgctccaaagtagcctaactgaatactttaccaagtgctaggctttagaaaaataataatgagttaagcatagctaatgtttatactacatttagtacatttttttagtcctcacagcaaccctacgctcccccatccactcaccctgcctccattcctgtcccagggcaccaggtaagaaaccagctgaatcacagggagatttagtaacttgcctgccaacagatagctcatggcagatatagacaatatttgaacgcaaagtctcactagacagcttgtgctcataagaactgcaactgggctaagaatctgggttccctttaccactgtagggtacagcaatatgcctgcactggcagctaccatatttccctcagtccttagatactgcatggtaaaatctggcaacatgcctatctattttttaaaagcgagaaaaaacaaaacaaaacaaaacaaacctttcttctgcccttgaaacaatcacttccttcctttgtgatctggaacaaaactatctttgccatcttccgcctcctactctctgccacagagattatgttgatgtgaagaccaactgtgttggttagatctaaccctgttagatccttctgcattccctcagcaccccttctgcttggccaactcagtagttttgcaaatgctatggctctctcctggcaaactttctcttcacctctcccatcccttctcacctgaacaacacataatcccatccatcaaatatcacatgcactgggacactcccctggctgtcccccaaaatctctccaaactctctcctctgtgcttctgctacaattattatgttgcaaaatatcaagtttcatgtctctgttgcccctaaaaacaagttcctacccattcacaatgacataaatgtttgtaagattgaagtcccgaagaccaaatttcactcacattccaagtataatctttttggtgctgttaatcattggactagaatcctgcactgggctatttatactctttgaattgctcacatttcttccctcaagaactaagcaaaaaaaaagtaagtgtaagtgctttcgtgcctcaagtaagacagtccattcaccaagagtttcatgatggtgttgggtagcagttttccatactaaaaatggagacggggaaaaaatccatttaactttgatttcttgcttttttgctggaaagctttataagttgcttcttggtctcacctagtagaagggtcactgccttagctgggattgtgacaagcctctctagaattagagtactttattatcacattagtactggaaaaagtcacataattaacagaatttatcctcatttactctgcaaaatcactaatattcaatctctctgcctctgtttaattactttccttaacacaacttttttttccaagttgacccttcgtgggctcatctgcagaaatgtgttaaaactttttctccctctcctccatttaagtggctagactttattcatttgaataagcataaaaggtgcaccataaggtctgtcatagttcacacaatgcctttgaattagcagccgtgacggtgtcatgcttttgctggagatcctctgttcggagtaagtgatgacagccaccagaattactgttaattgtaatatgacactggcatttcaccggctgcatctagtggtaaacttgcattagttcaggttcctaagaaatttagaagctgagacatggcaattcttcaaagagaacagcagacccgcctgacacatgctgccttctcaggtactgcttcttcatacctgcttgctcaaaagaatggtaaacacacacacacatgcacagacacacttcaaaataaagccacctctggataacaatgtcatcattagataacaaatctggaaggcactggcttgctctgaagactgcattctcctcctttgaagcagcaaagtataaagtaaagaaaccaaggcttaagggacaaacatttagtagaagctgaataatcccatccatcaaatatcacatgcactgggacacttccctggctgtcccccaaaatctccccaaattctctcctctgtgcttctgctacaattattatgttgcaaaatatcaagtttcatatctctgttgcccctaaaaacaaggtcccctttttctgaaacatacatttttaaaacgtgcctctatatttcacatcaaggcagcctgctccagaagatgggggctcagaggaaaggaagaggggcttggcttgaacagatcttttggtgtggaagtagttggttcacttttcagggaaggtaaagccctcctaatgaggtcaggggtggggccgggtgagtgacagggagacagtgaacaaaatgggcagctgtcttggctccttagacagtgagctttaggagtagaggactcaggcagtctgcttctgcccgacatccatgggtggtctaaaagactttcaccgcaatcattgccagccaacaacatgtttatctaccaaaagaaaaatcagcccctctccattttccatacaagagacgcatctcaatgttaatgtgaaaaaagggccagtaagagttcttatctgccctccctttgagtcaagtgatatgcatttacattggtctttaactcaaattagaatcactttgtggacttcatatataatatggcccatgttcactggaaaatcagagctctctctgacctccaagctttagctcaaccattccttttgcctgtaatgcctttctctcccttctaaagaccccctatccttccaggtctggttaagattctccctctccccataagacttcccagattttcccattcggagttgatatcacttctccatacaactgaggtgtccaaagtctgtgagtgtctttcttacaattctgaggtcattttacactttgggtatctgtgcatgaatctgatggcttcatttggctgtgaacacctagaaggggtcaagagggttgaggctttgctgaacctcactgactacacttgggactatttctggctgaaactaattcacttgtacctccaaagctgcccctcacttaacctgtggtcaaacacttcatcattttggccccggaagttggccacttcccaccttcaagcctctgtgcatactgttccctctgtctggaaagctgtctattgcaaggtaatcgagcccactcctcaagccaactccaaatccaccttgatcacattggccagaacagcattatctaaattcccaaggcttttgttgatatctcatcggtcacttattaccttgtactttgcctatctgcatttacatttcatatctggccaaccagattttaaccgtctatgtgaagggaacgtattttatacaatcctgtttcctccacaatgtttagtagaatcttgtttatacatcaccgtttggtgaataaatgaacattagtctaatatttcactttgggatctccataaaaataagacaagtattgatggatacacttccacagtactgccaataaacttctagttccgcacctactaatgatgctatcaacatgattacaattattcttatttttaaagttaccattatttgagtgcttactatgtgcaaggtcatttgctaagcactttactaacatcatcttattgaatgctcacaacaaccctaagatagtaactactaaggtagacactatcaatagtccatctgcctgagatcacaaatctagtacttgcaagaccctggattcaaatccaggtatgactaaggccaatatctgtgttcttgttcacgacactatttgtagccacctgatcatgctttggaaggtattcacatatgtgtgaagaacgcctactcaccctggcttctgacataagaatgcagatctggggtataagtgaccccactcagagtgtagagacaagccaccaccatgtggacaggagccacctctcacgatttccactgagataggacttggctgccatcttggcatggttctcttcagtgccactgagcccttttcacttttagaaggacaagaaaaccctcactgcctgcttttctgagccaacgtggtcagcttgaattttaagaattgttgcttaaggtttggtaagacaaacaagtgacattttctgatggctcagactcttttgctccttctccccttcagtccaagcccatggcgcatcttgcgtctctgttgcatgtgtgtctcggcgcataaatcccttttgcctcagaactctgatatcgccatcatgacatccacctccagcaccctgcacaagggtgagcgtgggcctctaaccatcagctgtttcaccatgtcagtatcacagggagcaggacacacattccagagctgggtagattaacctccaagacgacactcagttttagctttagcctccctaaatcctcaacaaaagctttaacagccagaactgatttaggaccttaactgtaaatctcctctcttctcatgcactcactaaaggggtgatgagtaaaatcaactgggaccttttctggtcacttgtcccctgtgtcccctggaggattcaaggtgatagctaagaacccgcattatcaagaatcttactcaaaggcaggctaaaaaaaaataaaggaactggaaggtgaagagaaacattattaatggcgtctatcaaatgcggatttgtgaaaatatcattcatttataaaaatgaagccaacctagtagaatgttaaaaacagcagtaaccgaatgtacactcaatttttagagacttgctgatcagcaatggagccctgccatgagaacacatctccttttcactcaagcgaggatctgcaggggcattttcaaaagtaaataaatgtccacaaagaacaaaaaaagatcagtagagaattgagtctctcaagaacatccctgacaaaataaaccccatgtttatgtatgctccctccattggcctgagccagaaatgttccctgcaacttgaaaccaatggcacaggagttgagagaaatgtccggaattagcttagtcaaatgctgccttcaattaatgctcctctgctgcttaatgagatcccagggccaaagcagtttagtttgactttagcagttcccacttgttttggccatgatgcatcaccttgccttttctttggttatgtggcatcttacatagagacacctctttaaaattccaagtggcatattttgaaatagtgtctagatttttttcttataaaggttgatttattgtaaaaaaaaaaaaatgtttaaaatccaaaattcatagataaataaaagccacctgtatcccattttgtctcaatctcttcaagtacatacaaatttaataaccatatacagacactatatccttttttatgttatttcatatcttcaaaatattgttttactccataacatttcatcatatacagtagacattcaaatgatctcctaatgtttgattactttcaaatttttttgctatgataaataatcccttggtgaacattcttgtatgtaaaattttatctgaataaccaaggattgccttaaaataattaacaagaatttctgagtcaaaggtggcagattgctggagatggagggtaaaatagtttcatctgaaaaaaaaatgttggcaaaggtcaaggtaacttcagattcagccaaagtaggctgggaaaacttcaaaaagtggcccaatggtgtaaatggttttgataagttgggttccagggacatccaatgtttattaaaaaaaacaagaacacacaaacaaacaaaaactccagtgaagcaagcagcacatattgcatatccatgatccaacctgtcttcacctgccattctacaatgcattgaaacccatgacagtgtagtcaccatcttggactagaagtaactacaaatgaaggctatctcagagaagccccctacgtgccactatgcttgtcccactgtgcctgctacagggctgagaaaaggactcaactacagcaaagcaagtcaatattggatacagtcaggttttctacttggcccatgctaccaccaagataccatgtccaagagtagggtgagagaaagctcattttttaagcgatctctgcttaaagtctgaatgaagttatatcctccctgagaaactgcatcctttgcaaagtggacaccatattgtgaacttaggctttaaggaaaattcaaaacaagtgacctacaatatgattatcattttcttaaaattatacctggaaattgttcaacaagaacatctgctcaggaacagcagtccttcattagactcacattcttgaacgattgaattctacagaccctgactttgattttgaagactttttgttttcctgagaggtcagcctcaaatacaactgctagtgactcaaattatatgtgatctcttctcactgtcacatggcataaagtccaccatttacaatttggcaccaaaaacccagtcagctaaatctcttgtcccctatcctttatgttcctttatgctaaaggtttgtaaccttcatgcttatggtttggaactctaactcatttgatgtttcctaaactctctgagctctcttaagcctccccccatgtaagtcctcacccctgcccattcctggtctaaaaaatctcctatatttcaagaatgatcacaactcctacctctccctctaggaagccttcccaagttcctcccgacaggaatagaacatcccacctcagttttccaacggcacactcctccagaaccacatctgtcacattgctctatgactgccacttaccaatctccccggaatgagagagtaagatcctcgaagataacaaccatgtatgttcatctctgtatcctcagaacctgagatagagcttataaatatctgcttgattccggaacaacaaatgataaaatgctacctacgattaagaaataattgagaatccaaaataaagtaacaaagaccaagagcctgaagacactctagctgtaaaccacgtgtgtgtgtgcagagtatcatggcttattataaaaaaaaatatgctggaatgtttgcaaaaccaaattgtattaacaaaaaacatctgcagctttatactgtgtgaccataatcttgatttttttcataaaatgcagaatatcatttataacaataaatacaaactctataaagtctcttcaatataactcaaacctttttctttggtgtgctctaaacatattttacgtaaatgatgccaaagtctcatgaaaatatacagaaaccggaagctcaatggcagcagatgcagagactcctcacagagttactgagggggtaaatagaatctaactcaggggccaggtgtggtggctcatgcctataattccagcattttgggagactgaggcaggtggattacctgaggtcaggagtttgagaccagcctggccaacatggcggaagcccatctctactaaaaatacaaaaaattagctggttgtggtggtacacaccagctactagggaggctgaagcaggagaatcacttgaacccgggaggtggaggttgcagtgagccaagatcatgccactgcactccagcctgggtgacagagcaagactctgtctcaaaaaaaaaaaaaaaaaaaaaaaaaatctaactcaggggccaccttagatatgaagagagtactggcttttaaactaaccgagatctgacactggatttacttaaaatctcaaatagtcttgtctttcttacctttctgccaagccaaaggggcaagggaaactgctgtaaaaatgaggtgctcacagactacgagaatgaggaataaatattggagttgtctagagtagcttttcacccaaagaagggatccattccgcagtgtccctgacaaatggttgccccagtagttctatgcctgttctggttgctggagtggagaagataggagagcactctccctccaacgactgactttctagtggggaaaaaagacaaaaaacaagtgaaagactcacaagttaaaaaaagataatgtcagttaccgactccagctattagaaaagaatggatggcagatggaaagtgatggttcctagaaaggggagaagagaagatcttggaaattatgatatattggctgggacttgaagggcaagaaggagcccagccatgccaaaacccagaaaagcattccagttagtgcaaaggccagtgtggctgcagcacagtgagcgaggagggaggtgatgcgacggcagttccaggagaggcaggatcattctatctctaacagagagcagcccgtcactgggagatggtccttcccatatgagctggacagctctgccaggaggtgccctcttcctgagaactgaattcttccctcctatcatttaccttcagaaacttcagttttgagctcgggttcagatagcagcattacatctcctccttccctgagacaacccaaaaataatttaaatcagagaaaccggcccaccttctcttcccaggactcttttccaggataaacctattttagttatccaccccttcaagataggattcacaaacccttcccatcctgttcacccttttccaaatactctctgattagccaacacccctcctcaattatgccagaactgagcaagcctccaaaatgttagaggcagcacagcaggttggttatgacatgaacttggtttaaaaaggttccagtctgggccctaccacttatcagttgtgtgatcataaccaagtcacttaacctttctaagcctctgcctccttatctgtaaaatgagaactatagtatctaccttgaaggattattgtgagaaataagtaagaatatatatgaagttccaagggctgtggatggcatatagtaaatgctcagtaaggttaagctagtacaaatttgatgatgatgataatggtgataatgggatcacaatcatttccatcttgatctaaaatctgcatttgttcaaattcaagtttaagatatatttgttgtgccgtgttgtgttgtgtttgctgtagtagagtaggggaatagcagccatttacagttctactaaaacttttcccccagatcttttgcatataatacaatcactctaatctgatcacagtaacagagaaagatcaataaagaactaaaccataaaattgggtacatctaggctccaattactgcaggaatataaccatgtccgtatcacagagataatgctgcaaatacttaaagaatgtctgcagatcaccttcctggaggcaaaagaaaggtcttattcaccatcgttggagcaaatacgttagtcctcaataaatactagtaagagtggagaaaggaggaagtgagttagaggttgctctaggctaatggtatcacatttgatgatcaaactcacacaatgttagatctcaaggggacccaaatgaaacatattataggcatggaaatggaagctcagaaaggtgaaggcacttgcccaaggccacaaagctaacttgggtcagagctgggtctcttaatctcttcccagaggccatcctaggcaaaccagttgcagacctgagtccctctggacagggcctcttgatctccttcaaagccttcttgcagaaatgtcctctgagacaggagaaagtcaggtttccccatttccatggtttgtaaccctaactcatctgaactgagagatccttagggagtagaaagtcaaggctggcatctccaaagctgcataaatctctcacctaaggaacatcatcatttttctcttgtcacaacccttccagcctaatatttgacagctctgatcgggtactgtccaaacatttattaaaacattttaaatgatgaatatatccaattattactattaatgtagctaatactgactaatgagggggaaatgcaggagccagtgtcccgcaattcattacccctgccttgtcaacaattcaaagcccgaaacctaatcatccataccgggccctgttatatttcacacgtcacttttaataagtcactcagtgcctataaattaatgtaacatgtcggcgtttatgagtgcagctttgtcgccgttaacaaatgatgttctggcccactctacaacagctaggcagtgacgaatgatggaagatgatttctttccaaactataaactatacactggggactccagtaatatatgtatatatatgtatatgtatatatatatatatatatatatatatatatatatatatatatatatatatatatatatataaagccacatagtgcatatgtctaagcacatacagacataccacacaaactaacaaagcatgccaacatacacagaggcacaaacatggaataaatatgatgcataatttttcacaaagagctgtgcaatatcccctgtactttcttctctaaaaggttaaacatgcagcactaggaaccatgacagtcccataaaagtggtcaatgttaatttcaaatttgttgtaagttctgctctattgtgcctggccaggtttcaggatagcctgacatcccagctaataatggtgtcaatgaaaggagagggttcacattacgcctagaataccagtaattagaggaagggcctgagtttttatgacaaaattggtggttgttgggtgttgggttggaagaggttacttatttgcttctaaacagacctgaataatctatatcttcttctaagccatgatttcatatgtgaaaaaatcattagtatgtaatttgggtgtaactttacctccgtattttcatctaactcaaggttcaagatgggatacagtgtttctttaactggcgaccctttttttgtttctttgcccctgtcagaggcagctctggaactacagagacactttgggtctttgcacacctggattgaacaccatacacagcgacaaaactctaggggcaaagaaggcctgagatttccttgggaatcaatctgcatacaaggtcacagctctgtgggctgagttcttagggcagacaattctcacctgccttagtttgcgggaagaaaacacctctccatttattggagtgtaccaagacttccatatggttagatattttattgttaatattttctttctccctgtaatcctatcttagcttcagagctaattattacaatggacataaaaaggaacaacatttgaaaaactagatacttgaaaagtttgaagtggattttccagggttgctattatggctcctctttgatgagcattcgaccatttcagactctgccttcatttgttttttctacttgcctacaaaactcagaagatagcattaccatgtgactatacaaatcctacaaaagcttaattttttttttctctaaagactgtatatctacatctggaaattctttatgtagttctgacacaaggatttcgctcaaatatcagggacgggattcaaatcagagttccccaagaaacaaacaacataaaaaatggctcctattcattttttttttgccatattcttcattctgtcattgaattatcattaagaaataatagccttaggatttaaatgtctagacaaagattcctgttttataaacccagagtttatagagtttaattttgtgtgtatatggctgagagtttaattctttcaacttatgtgttagagatgttagagagctaaacatgctgcctaaaaaaaaatcactcaaaaatttaaaggaaattaagaagagagctccaaacatgtttttattacatgtctattaggaaagtacttgcattgcacttcatctggcagggaacatactgcccagttcagtcttttgggtttgtttgtttttttctgggatctgtgaatgtctagttcaaggactaacacccttcacgtcccctaatacattagagagaagttcacagtgaagaaagggcagtgcttttttgttatgtgaaaactgagcaacgtctgatgctcaagaaaatggcttcaaagtacggtctggagtcacacgtcacacagccacacatggtgtgcaacagtacagactagcagaccaataagtcaagtgattacatggtgcccctgtctctgggtgtttgcacaattttcatgcagtgaagatgctgaaaatgctgcatagtggtcaagggccatggcaatgctttgctggggacaaaagggtgggaatgtcataagcaaaacttgaaatgatttcaacatggttgatgttgaaagcattaacttttaacctactcttgaaaagattcaaaatgacttcatagaatcaactaacagcaatcgaaggaggtttcatgttctcttgacaaagccggaccaagaaagaaaagaaagatgatatgtacttttcctttggaatcatgaaatgtggcattcaactttttctccgtccaggactggtgttttctgcagtgtgtcacaggaaaaaggcacttggtttagggtgtgtacgtgtgtgtatgtgtgtaaaagtaaggcaaaaatggaagacaccagaactctggccgccgtatggaagaaaatgcagaatgctgtctgctctggttgctctataaagatatcaacccaggaggagacagctgaaaagtgcttttcccagcagagagggcttcacaaggcgcagtgagatccccctgggaatagaacaatttgcataacaatgtgctgttgcttatccgggaggacccaaaggatctggataccctgagagaatacaccacacttttcagtccagcccactagagagaaaggcattgccattcagtctgtggggtcacaggagggaatacccgcccccgaccttttaacatcatttcattgcatgaaatccttgagaccctcctatttcctcttctccaaacattctgttttcctatattagtagtgttctcttttttttccctaattggcccagatcctaataaacacacacacacacacacacacacacacacacacacacacgttttgttgtttgttttgttttgttttgatcttttgggacctacccaaatccaaggtctccccatccccttttcacttcactctgccttttcatccaggccagtgacttggaatcatgcatgacatattcactacttgatcttgtgaacactggaaagactgtctttattctttcatgaagataattggagagtctattctctgtgctctaggggatacctattttgtttgcctttcttttgaatgagaaagaggcatgtctgagggtgatatttattcctgctgttttgttttggggaccaggtagggaggctgttgaagaaagccaagaaaacccagagaaggcaaaactctaattccacaatatgccaaatactcataaagagcaagatttcatgctccaaagctgccactgtgtatcaacaagcagtgcacttcatgccaaaacaaagttttttttccaaagcacattggcaaggactagatttagagagcccacaacagaagtgtgcatgccctccacttcaaccaaaggcaaaatagcatttggccatgttattaaaaatacactgttcataattgaggtgatgtgaacattctgctcccctcctccagaaaggactgggcatttctggagttccaccattactagatgtcataatttaggacaagaaaataaagttagtaataggaagcaataaaatttcatttagcatctgctatagactgtggatgacattaggcattttcaaatatcatcaccatctgaagattaagaaatctggccaggtgcagtggctcaagcttgtattaccagcactttaggaggtcaaggcaggaagatccctggagctcaggagttcaagagcagcctgggcaacatggcaaaaccccatctctacaaaaaattagctgggcactgtggtactcacccatagtcccagctattcaggaggctaaggtaagaaaatcacctgagcccaagaggtcaaggcttcagtgagccatgattgcaccactgtactccagcctgggcaacagagtgagaccctgtctcaaaaagaaaaagaaagaaaaaagaatgagaaatctgaggcttgcccactagcccacaaccacatagcaaggtctgaaacctgaaccaacatctggttcacctaatgccctggctctttgtacttgtttatatttaacatagagtggacagggcatcagaggactctgcaagatcatgaggagaatatttgaaggaatatttagtctgatagagagaagtcttgatgaaacaagatagctgtttccaaatatttgaactatttactctttgtacgaagcagcaaacttacaattaaaaagtctataggacagactgggaccaaagcctgaaaattcagtcaagaaggaacactctaatacgacagaaggaaaaaaatactctctaatagtgaaggggctgccttacaagatgaattccctatcacagcacacattctagaaaagaccaggcactacttggaagaaatatcagataagtgaggtgctcatctagctgctactactttcccttcaagccttagggtctaagaccagcataagcttggagaggttcaacttctgacatgcagattgctgcagaagacaaattaagacattaaaaccaaatgccaggtagttagaaaaaacaaagttctgcatgagaacaaatctgcatgaccatcccctcctgacttaaaaaataataattaaataaagttctagacacatttgggctcccttggaaaaaaatgccatacaattgcattaacacaactgttgctattaggaatatttacctaataataataatatgtagaacaatcaaaatagggaggaaatagccagaaagtcattcttgcagatggtcacatgtctagggaggcagaaataagaaatgtttaacaagcagtcttctttaagttatgacaaatgatgctctgactttataaaaccccctggccaaggatctgaagtccatccccataggtggaaacaggaatgatagaatcataaaatgttacaatggagaacctctaattcagtcatgtctttccacagatggggagatagaagctcagatagcttagtggatttgctcaatgacgcacagttcattcattgcagagttggggccacaaccttcctcagacctagccttacgatccaggatctcttcctacagcaatgcaccaaattcatttttctagaattgaactaaaaacaaaacaaaacaaaaacccagacagcaccagcttggaacagtcaggtccaatgggatcaaagcctaaaagaaggcaggtagttaccacagcaggtgcagagcacttggtggaattgcagccatggcttttctaagaatatggaaagtcagtggaaagaattttacaaaacatacttcacaacctaattctgttgccaaaacagacactaataagtagtcaggagagatgcagtcatcccaaccccatgatggtcttaagcttccctctgcctttagactggactttcctatctacccaagtagaaaacttttggtcttttcttttctttttttttttttgagatggagcctcattgtgtcacccaggctggagcccagcggcatgatctcagctcactgcaacctctgcctcctgggttccatcgattctcttgtctcagactcccaagtagctggaactacaggtatgcaccactatgcccagctaatttgtgtatttttagtagagacagggttttatcatgttgtccaggctggtctcgaactcctgaccccgcgaactgatccaccagccttggcatcctgaagggctgggattacaggcgtgagccactgcacccggccctgtttttggtcttttctgattttggtgatagaatggaaggaaatgagaatgcaagacattcatatctgaattttaattttaaaacctgcttagcacacaattcactcttgtcaagtgaactgtcgaaagctcctaagaactacataatttattcctgggccaccacccagtgtacaaacataggcatttactctgtgggatacactggtagatgaaacaatgatcttatttcatcttcaatcatgcttcacttttcttttctgtgtgtacatttttggaggaactattagttaatcagagccctgctacataccattaattcagttcaatacaatgggtatgtgctaagctgttacaatatgccaggcactgtccctgggtgtagaccagaaatctcccagagcacattccctttgaataacaaaacaagctaatattttggctttatcaaaagccatacctttgtccagggctcttcagtcaagaatgacactaatttttttttttttttttttttttttttttactgctaatcaacattacaagatccacaatggcttaaaacaacctgaaaaccttcattcattaatgatagtcaatttctccctcaactctgacttactatagtggaaatgggactcctgtgccattagaaatgattttcatcaatacaagtgaaccttcaattagaaaagccgactgaccagaaccctagttagtggggattttactgtctaaagacaaagataagtgaattgcccaaaagtgcacgtctttacccccactagcatcttagattctacatcctctttttatgcatcactcaacccttccattccctttgactctatagaatacacagctctctagagtgattcgccacattttggcattgccacagtgttccctgaacttcaatcactcataacagcaccttcagagtttttgccatttttacctataataatattcacttaatattttatgtatactgactcatttccttttatccctaataaacttatttttgaatgacactttccattcctactatgaatgaaaacccatactacttatctgagataaaagaaagcaacataattaaaagtgaatgtaaacaaaattttaaaaatttactaaattttggctagatactgttgcctaccacagggtactcattgaaaaccaagatgaagcaaatgtgagggaggtgttaaagacagattcccaccaaacaaggactttggcctcatcaggaaaactaaaagaaattttaaataagatgatttccttatcacctaattcagtgctatttaaagacacctacaggtaccacttaaaagcatccagcagtatgtaggtatacagtgagaagtaccaccaccagcagtatgcagatcaacagtgagaagctgcgagttggctaatataggtatgggaaagctcacatcacacacataagggaacacaacctgtatgatggaaagaaggctagagagaaaatattgatcagcctaaagagaggagatggaggattgtttgttagtgatttgtatagagttggaagttcctaggccagaggaaaattcatgagtttccactggtagaggagaaaactagaatatatcagcagattatgagctgccatgaatttttctgtttttcctctttaaacatggatactgataatgaaataccagaaaagtacactctgtggtgaatctggcttttgatatttattaacattaaatggacttttgcaactaaataacaccaaaaaaagagagaggagatacaactatagtatgttcctatagcatgttcctaccctcaaataaatatcaagaatataatctatgtggaagaaagatcaagttggcagaaaagggaaaggagaattaggaaagcaaaataaataggtgcagagaaactgtcacacaagtgaattgagactcagtatttaattagggacagcaagcttgcaaggctcttggtaaatgtctaccgaaaccaaccacgtgttggttaacactgagacatacaaactgatcaatagtacaaaacaaaagggctcaggtatgcatgtaaagtcatacatcatttcaataaattacgctgtgtgtagacaggttttttttagaacgatcattctgagatcaagagctaaatcatctcagccacatcttgatttctgcaagactcggcaggaattatgaggcttaacagcattctgacaattagcatattataaatacaaaaatgatatattaaagggagaggaggaaaaaaaaggccagtgttttacacctacagtaatataattccactacttaatgcaaagtaacaggcctcagagtgtttgggatcctcttgtatggtgttatcttctctatcagtaaatgagactatgtgaacagtacaacctataaataattcaaggcctgagatggcaattatagaaccatgcacaactagcatgaatattttatgaaggctaaaacagctctcagaatgaatcatggagagatgaacacacacaagcacacacacacacatacacacacacacacacacacacacacacacaccaggcagttttggccaaattgtatttccaagacaaggcctctctttgatctctagaacacctttattttatggaaacagtgatgatagttacatatttttcttttcttgaatttatttcctaaaatccaaacagaggaatgaaggtatgaatttgtcaatagggtagaggagcttgaaaccgaggaagaaggacaaacaatttttaacctgaacttctgcagataattccaagtgatttttttaacctttccaaatggactctacaaaaagtaccaagttccaatgtatcaaaattgaaactgaaaccagtgtcacttcatgactcaagcaagagcacttcctatccgaaaacttccctcatatacataagcttttatttctaattagtccttgaggaatacctgtaatccctgctttcactacattcataagacaaaacaaatattactgagccataagcctgagcaaacaagctactatatttaaaagtagcagcccagatgtcatactctattaggaaatgagcaatgcctaagttctgagctgtttctgtaaccaaaggatgtgcacagctgaaaaaaatgaaattatatgaattcacgtcttgatttccctgtgcaatgtacttgtgctatttgaataagagttaatattcatttgaattttacagagattagcattcatcatttttacctgcctcctatttacatatacccagatgatatccatgtggttacacaaaacaccattgttttcctaaagtcaattttagcataattcactttcttaattacaacctaaaactgtaaagacttttcccagtccctccacagaagaatcttaaatttatgacccttttggtatgaatatgtgtgcttttcacttcattacaacaacaagaatggaactttaggactctaggatcttagcacaggaaggaaccttagatatcttctgatccaactgcttcattttgtggatgcgaaaagtttagaggccaaaaaactgttccatggcatattcggtatcacatgactagttgaaacactacggccaataatataaaatataataatattagcaggaacaaaaatcagtaacaacctcaagtatttacagtgagcttgcaataaagcaggcactgtactttgcaggcactgtctcctttagcctcccaatacctctaataggtagtattattattgtctccatttaaggatacgaaaactgaggcttagagagattcatgtatctctaccctcaatcccacgaccccttttccctctagtgtactcttcaggaagttacatcagaattctctatttgagtcttggctagaagaaactttcattacatggaccagttattactggagacttcctagatgggagacacactgatgttttcggtctcactgagcctgctgctttgtgagacctccgagggcatagagagaaaaggaagctcctacaacctgtactgcaagaacttcaggaaaaacaacatctttccataaaaagtttcacgttgccctattattcagtttaagaagttcagagccactgttccatgggcctgccttttgtgttcaatttggaggcatgaaaatacctttagaatttgtaaatctcaaggcaaccgagtgaaacgccacctaccgcagcagctggagggcaggccagtgttatgctttgatagccccctttcgattgtattaatacaaaggaaattaaaaaatagcatgattctctccctttcttctgctcatgcccagctttggattttcataataggagggtaacatttagaggtcttttttacattcgtgcactaacctggtacaaatagaagtaagctgtttgctgttttcttttaggtgctccaaaatatgcatgactttagaccacaaagtcagagaaataccctgttttattgtaaaagtgtaaagaactgagcaagtgaactggcttttggcatgtattttcttgaagcctctatctccaccaactccttttcctactgcacccagattcacttcagttttcccacagttccaagcccacagttccaagcccaactctgagaaggtgctgagaagaggaaatccagtaactgaataacagccactctctggactcttgcccctattctttttgtatcctctagggagctacagtgtcacttactaggtgcatgcccctgaatgggttaatcttttcttttccttatttcgacagccatgtttaccttttgaaaaggcgagcagaggcacagtatggcactggagtgctaactgctaacacatgggctatgctacatctcggcaaaaatttctctcatacttgtaccagcgtcccagccaagatcaacaccatgagtttgattttcttcatcatgaattgacagcttatttatctccatggaagaactttctaagccctttaggcacccaggcaacttagaaggcattcagctgactgttcaaaaatattattgcttcatcaaaaatagagactaaattatttcattcctgttaggctgttctctttctagagagacattttagtgaccctgagttatgataatagtttataaccaaatactacaaacgcacacacacacacacactttccaattggtattatattttgaaaacctttttagacctaatgttatgctgacagtactaagttttgtgaggatgcacaatttccatggcttccttttccaataatggttgggaagcctcattagaataattaggaacgaagtcatttccggtcgccatatattgctctggaaataatagcttccagtgcctgcaaaaccagcaaggaatagaatgcatatgccaactcctgagtcacaatggaaaataacataactccatgttgctgtatggaacctaaaccaactgcaactctgtcaggtgctcacgtccaaagaaaacttgtcactgctcacgggagaagtttaaatcaatttgcaagcagaagacaacccagaaaacactaactaattgattatgcaaatgcagaatccaaaaagtattttccctagtaataaatcacctatgactttgcaacgaacagcaatgagaatattgacctgctttggagtgaggacagatctgtatatataactatcagcaggaaaaaaatgtatatgagcatgagaaagtggcatgggaagagagagaggaaagagaaagctttactggttagattggagggacttgtgaccacagagcctcccaaatcaaagctagtgcccatttctctaaaagtatctcttcaattaaggcactggtttctggtgttatgacttccacataacagtaacaagaggaaatatttactgaatccttattgtgggccaggtgccctgctaaatgctatgtctcatttaatctcattatctcatttaacccccacaacaacactatgatgtgggtatatactagtactgccttcatttttcaacaaggaaactgacactcagacgagtaatttgagcaatttccccaagatcacacatttctacttctagccagccttttttttttttttcctgagacagagtcttgctctgtcacccaggctggagtgcagtggaatgatctcagctcactgcaacctccgcctcccgggttcaagtgagtctctttcctcagcctcctgagtagctgggattacagggatgtgccacggtgctcagctaatttttttatttttagtagagatggagtttcaccatgttggccagggtggtttcaaactcccgacctcaagtgttccgcctgccttagcctcccaaagtgcttgctgggagtacagctgtgagccactatgcctggcctagccagcctaaatttgtttacacagtcctaaagcccaataaacagaaaaaaagaatagattctcttcattccaaatttgcaaccaaaactcccaggattttttttctcctttggtctagtctacatccctattattcactctgctgattcctgccatccactctgccttattatcatcctctatgccccatctgttttctgaatgttttgtttgtaaacgtctggcataggatggttggttcagtacagtatgtaactgggcacatatatgtgatcaatgatcacaatggtgaacatagaaactggaggcatcttatatgtcttcaatgtggcaacatatgattctaccatacacagtgtttgcaagcacatacgctcaaggaagagagtacatgcgtcaagatgggtttggcaaagaggctgtcctgagaaagaggaaagttcaagtggaaacactcttgggtgtttctacctgaaagataatgaatgtgagaaaagaaaggcacagagcaaatattacagaacctcacaggaagaagttatatagaaaagagcattgtgtggaaggcaatgctgagaagaataaaatcatgttgaaaagttgtaggcattgatagacatttgggatggttccaagtctttgctattgtgaatagtgccgcaataaacatatgtgtgcatgtcagcacaccaacatggcacatgtatacatatgtaagaaatctgcacattgtgcacatgtaccctagaacttaaagtataataataataataaaaagaaaagttgtaggcaatttgagtttattagaggagaaaagaaacggacaggagggcaccccagccctggagtagccccgattttgaatctgtgtagtgaatattaatcgctcctatggttgaaatacttgagagcagagattgggccacacgcctttctgtgtctgtctctctctctcccgaaccaggctttctggaacatcagggcaggaagggtgtttagagatcgcctggtacaatcacctcattttacacacacagagatggaagtgcagatgggttaaaggactagccccaaatcacacaactaattaatggcaagaagcccagccagcacaagaaaacaggctattgactttttgccttgtgcacttcgcaaatcgccccacggcctcttttgggaggctcttgataaacactcacaaagcgctgtcaaactctgggtgctctgagaaagggaggatgagaagatcccacaagtttcccacactcagccccccgtctcatgcagatactccatcatgcttcctccaccatccgtgacttgctcacaagggttataaacttgataacctgagaaaccgcagctttagaaaaatggataaagataccatgagagagctcaacattaatgacttttaaataagggtcagttggaaatgcggaagaaagaaaatttcgaaaaatttattctcaatctggccataaagattattaggtaagatgcacactgtcttatatacacgctggtacattcccacactcctctgcccagcacggcactaaacatatgtacatatttgttcgatagaatccttcaaagtcctctcccttagagtcatttgcagatatttctcaaacatgatgcagatcaaaatgcaatatacaaagtcaggtaatgtccccagcatcaaattaaaatagctaaccggccaacagatggcagctgaagcaaatcgcttgccgatttaaataagaacggtgttcggttcagttgtgcacatttttctagacagaagttgactgctaaatgaaatcaacttcagagcccagttgtttgtagtgtgaaggggaaattacaaaaaacaaaaatgccttctttgttcctggaacccggggtgattcacaagcacggacatcccctggtcttctgattttaaatcactaaggtggaaatgtcattcacccaggaggttattgattaaaataaagagcaggaatgttttctgcatgaacctcacttctgctggcaatgttacatcacttacagactgcaaagaagaagaagaggggaaaaaaaaacacagtaaagagaggaaggttcagaacagtcacagactgggaataaataacacaaagaaactctggggcctgaggacagaagcagaggttggcattattttacattagaaacacttcgtattcaaaacggtaattgatagcagagaagtgttgggggaaagagccactcgcgttcaggcaggctgccctgccaatcaaactcaacctttctttgaatgaataaaagcttcattgccctattatgctgatacagtcagacaggactaaagtagcctgtttgtcaagtttatgtgaactgccccaagctacttagattctgacgcttaaataatcccctcaaaatcacccgtgattctggatacagttctcttttttagcaacgcagtgtaaattttaccctggacttgcctgcccctggctacagatgggcaagagggggccatacctcctcctctgtgttagtacaaggagggcatttggctgtcttttgtttacgatctgctgcggtgctgaagtgctctgcacacaggtctgtatgtgctgcgggctgtctgaagcctgcagacattcaccagattctatattcccagctctatgggaagtcagcatagagaagtctccacatcacctctcttgtcatcagggatatgggctaaatagcaccaaaccttgcttgcaaccaagtgatcaatgaaaactgaagagcctgggggatgtttgcttccttggtcccaatccttgtctgcttccagcagcaaatcagtgatttgggctcagggaggactggaaggttacactgcaccccaaccagcaatgcagggattctcaggagtgacttcaggccctgggggcaggaggggctcagaagagctaaaaatgaatctgtcccccacctcccttcacagggctatgtgtctttgacttccctagttgcttctgcttaaaaatacatgtgacgaaactgctttgtatttgcaaagaaggagttgtgggtaacaatgaacatgcaattgggctggaaatagatttatcaggcttcaaggattattgtttgctgagagatggtacacacattactatttcacagttcagctatgacattattaacctactgtgcaaggattttattgccagattggtccatttatcaaaaataagagaaactcaaaaccccataaggaagttaacatttcaagcaggcttggctttcacttaacaccattaatctatctatttacacaagagcaagaaatgttcatttagtaacgtctctccatttggtataaaagcagcaagtcggtactggatgcaagcatgcgaatgtcatgctcattgtcacaggaaaaatgagtgttttctccttaaaatgagttggcatccccagagcctgccacgtattctgggctgcaatatgctagatgccaggtactcaaccagcaaagggataatccaagtcctggaacatttacagacccaagctagaaagataggtgttggagaaaggtatacagaaattaggagactttcctaattattttgtgacaatacaagataaaaatatgcaaagtttctcgaaggaaaaataactgtgtccaaccttatcacaacaatgagtccttaaaataaaaaaggataggaaagtaatggtcaacaactcagtaattccaagatgcaagtgatttgggactggaaagatggtagtcttttaacatatcttctccaataggaggtttcgatagcacagggatattcatggagcaatacatgttgctgtgttacacaccatcgagcacctcgcactgcaggtgcaccccaagacggtgcagagccccgctgttcatgtgtgaatctgcatgactgtgttaggaatttatttatctgtgggtaaagacacaggccttgaaagaaagaaaaagggggtgaatcattccatttctatttgttaacctctcttgtgtttcttccttcattcctcttgttttactatttctttatggaagaggagacaatccccaagcccataaaatgcctgcagccattttgatcctatcagtcttttttcttcaaaatatgtatgtaatgttaaaaaaaaaagtgaagggaagctgtcaccagagagaggtacattcatttttgaaatgtgtgtatctgtgtctgtgtgtatatacatgtatgcatagatacaaatgtttgtgtatatacacacataatacacataaaacatgaatgtccctttttctggcgacagcttttcttcactttacaggaacatatatatacatacatacatgtgtatatatatacacacacatacatgcatgtatatatatatatacacatacatacatgtatatatatacatacatacatgtgtgtatatatatacatacatacgtatatatatatatacacatacacatatcagtataaagaaacgcatacccaggtgatgcagagagttaataacacattcagcatgccccaccgtgcactccctactaaaaggcactgtgctcgcttgagtgctaagtgctccagagatggtagccttgaatcagcaccaggaactatgctgaggatattacaaacattaccatctccaagtctcacaatcctatgagagtagttagccccgttttacaagtagggaagttaaggctttggcaggttacgcagcttactcaattcacagctgataagccactgagcctgggttccaccagatgccaaagcctgtgtgtctccttccctactgttcaaagcattttactctggcactgtgtgaagaaccaaggaagatacgaagataaaaaagcggtccttgccctggaggagctcacagtctattataagagccatatatactactaacaaggcagaaactaacaaacctcccagcacagcaaaaagttaggaagcacatagcaaactcagcactgccttgggaaccgagatgtcttcagggaagctgcgcactccaacacacacagcaacttttctctagtatgaacctgttacagcaggtacacaaacaccctgcaccctgtaaagtttctggcacaatactattatttgctaacatttttctatcctgacagcttaagtcactgttgtcatattttcagagacttattttggttcaaagaacagaatagctgctgtgacactaaatcaagtgtcatccatttcaatttgatcagaatcatcttagcaaaatacagtaagtgaggcatagtggaataaatgaggaggtgaaagtcagagagatctcggtttattcctgactctaacaagtacttgattataccctcttttgtagatgagaaatatgaatctagggagttctgtgaacactttaatacacctctcaaattcttttaatctcacttttctcatctgtaaaatgaaaataatacattcaataagcatctatttagcactaattacttgccaagcaccatgctcactgctgaagacataaaaatgaaaaaaggtaggcaaggtagccctcaggacaggggaaagttgaagagacagctggaatgctgtgtgagagtgcttttaggtggaacacagggcacaacaggaaggtgcaagagacacacccgactcagcctttgggggtatgtcagaaaaatcatcatgacagagtttaatcctgagtgcaattctgaaacagcagcaagaacaatactgatcatcattattatactactaatattaaattaattgcttactctatgatagaaaatatcttacataatttatgtctcttcatccatttgtgcttattgacaggaaaagtaggtagtattatccataatttaaaatgaggaattgagacacagagaaattaaaatttacccaaagtcacccagctactgagagggagatccaggattcaaatgcaggtggcctaactctacattcatacccagagcttctgtgctatttgtctcacaaatggagagaaggggtgctccaggcagcagatgcagcatgtgcaaaagcacacctgcctgaggttaaaggcccactcctgcaactgcagggagctcagtgtggtaggaggccaggtctatgactgtttggggatgcagaggaaggagacataagcccaggctgaccactgaagacacaggcaatttgcttatgcatctaaagttcatccagatgacaatgggaagacatggaaaagtttcagccagaagatgatgttttagaagcagccctctggctgtcacgtggaagacaaattaaaacggagccacataaaaggaaaggggaacagtgagaagacagtcacagttgtcagagtggaaaataaagaggacacgagaaagagaagtggacgcaggcaagaaatgttaagtcagtaatgcggtcaggagttaatgacagactaaataagggtgacacccttgctttgggctgatggagctgcctgggtggtggtactattggttcagtgatattcagaggatcagttaatcatgcacacattgcaggggtattacaaggagcagaagcaacccacacaatcatcatcatatcatcagagtttattgagcacctgctatgggccaggcactccactaccactttgtccacctctgctcatcaaatcctcaacaatgactctgcaggaaagatactggctccattacagatatggaaacaaggtccacaatgtctgggcaagtcatttaaatgtcatcctaccaagtgtcagaattaggactcaaacctgggtctgccaagcaccgaaggctatgtcaaccattattctctgccatgatgttctctgttgttttcagttttctcttcctagcatagaaaaatgtcagaaaatatgtgatcaaatgtagcaggtatattctgcaaagtacctgttgaaattgcttctctgcctctgccctccctacaacttcccccaagtctcactccaagtacagtttgaaggaggttgttctaaggcaggaggaggaaaggagcctggccttgctggcagtgctgggtgtgaatgggaaggtgtgccactccctttgcccaactcttctgtcctaatccttagaggaatccatcaattcctaccttccagattatctacaaggatacagctattgtctatgcagcctgttagaagcaaagtcataattcaaggcatgcctgtcatcaaaatgttgcattggaaaagctgtgtggaccagtggctaaaccacaagttttacaaacccaacagacgctccttgcattggcaaatcaaaagctggtctgaagccagatgctcagtgtcttccagcaatcctcatcaataactgacacattccatgctatttctgaagtataacattccaagttagatagataggcatttgctctgcactggtgttttcgagtccaaaggattcacaaatacattctttagattaaagcatttctgtacagatttgggggtaaaagagggttttcaccgcatggaactccaatcccaaaccctctgtctatcttaaactaatataaagtaagtcatgtttctgtttctctttcaaagatttacttctagccagatatttacataaggtaatgctgcctacatactaggagattaacaacatgtacagccagtttgagaaaatgcatacttattttaaattcaaaacacagatgggatgattattttctttacaaaaggagacttaggctgggcatggtggctcatgcctgtaatcccagcacttagggaggccaaggcaggcagaccacctgaggtcaggagttcgagaccagcttggccaacacggtctctactacaaatacaaaaactagttgggtgtggcggcgggcacgtgtaatcccagctactcaggaagctgaggcaggagaattgcttgaacccaggaggtggaggttgcaatgagccgagatcgtgccattgcactccagcctgggcaacaagagagaaactccatctcaaaaaaaaagagagactttatattaacagaagaggacaccacagatgtagaaacctagattcttcaaaggccccagtttcaaatattcagtcttttttgggcacaccaattggcaaaaacaaattggtacttaacatttcttttcaatgactcagcaaatgaatggcttctgttctgttgtcgtaacttttttagacatataggaccatatgtctctattttcattcgaaaaatatggccaataaaacctaacaggtacagagacatctgctgaattataacagccaagccgaagatacatcttttccttgtcaataacttagaaattctttgatcctaaaaataaaccacaaagtttaccatcaaccaccctagattttaaaaattggcttcaatgtatacgtcctttcttcagaaacagccattgtagaaaacaactgtaatgttgttgcaaaattcttgggcctagaattagtgagcttcacgctaaggctcatctctgagatgtcctgtttctcagaagcagttttaactaaatttcatatttaataaatattaataatacatactattaaataaaatgtatacattttgccagacaattcttaagaaaagcatatgggcaaggtaccattgtgaatgacaaccttcacggtcaggttccacctgcatcctcaacaagcttctctgtgattggaagcgtcttttatactcctctatttattttcactttaacccagtattctagaagtgatttctactccattttctattgcccagtaagattcacttcagtgggagactgggttatgaaaaaatatatttaaagcattcatgtttatgattcaaagagtggggggaaaagccttaccttgagctctgaaaagtttgccaacacatttccagggtttaaggtgaagaatgatttctgttttgcctcaatatgaattgcaaaattcaaatgattaacctcaccatggggctctctgtttccagggcaaacaggagaaaggactgtttctctgcttaaacctctaaatcagtctgcttggagtaaagctggcaggtgagggctcggcagaagtcacatccttttctcatcaaaaccttacaaattatttatttgattaggaaagagacgccacaaaaggcaacatatattgacagttaccaccactaagttctttttccgtttttcctagttggtgaagaaatgaaagagcctcttaaaattcactcctcattttttattcgtgtgtgtgtgtgtgcgtgcgtgtgtgtgtgtttgttgtgtgtatattgtggaatcaatgtctgacttaatatcaaaataccagaaagaatactgactatggctagcatgtattatggctaataaaatgtaactgggccaaattgttctcagagaaagttgtgtacattcattcctaagaggcaagaatgtgaacctagtatagagtcataaaagtaataaatctacatagctacagaaagctttcacagccaatgtgctaaatttgttcagtgagttgtcaagaaaacattttctatgactatatcttttcaatttaaaataaatacctccaccagatcccagtaaaaattgacaaattatattaaagaccatggaactggtactgatacattttgaatagaggagaagtctgcagtgggaaaaacaataaccaaaaaggtttaatttgtgtctcgatatgaatttactccttcatatctccactactgccctatcatccctcccataatgcaattctcctccagcctctgccactccaggaacactcaccaccatctccatctattaacctagggttctcttcctccttcttcctcttcatcttcccaccagattttcctcctgctatcttccctgtcatagatgtgtcctctcccaatcaacacaagcagaattttcttccctttacttctcccaccaatatgttgaataattctcttcctttcctgctcccatcccatccatgtatttaggtattaagttcccactgattactttagggttttttccccacatatgttccccactgagaaagacttgtaacacttgtaacactaccaaaactaccctgatttcccacaacttcaaactccaccatttagaaagtggccaggattctataatgctaatttaaacacctaatactgtatgcctggcctatggtaagcattcaacaagtacttgtggaataaaccacatctaaatcaatagatggggatggcaagtggtgaggatggggagacagtacttgcaagtgggatatggcaagaaggaccctggaaaattctgctgaggacagtatttagccagcttttcagttggagcagctaaaggatccactttgtcattctacttaggtttcttgaggttaaaattttaaaaataaatttgtacaagtcctagcaattcctctactgcttaatgttatatacaggaaaaattaaggaaaaaaacctcaatgatggcaaagctgagcagaaagcttgagaataagtacatctaagttatttatgatgctgagctacgagaatgggattctagcctctgttatccctaattcattagtgaaactggacaactaaaggtttctagaatctagagcagaaaagcttcacaaattatttgctcagatgttccattttacagattagacccagagggattaagggaatatgtgtgaagtcatggaatgagctaccagcagagtcaaagccaacatctaggtcttctctactcctcttctgcagttggtcctccttatctatggggtttcacatccacagattcaaccaaccacaaatcaaagatattcaaacaataaacaatgatacgaaaataaaataaatgtttaaaaatacagtatggcaacaattcacatagcatttacattgatttgggtattttaagtaatatagagattaaagtatacgggagaatatgcctaggttatatgcaaatattatgacattttatataaaggatttgagcatctgcagattttgttatccaagggggcatgctggatccaatcccccacagatacggaaggacaactataataatatcctcctgtctaatcccctaggttgttgtgagaatgcgtaaaatgaaaatatatatgctagatataaaaaaattgtgcaaagctaaaactgtcacacagggatattttaagagttttttccctaaatgttacacttacttaattttttaaaaatgtttaattcctgctgtctggccactaggcctttattcaatgtggtaattatgctttcctacaaagaatgtcaaagatgatccgcatttgcttattcatttaacagcccttatcctcatatatttaattccaaaacaaatagccaccagccacttctacatgcctctcagaaccatgcaaacttctcaacgagctccattaatcttttaattttcttttctaaagacacagacctttttcctgtctgaaccatgggactcctatagcattatcttacatacctcagtcatttctttctcattgttacaaatggagacaagaactgagagcagcattagagtaatttcctccaggttactgtatattcaatacttctatttatacttttcattttgtctgctgcctttgtttttggtccttccccgaagcccccgccaccctgctgctaagcctggtatcaaatatacaagagttttatatactgaagttgagatgatgtcattttccctttacttgggaatggatcacttttgaaagtgtaggttttctatttaacattttaaaataaaactcaatcagctttgatggtattagttctacctccttttagccaagtcctcaggaaatgctttactgcatcctgggctagtgtctaccttattatggaaactatttgttttcttccccttgcctgaaacatcaaagataaataaaacaacttgactgttgagcataagacagattttctgtccactcaggaagttaatccacaagtgaaactggtatgttactctgtcttccacaaaagaatcacaggttatcctgaagtgaggaggtattgaagttcacgatttcccacggtacataatttagttttgtgtgtgtttgtttgttttagtttgagcacaacaatgctttctgatttgagaggttggcatttttaaaaccctatgtctctctcttgccactgccttcttttggcttcaagacatcatttctgtatgtagccaacttctgcagttagaaaactaagtgcagtggtctctgagcaacgaaaattgatttcagtgggaactgtgtccctgtaactgtaggaagaagctcatccttctcttatggtaacaaaatcctcttccctttttattgatatatatgtgtatttttcccctaatgcccacttccctgcaagcaaaaaataaatctctccagcatctctcccctgttatttcctttggattcgaagtagacccagtgctaaagtctggccatttccagagccatcactttcccaggtctcaactttgggctaatctttatttctctggtaattttccttcttagagccagctagtgtatatgcatatatatgtgtgtgtgtgtatgtctatgtgtatatatgtgtgtaaattgtaaattacataggtatgtttacgcatacgtatgtgtgtgctgtagacacacacaatatttagccatttcttggctcagttaagtctccttggcaaggttttgaatgttcaactctctcttactctatagttttccagttcctatgaactagaaatttcttttggtatttcagtttttattcttctggtctcactgacaaacaaatgatgcaaagctcaatattgtctttatttttaaaaaatatttatttatttatttatttttgccaatgagttaccattcacctaagagctccccttgttctatatgcacagtcaacatagcctttatggatttcatccacaattgctgtgattgtgtaacataccagggaatactatcttccaaagatatttcccttcattttattcctatatgcacacacacacacatacacatacacacacatatttatagtccttcctaagtttaatattctattcaacaatattttactcttccaccgttatatacaggttaagcatccctaatccaaaaatctgaggccaggcacagtggcttatgcctgtaatcccatcactttaggaggctgaggcaggcggatcacttgagatcaggagtttgagaccagcctaaccaacatggtgaaactccatctctactaaaaatacaaaaactagccggttgtggtggtgcacacctgtaaccccagctactcgggaagctgagggaggagaattgcttgaacccgggaggcggaggcttcagggagccaagattgtgctactgcattccatcctggatgacgaaacaaaaaaaaccaaagatctcaaatccaaaatgctccaaaatatgagcttaagtgccaacatgacacaagtggaaaattccactcctggcctcatgcgatggggtcgcagtcaaaacttcgtttcatgcacaaaattatctaatatattgtataaaattgcctttaggctataagtttaagacatatatacataaaatatattttgaacttagacatgggtacaatccccatgatatctttgatgcataaacaagctcttaaaattctccatcctgagcagacctcatgatatgacttttcctggtaagacattttacaaaaaaagaaagaagtggtgcactcaatttctattcttattttttattatttttaatttcaagccataatgattttgctcactcagcacctactcgaagcgccccttttactttgattttttttctaacccttactttatacataaggttattcctttggcttcatttctgctagcctgacacgtttcttctttgctgatcttttctaaacagtttatgtcccacaatatttatccttctccctcacacaccattcatttccattactcactctctgatttggctatacccatcatttctgaaatagagaatgcctgaacttctttgaaaatccacatgtcaaaatgtaataaaaatgttttcattgttacattgttttaagagaaatgaatggcttgctcaaccatcagttccaaatttatattcaattttgggaatatatattattaagccttttttctcttcccctggttataaaatactcaacttgactctgtagtcttgcatggctgggattaggagttaaggcattccttataaatcagtgtaatcttcacaacaggacattgctgtatcgagaattcctctctgtattgtgcattttcaattatgttacatgtttctacttagtaagccagcttaattctacgctatgtcacaatattagaacatgtccaggttagaaaaaggggcaatcttacttctcttgtaagttgtttagcctttggcacttataaatccccccaaaacacaggggaaatcccttttccttgcttttaatatgtctttagatttattacatgaagaatctgctcacttaatcctttgctgaggccaaggctcgtcagtcttctaataaaggttccacgaagagaaaggaagaaaacaaaatcacaaaataggtgttcaagggatgcttcaaacttaaaacacatttccaagtatattctccacaagacagacaagaagaggcaggagactttaagttactctgcataaatccagccccatttatcttcagctttctttctagacagtccagtcagggcaagcaagcagggaagaggctgaagggctcttcggggaccaaattacagtttcaaaatggttcttgtgttccaggtgtaggacaatgttatctgagaaatcttacaaagatttggtgttctttaaagagctctgttaaaacatttaaaatgatcaaagattacatcattaaaaaaggagggaagtgaggttgagaagctttatttaaaatatgttttaagcagttctggcccaaatactaaaactcctgcaaatgaatgaaggaaaaaaaggtcactaaaataaaaaattaacatatcctttaaaatgtcacttccaagttcccagcaaacatggcagagtccacagagtattgattgcatcatgaaataatcattaaatttctctatgcatttctgataccaaaatttaataatgggacaatattattctttgaatcaaatctattttggatcttttttcaagcttgagttagggaagaggccattgaattttttttctttggttcttaaaaatcctctctatgcacaaacatgagaaaataaaaaatagaaggcagataaataaaaagtaaaatcttttaatgcctaaatatgtctttatccttttcaggtttatttttctcccccttttttactcatactcctgaaactaccctgggttaagttccatcaagtggcagattagtttccatgatgctaaaaaggtcccaattacttgcggcatgtagagtgacccatccttcaaaactcaaaccagatatcacctcctcgttgttttacaggcaagattagttgctctttcaacatcacagagaagagcaggaagtgtggcagaagaaatataggaacttggccatttactgtgtcacctggacaggtaatccaacgtccctgtgtttccatttccttatctgtaaaatgggactcatgcttgccctgctgatttcaatgggcttttacaacaatcagatgggccagtgcacagaaaagctttataaagtatcaattcgcccacatctctaagccaacagtcccttatctggtttcctttaagaagccaggtatgtttcagaatgcagaaccctttagattttagaaagttaatgttacatatactatatatactgtatattatgtaacaacccatcagtgaaatatataaatatgaacattaaataggacaaagattataatgaatgccaaaatcaatttcagtctataagaatcttgtccaaatttatttaccattgtccaaatttatttaccagctgaggagaacagatgatcattttcccttgtaggactatgaacatcaataataagtcagatgccaggtaggaaatgttggacaccagcactattcattgagcattcattatgcacagagtactcagtacagcactttgaaaaagaataaaaacgcagtaaaaaaataacatttagccaggttcaacagcagatggattgcttgagcctaggaatttgaagccagcctggcaacatagcgaggccctgtctcaaaataaaattgtaacgataatatttgtttggctattctataataaaaatcgtgatgaaaataaagttaatactaatatcagtggacatttacagagtacttactatacgtcctaagcattctacatgtattatctcatttaatggtcacaataatcgatgccaaatattatgcataatctacagacaagaggctgggccagaaagaaggaaagtcatctgccctgcccaggtcagtgactaaagacaatgctatcattctactgggacaccatcaataaaccaaatacttcctgagaggagaatggtaagcaattcagatcaggaggagtgacctggccaaaggagattctgaagcctggtagcctgaactacctaaccagtgatcccttgaggcagaagtggaaactgctcccagcctgtaaacatatctgaagcttgttttccaaccagctgctgaaatgcaactcaacttccaagttctaaaaataaaactcctgagatcagccaaatcatacttttggaactattgacatatacaaacatttcttctcctgaaatgcattcttgattcagcacaaagagagaggcaaagaagaggagtggttaaaagatggaaaggaaaggaattcccaattactgtatacaacagataacaaggaagagaaaaattaaaggcaaagtcaggttgaacaaggaaaggttctttagctacaaagtcaataaaagaaagaaataataatatggattgttaacccttcacagaaggcaagtttcaaatcactttcaatcaaaataaaatattccttaatcacttgaggataaagagctttcaaggaatacggtaccattcgatgtggagaacggatcacagaatttccatttaattatccactgttgaataagatttgctatattgatgggaagttgagttttttttcctcaactattacctattaaattgtaatctccagagggcacaagctttgcccatttcttttcttgtatctcctttatacacgtttctgaaagattaaacactcaataaatggttcattcaataatagtaatcgctaccatttctgaagacctgtaatgtactacatgctgactgtttttcataattctctaatttaatcttgttttaggggaatattattacccacaacttcctgatgaaaaaaatcaaagcttaagtaacttgctcaagaccacacagctaagtggcaaaggctgggactcaaattgtatgatttcaaagttcttgtttctctgatgttgtacatatgtgttgtgcatatttacacacataggataaagtcacgtgggtggttgctttattctccaggatctcaccatcttctttcattactccattaaaattgtctctgtaggccaaatgactccaatagctctttaaaacctcttgtaaaataaatacccaaagaatttccacttttgatatttcatttctctccttggaagatcagaaaaaaaaactggttgcccctacccctgcccacccacctatcctatcccagtggcacaaacagagtttcagagatgtgcccagttcttatagctaaatagtaatggaggtagaatttgggtcccttgatttcagcccaagacacaccgaacacagaggcattttgacagccagttcatatttgttaagggtctattagacccttagtattactgcagggcaactgaaatcattcttgctctcattctattataaagacatatatgaacgtgtatgttcatgcagcactattcacaataacaaagacatggaatcaacccaaatgcccatcagtgatagactggataaagaaaatgtggtacatacacaccatggaatactatgcagctataaaaagaaagagatcatgtcctttgcgggacatggatggagctggaggccattatccttagcaaactaacacaaaacagaaaaccaaatactgcatgttctcacttacaagtggaagctaaatgatgagaacacatggacacatagagggaaacaacacacactagggccttctagagggtggagggttggaggagggagaggatgaggaaaaataactaatgggtactaggcttaatacctggatgatgaaataatctgtacaacaaacccccatgacacacgtttacctatataacaaacctgcacatcctgcacatgtggccctgaacttaaacgttaaaaaaaaaaatcattcttgctctcatctagttgaaagggacagttaacatgcatatgtgactaagaaatgaactgtgcaagttgatgatactaattaaccacaagcaacagaatttcatagaagccaccatccaatggcaaaaagagccacaagacttagcttcaagttcaagttgtgccactgcccccacagctgttttggtgaagtcactttttcttccttttataagatgattagtttggaaatggagaattatgtcttgtctccaacagtgaagagtggtgtgagctttgacagtggaaaatggggatattaatactacctccactggactgctgtgaggaggaaatgagacaatgcacaaagggtactgggcgaggcatctagagggctcaacaaatgctggccatcactatttgccattgaaagatcattgctgattctaaaactgtgtaaaagggaatcttttgttggagttttgttccccagaagaccctaatctcttgctatttaagaaccatgacttttaagtttaccctttgtctttaaaacattttttttaaatatcaaaagcagcactgttattatagtatatatacttagctactgaagaccagagacatctatcttgggtctgaatagcccctggtcttttttgatatctccaggtgctctccttttaccaatatttgcattggcaactgttccacatcattactaatcatttgacatcagacttaagaatttctgacgctgacagaaaagttcttctccctcactatcctttctcagaaattactcattgtagtcaaatgtgcccaagtccctgaagcatatgtaataaaccaccaaccagaatcggaagttctatccaccttcaaacatttgctctaaccttagaatgggatctttctttttatttttgcaatgcaacttttatttttccaaactacccagtaccagaggtttttctaactgggacatttgttagcctgagaaatatagaaaacaattgttgggtataaattcacatcacattttcatttccttcacttctgctattttcaaaacctcagactttccactggtagtactgcactcagtgtggctgtcatccacgcactaagcgggggattatcttttttgtctctcaggaacctcgcttttttattgcagatgcaactctaataggcagaagttgccacacaatccaacagtgaagatttaggaaggatccacgttacagggcagtgaaagactgcctgaggtggtggtcctaccagccctgcaaaaagaaatgtgggaacgaagcttaaaacagccctccctccctacagtgacaacacaacctgcttacaaagagcagcgataacaaggtttcagcccaagatgccccagtcattcctctaatgaatgcagaggaactatcagcagcccaagactgtagacacacagtatactgttccccatattgttgaatacaagatgcgtaagttattcaataatgtatctgaataattacgtgaaaatgaaaattacatattaaactattccaacaggtgccattttaaaataaaacagtttctgccttgcatatgcctagaaaatattgcaattacttgtgagttaaagcacgtacactagtacaaaaatataccaccactggcactgaaaacaggccatggctaaaaccatcctagatgtctaatgatttagcataaaacatatgtgatagtgtaagagataatcctactatgtttacatcttgcttgtgtaagtctgtcagtgggcaatcacgaagcagaaaggcattcccgaatggtgggaatcacaggaagcagtaatctcatctggaatttaatagtctttttgtgtgtgtggttttgatcattttccttttatgagtgccgtgtgcacagactcttgattgtttctgcaatggaaaaagaagaggatgtccctctgaatcccaatgatctgctttggccaaaatcagacaccaaagctgttaacgggaagaacacttgcaatataggaaatcctataatgtaacgaccaatgcaattggttagaaactcttaatacactcccaagttgacagaagatggcagctcccactgacaactacacagccaagcctcttcatccattctatttagaccgaaggaaaatgaagagatattgaatggaatattctaaaagttctgggtggtcagagccatgtgttttaggatggccatttccatgagaaaggtgcggttttgtgggcaaactttttaaccctcttctcttcctaccaccccctacatcacacaattaagaaccgtgggtgggagaagatggattgctcatcgccctcccactctgtggccctcttttggatggcatcatcgaacccagatgacaagctgggaggcaagaggcttccagcagcagcatctggccctctggcagatggtcaggccctcgggttcccggcttgggctccctccagatgtgtctcatgcttgtcctgtgtgtgagcttcctcctaccgctgcaggaaatttttcacgtgaagacattttgaaccagaagaattggcacgttcttatctaagaagatgttcttgtgtttttccctctggggttatattttacaaagatgcctggatccaagaggcatatgtgaatgtatcttcaaggccatctccctggagacctgggcggtgggagaggggagtggagggtgcaaaacaaattatactgtgtctccactcctctatcactttttactactttttccttcctaatgaaatcaaattttgattaacactaaaggtagctcagaagagggaaaaatgataaaagaactgtcatcggagatggaggagggctctttctctctaggcagttctgatttggtaacgacatgggcatgaggcccggaaattgatagcatttgtacaactctgtttttttcaacaaggcagctaccacctgtttcccactgacccctaactacttccttgacttgctccctagtcactgcctcagcagggaggatcccctgaagcagagaactaagacagctattcccaaattttgatgctaataacaatgatcataaaaatatcaactgcaacagcaactgccatttattgggcaccaggcgttacactaggtactttacaagcctcagttaatgtaatccttaccgcattccaaataagtctacccattctacagaagaggaaagtaaagtggaaataagtaaggtcccgcagatagtattaataattagacttgaaacgtggtctctcttatcccaaagcctaagagatctcttcattagtcaattggagaacagcaaatcctagaatctttactctacaaaaaaccttagagattatccaaagcaaccttacatattactcaagaatgtccctcagattctgtttatgctcttcttttgataatgaactcactgccctcaaggcagtcagtctactcctggactattgagccagaagtatcttcattagccagagttaaaatcatcttccttgttaacttctaccacatggatgttattcttgctctttggaataacatagaacaattctttctctctctcatacatcttatcagacatttgaacctactttctccattgggttgacagtaggataaataccattagttctctgtaattgtcctcatgttcaccaagcaccgctaaagcttgctgtctgaaaaattgccttaattatttatttaattttcctattatttgtctgccttctctgggcttgaagtccatgacagcagggatagtgtttgtcttgttcttggctacatcctcagctgccactcaatgggtagtcaacaataaatgaatgaatatatctgtgccttctggttcattcattccctcattcaatcatttttttcattcttcattcaacatccaacactatgtgagcactattttgcaacagcaaaagtatttggcgataagttcagttagtcaacaagcattttccataataataattatagctaacatttattaagagcttaccaagaaatatttggggtatatgctaggcatatgttagttatatgaagtaggtattcttttaaccccctttttagagatatgaaaagggaggtatagagaatgcagtaacttcccccggtttacacagagagtgagtagtgaagagaagactcaaaaccaagttttcggcctggtgtggtggctcacgcctgtaataccagcactttgggaagccaaggcaggtggatcacttgaggccaggggttcgagaccagcctgaccaacatggtacaaccctgtctctactaaaaatacaaaaattagctgggtttggtggcatgcacctgtagtctcagctactcaggaggctgaggcaggagaatcacttgaaccaggggggcggaggttgcagtgagccaagattgcaacactgcactccagcctgggcacgacagagcaagactccatctcaaaaaacaaaaaaacaaaacagaagttttctgatgctcctaacttgacagtatactgcttcccatctactgagagtaagaagtgcttgtttatgtatttttttactgctgtcgagaaggagaggaaattcttaggaagctaataacaatgtctcccatgaggctgtagagacacaaccacacaatgcaatcaaaactccaccctcaaaataattacctatcaattactgagcaagagtattgatgaaactccatgcccaagtcacaagctgacttgattcatggcatgatcaaagtacgattaggcccaaaagcctgcttctttttcttttttttttttttcttctagaaataggatcttgctctgtgtcccaggctgcaatgcagttgcagtggtgcaatcatagctcactgcagccttgaactcagggatcaagcaatcttcctgcctcagcctcccaagtatctaggactacaggcatgcaccaccacacctgaataattttattattattattattattattatcattattattattattattagagacaaggtctctctatgttgcccaagctggtccaaactcctggtctcaagggatcctcccatatcagcctctcaaagtgctgagattacaggtgtgagccacagagcccagcccaaaaggcttctcgtatggggacaacagatttcagcatggtggccaaggacacaaagctgtggatagaaaagagcaggcaagggttctaactgggggtgtccaatccaagcccagagacaggaaaggttctttgacaggtgcggttagagactttgctgggtagagccaaaggacggctctggggaaagtggagaagggaaagctggaaagttaagaacaacatctagcaggcacaaaagattttccttaaagtagatcttgtaaactaaaataactaagaccttcagttcacgaaactttggaggacaaattagcactgccattaggttgagactccagtataaagggggaaaaattctgcaaggctttggctgtcaatgaggggagagctcttcagcgaagaagcctgtcgcattggattgtgattataatccacaaagctccccttccccgggtcagctcattcatttataaataagaagattactcactgcctacatgcataaacagctttctgcatcattcttggggtattttccataaatgttttctgcatgcccctttttttctttttctcttcaaatgctcaccgtgtctgggtcaggaacgtgcccttatcagccaacttcaattaatagttccaaatcaggtcagcaatggcccctctcttctctctggcttctcctaagggaagtcccttgattaggggttacagaaggcaccagcagtggggtgccctcatgctctgtcctcctgtcaagagcctggcagacaatgggcaggtcttaggctgttaacttctgtttggaaggtagatttctttatctgctatgttctttttcacttaaaaaaaaaacgcagtctgctaatccagccattggtggtggctgattaattttcaaagtgaattcagttttagccacttctacaaatagacactttattgagttgaagagtcaagaagggattgctatttaattgtatttgatccaaagacaatcagtggctttactatctcacctctctgtattctctaattatgagcaatattccttctccttgtgttgacagagcactttacaattttccacactcttctgcttatattcctgaggtaatccttccccaccccgtgaggtaaagtgggcaggtactatcatgtccacttgatacaaggagaagtagaggctcagagtaaaagacccggtaatctagggggtggagggtacaaaacacttgatccagcaagaagtagaggctcagggtaaaagacaagaaggagtggggagctgcaaaaccaaacccaaggccctgactccaattcacattacttcctgtggtgccacaccaccaaagcaaggggaaggaatgcttgagtggtgcctcagagctcacagagccaatctgagttcaaattctgcctgtgccttctggagcctcaatttccacatctataaaacagagaagaaatagtacctactcacagtgcctgcttgagagggggacctgaagatccaatgagttgatgcacctggagcttaggacagatcccagcagacagcaagttcccagccacgtgtgctgccacctttgcctctgcctcaggactaaatgccattcattacagcctacttgttttcttgtgttgcaagcccaaaacttcaaagcacaattcacaaactctaagcccatgacctttgttttatttgggatacagagcctttctggttttattgtcagcatttactaattgggagcattcactgaaacatcaagatatcccacattttgtgaaaataaaacatccagcaatactaggtccacattcctgcatagcagctattagttgggaaccgaaattagaaaggaactgaatttgacttttttcgaaaggtaatatccatttatgggcccatttctaaaggcccactgagtctacctttacccctctctccctacagaaccgccttcctcttatggtaaagctgggacctggtatattggtgacttcccctttatacaaggcacatgctcgccggtctgccccagtccccaccactccctaatacatttctcaaatctcacctcctcggttcatttatattactgcctgctcaggtggcatttcaatttgttattctccagcattaagacaacaatgtgccctactacaagaagtgtgttgtaacatcttctagagccagctgaatgactttaaagaaggcacttgctggcactgtgaattctcatattattcacatctcacagcattctgtttatcatcccagcttctcacaggcaaatctgcacccagggaagaaatacattcagcacattttgctagcagaaaactttaactggaataagctcaagcgaaatgaggattatagagttaggctaagagtgatagctttaactttctgcaaaaacctcccccatttgcacctattcacataaacattgctgccgtgtaactcccaaccatcctcaaaatgtattttgttacttggtaatcaaatttgcttatgccataaaatgccctagctcctatgtgaatgtattttttttaagccggaattgaggaatattgaccattattgggaaattaaagggccttgcactctcttgatcatgagatgagtttattaaagaggcagtttgttctcaagtctggacagtggcattttggcattgcgatagcactggatgaggattaagtcatttctcagctttccttggcagagtcttttattatttacagtatttacttcagggaaatcttggcgtgtgtcatatttatcttactgaaaaatgggcccataaatgcatattacctttcgaacaaagccaaatgttttggtactaatttggttcatgaagtatgtaattcagttcctttgcacaggagcaacatttgtcttctgcttttattaaactaccataaaccattttttcttgctcattattgaaatatgcatcaccgaagctggggcaaaggagatttaatgactaaagttctaaaggcaacccagtgacaccactctgttctgctgcttgccaccagaaaaattaagaaaataggggacctgtaaggaaagccttgccctggccccacttagtgggtagcaggagggatacaagggaatggaggagggagcaaaataaagcagtcatttgtatgagattatttccatgaaacacatgccttcgttaacaggagttatttataaatagctgctcatttatttttcatttcaatcacgtatgcttttagtctctttgaggtcagcagcagagaaatgttgccaccaatatacctaggtcccagctttaccatgaggggaaggtggttcgatagggaaagagggataaaggtagactcaatatatcacacacctcccctcaaagcttctctctttgccagtatgagtgttgtcttgtgttcattctctacaagaatgttgtaagtgacagtttcactatcccacctataacagatcacttgcttggaagtaggctgcctgtctttccttaccctggcaatgcagaaaaaaaaaaaaaaaaaagcaaagagactccaggtaaaatgaatgagacatttcggaaccaatcatacatacaaaaaaagcatcctttttccaggcaaaccattctatacaaaaacaactcaaaattcagtttaatgagatgtaacaacaaaaaggtgctgtcacttacctgaacatgctcagtgtttattatgtgtggagaaggaacaggcaggtgcaggggaggaggaggaatagcttacacacgtctcatactcaccacgaagcagaggctgtgctctgtacttggtcttactgaattttgacaccacctctgtgaggcaggtactattattattcccattttacacatgatgataatggaaaaagatgacagagatattgagtaacttgcccaacctcacagagccaggaaggagtagagtctgggtttataccacagaacaatttgctctttggttctattgcatttagctcttgattgaattctatcttgaaatgtttactagcgcactgtgaaaaattcaaagaaatggaggagacacagtccctgctctcacatcctttattgttgaccagggagataagatgtacatatatgatgctgactaatttcaaatagaagttgagttcacttttgtcccacataactctgtaacctccttacgaagaggggttcatttactcagaaaatattgatgagcacctatgtgcccagatagtctaggactgggggacatcctggggttggaactcagttctaaaaccaggaaagtccccaggcaaatcagggaagttggtcagactaaaagtaattatggctagatactgggagtatgatagtttctgaaacagacatcatctctgccttcacgcagcagtcactctaatggggacccagacagaaaaacagtggagcgaaggtgacaaggagggaagtattgtgcacagcaataccacatactcacagggtggcattagtatggtgttcttagctctaaaaagccaccaaaacaaataaaatcagaaacaaagttttttcaaataattgaaaacctacatttatggatgaggtggaaaaaagataaggccaaaattacacccatggcttgcaaatctgagaaaataggtgtgtatcttagcatattgctagatacccaattaacatctagggtaattctataacacattaactcatcactgagatgccccatataaaaccacgttaagctggaaaagcaaaactttcagtttgggatgttaatatgttaccaaaaccttcctattctcatgggtgtcctggtcccatgaaatgaattcctgagttatcagtttcatttgttattttaaatgaataagaacagaatcagttctcctctttcactactatcaccacccaaaacatgtatctttgaagcaattattacattacagtagcaattaatgtcaacaatataaaaaaaaaacaaatgctcaaaggtgtaaccaaccaaaaccagcacaatcattccctgcattagtgttctctcttttgttctcagcgcatttatcaagtatgcagtagcttctagaaatcacttcaatgaaaactgctcccgacaccactacaatgagttaagtaatcgagaaattagaagctgtgttgacttttcagaagtgtaactaatagctgtagaaaaaggagtccaaaaaaaattaaccaaatgagatgctaatcttctccccaacaccccaccaccgagttttggcagacaaaaattactgagctggagtttggcaactgatgagcaaggcataaatcctgaaaagacttgtcagtcgaaagaaactttgtggctcctctcactatatcctcatctttacttaaaatacacagtacctgctgtgcttgacaattatttcccaaactgttggggagggtgtacacacccatacatgcattttttatctttgtgcacaaactaaatatctttgtataccttgtccacatcatctctatgtatgtctacatagatttgcacatatctttgttcacaaaaggtattgccacagataaattaacttaacatgatatcttggctgaggggtgtcaataagttgttataatttttgtttgtgctaacaaatccctaggtaaaccctcatctttttcctttcccatcttagcaagctcctttgcaagcaaggctcccattaactccaatcaagctttttttccaggccccttaaattaaccactctaggttttagaataaggaaacagcctcgtcacaatgcatcatgtattctgatcaagtgtgtattgttacttccaccctgacagttcccaacctcattttaaatatggccaagaggcctcaagaaatgtagatttataatggaggagatgcgtttgcacctccaaacacaaattatgttaattgggtgttccaactggagccaggaagaggtggcgtgattattctctggaaacctcggtgattggcagccaactcatactgagaaccaggacgggttggctctttggagccatgcagagcacatgccttcctccccttgaataaaggctgctccacactctacctgtccagccgggctgtggtcaagctgctccgcttgccatgcatcaatgccactttgttcagaccgactggctctcaacagtgcccctcctgccgtctgtattatttaaaggagatttatggttgggtgtcttgtgttgtgaaacacaagctgtgacccccgggctgggaagccagcagggaaaaacattaatataacggcacatgggaaaatgaaactcatgggcagcagaaaaaaaaaaaagaaaacagaaagaaaaagaaagaaagaacagaaatgtgagatgtgaaatgcacgaaggtgttacaaactgcactgagtgtttgcattccttctctggtggaacggcaacatatactcaggttaggatggtggtgctggtggtttttgttggtttgtctgtttggattttggtgggggttttttggagaggggttctgtttggctggtttggtttggtttggtttagaagacacagaaacaaatgccaaacaataagggcttatgtttaaaaataacccatgttaactagaggaccaagaaccctggtcgcatattaaagaggaccagataattgtgtcaccattaggatcatttgaagttatacatacttaattaaggggaatcaaaactcatgctgccaggcatgactgatcattggttggctcaggaagaatttacccctcttctaacagaacactctccaagacaggggcactggccattatgagagttcttacagttacagatcaggtcaagaaggaggggaggccgggtgcggtggctgacacctgtaatcccagcactttgggaggccgaggcgggaggatcacaaggtcaggagatcgagaccatcctggccaacatagtaaaaccctgtctctactaaacatacaaaaattagctggacgtggtggcacaggcctttaatcccagctattcaggaggctgaggcaggagaatcactcgaaccagggaggcagaggttgaaccagggaagcagaggttgcagtgagccgagattgcaccactgcactccagcctggtgacagaacgagactctgtctataaaaaaaaaaaaaaaaaaaaaaaaaaaaaatgcaggggaaagaacagagctggaactagaagagcagattttagcatttttaatacaatcagatgtattatttcctaatttcccaactgcatacatttgaaatgaagagacattgtcatcctcattgagctatggaatttgtctgacatttttgttactgactccaatgctagccaaaaatgatttatttgtcctctggtcctcagtgtcccaatctgtaaaatggaaactcactgttcctatcagaaacagggtggccacccaccaagctgtggttcttccaaggatgaaaaagatggtaccagaatcaaattattaaaatgcccttctcacaaaagcataactttctgttaatatttcccttagagaaaggcacattcaatttccattaatggtacttagaaattcgtggaagtaaaccagcatatggatatgctgaagaaggtgggtcaccattaaatcctaaacacacctctatctttgaaaatgtttcagagaactgtgagattcaattactttggtgaaattagatcctatactaaagaaccagtatgttgaatctctgtagcaaagatgatttttttaaactacatattttatgtagatgtgattttctttgctcaataaaaaattaattgatgtatgccctcagactaatctcagaaatacctagtaattttttccccaatctttaagtatttctcagaacaaataggttttatggtttatggaaaaacctggagattgtgagccctgtcttctccagatgtacacaataattggtgcaggatcttggaaagtattaggacaccccttaaacaaaggctggctgaagcctgttgcagtgattcaataggaaattataaagtccagtttgtggccccaaagggaaacactgctgtccttgagtagtccacaaaactctatttccaattagcacctgctgattcagtgtttcacattcacaagaaaaataaatcccctatattttaaagcagtgtgtgtatgccttgcaggggagcaaggcagtcaggggagagtaccgagagcccagcagagagaatttccttccccatgtaccatagtctcctttctatctcttcagtcatggaacacacttctgaaattgcagcagctactagaaaacttccctcaacgagtcgcctatctgaacagggaacctctgcaaatctccttcctttcatgaaatcgctgaatactaaaactaaatgtaacacccattttgtacaaaatgcttagaccttcttcagcgtactctttcaacattcaaggcttgctcatttacctctgtgagctttatgactaactcagtatcactaactacagctgtcagccctcagaggtcagagacatgactgtttacttctatcactaaccagcctggctggttacagctagctacactagctacaaagagacaattaacaaaaaatgtctcatgaggatagaggggtttttttttagttttgttttgtttttaatcatctatcatcctcagggtggagaggggaagaaatgaagacccatttttcttttccatctcatctaaagccaagctataatccattaccactgcaaacagacaacagggcattttctgctacgacagcatacagtaggaacaaatcataacataataatcatcatctcttaaaagccttactcaccccatttcaccttgccctggaatgggattccttgagtaggagagtatacccaccactcctgttatgatccttggctagaaccactgtgagctgagaatctcagcacccactccacatgccctacttggcagctaaaatgtaactattaagtcacactaacattagattagatgatgctgtcatcccattgttatccaatttattcttctctgacatggtatgaagtggttctgcatcaataatgattcataaatacagccatacctgatctctatcaccatttccatgtgctttcacagacaagaaactgctctctcttccatttctccaagttcatttctttagtgggtgagtaatgacagtttcacctccagagtctatttaactataaagaacattcacagaatgacctagatatttggttgataagcacctgctattgactcagggctcatctaagtagtgtgggctgcacatgtcttaggagagtaagggcccttcctcatggatcctcctggtggacacaaagattcccatttctgcacaaacattgcaaatttcacatagccattagtttcacctacggatcccagggacttacccaccaaagttcaagttccagaatgtagtggatgcttagaattcctataatccagagctttgcccaatttaaaatggagtgatatgcataggtgcagtcttgaactactttctaattacttcttgtgcaagcctcttaattcctaagagtactgtatcttggagagcacttaacatacggtgtacccgtcccttctaaatttgctggatcataaaaatcacctgagaatatttaagaatacagattctcaagcctcaccccaggcctactgaactagaatcccttggtacaagggcctggagatgtgtattttaactactctcaggcgattctgacgaacaggagaatttggaaaacagatgggtctcagaggatcttcacaacaactccatgaagaagatagggcaaatgttagctccactttgcagatataataaatggggctcagagaggttagttccctccactatgcctaattccacctcattagctctgtgccatgttttatacatcacttgtattcctgtccttcctactctctatcagcctcaagaaaaaaaaagatgtagcacatgaaaaaggttctagtagttattcttgcaggtagtatagatgctgaccgcaaaggcaattcctgagatattgtcctcaacatttccagaggatgcctgcctatccaggaccaccttctattcctggcatcacttttggtgcacattctgatataatcaacatccattcaagagggcctttttctgcagaggaattcatcaccagaaatactgcacatgaggatataatatacaaaatatctgtacaatacagcttcttaagcaattatcctgtaccgctgggtcacattatgcaacttaatatttcccataacaaaaatagagttctgggatttttaaaatgcgtatgttgttaagttttactttaatcatttgtggcattcttttatattactttactattgcatgtcaaagtaatcagtgaaattaaattttttaaaacttgcattgaaaattaactcacatcagaaataggattaagaccagggcttcatggttctaaagctgaactaagtggaggaaaagacgttccacagggggacatttcacttgacttaacacacgtcagtgggcttgaatgatttctgagaattttccatcagtgttttcagaaatagcctttggtggtctgctttctcgatcctagtgattccagcagaaatggctgtaccccaaaaaggagaaagctgggtactgcatgctcccactgagatttggggagaggttgtgtaaacaactgaagcattaactggactctgcaccagttgtgatttatgtattgcttgggaggagggagggcagtggaaagggccctcggtatgggtttggcaaggcagggagcaggccctccatctctgcctctcggacacctaccaaggatacagtgcctattcagaattcgagttcgtggaggcttttcaatcaataacatatggccatgagagcgcgagtattataccaacagactgaaataaatatgctccgcaaataaaatatctgtacgtaaaacaacaaaggctttagtttaactgcagaaaatgaaaaacaagtctacttgaaaccaggttaaatgagcaaccagttattcagtgtgagtttttggagatgaatgagctggcagatgctttcttcagatcattaagaccagatatcaataatttctgaggagtagaggcaaaagtcatcagaaacaacctgatgtggtggggccacaccctgtctttctccacttggcctggtgtagggagagctgggacacaccagctgtttaaaaagccaagtggctcctaccacaccagcttgttaaccttcatcttacatgcattttttttcctcccagattcatgatctcagattaggtaggtggtgggggcagtgctaaatataccttcctgttacccgagacctggatcagggaaggtgcttattaatatcatggagatatgatttttaatgatctctgaaaacagcctatatgggtgtgaataatggcactgtctcattgcatgcgtggtttgtgcttttgtctcagacaggttcatttttcactggaggggaaaggttcatgccgcacgaggggggtaaccagttgatgttacaaggctgactattaggccccttgctgttccacatgtcacagggaaggactccagccggcaaccttaatgcctacttcagcatcttgaagaaattaatgaacacagcttctatggcaaaacatttcaatcaacccttaccagctgtgcctacatttaagaaaaagaaaaggagggggggaaatgcccaggtttatcaaaaaagtttcttcgaaagatcaaccacggttttggctgtgtgtggggcggtaggaggtggggaaaggaaaggcagaaggaataaaggtagaaggatgccagtaccgagtgccaaaagatgtgctctggccccggtgtttgttgaacaaattaagcacgttctggtttttcacctgctgaagtagcagcagtgcatatggcctagaagttaaaaataaggaaatatgcatacattaccatacttaatggacgaccctctccatttaatatgcaaatttcctgaaatattactgaatgccgtctgttctaaatgaataaatttgaattgcaattagaataatcctttataattaatgaaaactgtcaattttagttcataagtaatttgattaacaggatgatgggacacttatcaagttcactggactgctaggctatgagaaaactgacagtgaaaatggggcgggccaggcactcaggctctaccggagtattatcctaaattattgataacacaagctaatgaacttcagaaagtgaactctgggggcctcatttaaagggacagcctcggagggcgatgggcagccaccgggatgatgatctttccaaaagccttctttgctggtacttttggattgtaggaaaataaatgtttagaaatgccagggcaaaggaaaacattggctcaaaacacaaatttaccatttccagctgttgctggaacaaaaggaaacaatagtcagaggataaatgtaagaagaaacaatgcaaaaacatgtggaaagaagttgctggtaatgcatcacagaagtaggacatggccacagcagcggggccatctccgcttcccttctttgtctctcccttcagacagatcatgaacaagaacttttaactagcattaattggacatttatgtaaagcaatcggggtggggggaattccgtggagacacacaagcaactcttagttatggcacaaacagtaaggagatctgtggcccttaaagaaacagatgcctgttgccttttcacggagggagacaaggaggcagagaagggggttagtgctacaagagaattctggcactcttggttgttgtcgttaatgaagatgaagacatagtaagtaaaaacaagaaaagaagttataaaataagcttgctttatcttttctagaaacggatgacaaaactcaatgcaacaatgccaggcatatcaaaaggggtccacattcaaggctttcacactttctggcaggtgagaaagtttattaagaaccttcacgtgtgggagtctctcaagagcaaaggtctggttttactgattcgcaatgtcctgacagatcttgccttttcatgccttcaacacctgtagctcctgacaagtgtaggtgacctcctgaccgacaaaggggggtccaaatttggctgatgttggctgagtagactgcagtcaggtcatacatagttctttacttcttcttaatcctcctgaacctactgagaagtgcctttatgccaaggatggaaattatctgtccaaagacttcttgtccttgaaaccttagtcaggattcatgtggcaggacaagtgaccctgtcatggatatctcaagatcattaagtaatgatctttcaagattaatattagtcataagaatgcagcattacagaggcacacaatgggcacttctgggaaaatggcagagtcttagcaatctcctttccatctctacgggccacctatatactacttatctcattggatttgatagaacaagataaaatcatcatgtaaaaatagcatgtacaatttactaagatattattctatatgccaaacattgtacaaagttctttaagtcatgaaatacttaaggtggccctggaagtatatattagatccatttagtaggtgaataaactaaggctcagaaagattaagtacctagtccaagcaatcacatccaggaagtggcagagatgggatttgaacccaggtctctctatctctgaagccaaagctgttaacctaatatgtactctgggctgacttccatgttataactgtgtgcttcaatgctggccaaatttaatcatgctatagtttccctcacttttcaattacattttttatttccttactctggaccaccatgactgctagaattgtctgcgtgcattgtccaagccagctcagcgggtatacatttggagccattgtctccccttccatgcaataagcaggtcataaacattgtctttccttctgcaatgtgtgccgcaagcaagacttcagcatcctctgcctcccacaacgtgtctcttgaaaaccatttatttagagctcagttttcgaaatataccaaggacagggtaaggctctttcctggcactcttcactagtgtcctgccttgccactgtcctaactagccaacttcagccctgggagatctataataaaaactgttagctctttgacactcaataaaagaaacaaacaagaaaccaatgatgttcttagttattaagctgcctattatacctaaataaaatcaagcagctggtggccctatgtctctacaaaattaatattgaaagctgtctttgaaccatttagatccttcgtacatactctccaagcctccagttccctcattctttccagcaatacaagcaattcttgtcctccttactcctttcatttgcttataacactcggaggatttctttgtttttccctataacctacccccatctgtaaacctccaaagtaataacaacacagacctacctggataccagctccactgaatggagcaggaggtctttagagaccatccggcttgatgtttctcaagggtcatgtgcaaaccactgattttaggtatacacacttgttagtggttatgtatttatcttcatgtgtgttaggaaagaaaaaccgtaagtggcacatcaaacttttaattttagagagcattgcttagctcaaaacctaagtgaatatttagctaagaaacagtgaatagacttcttctattataaagacaaatatggagtaaatattccaggtggtactcatctatagcaaaagtcacagcgagtctgtgaatgacgggacatccagaaaaactgatctagcccaaactccctctttttcctcaagggatgcactgaaggtcagggaagttaaataagtttcctgaggccatgcagcaaagaggaaaggctggagctagaactcagatatcccatgaggtcatctttcctgtcacagggacccaggccttcatcgtgggtccctttgggaagaaagggggatgtgtactctaggaacactgcccagaacactgaggccattgaagacagaagagagagagaaggcaagtggcagggctccctaggcctcactctccttcagccagggcagcttttcttgggagaggttttatttgcaggctttctctatttcatttgaaagaagaattttatggcgattttgtttaaagaattccactgatactagcaatgattaaaaagccctcaaactactggaaactctttcagtcttcttgtattttgcaaccttgcttatggtgaaggaagttggtctccatcagcatcatctagcttctcccaaaacatggcttaagggccatttatactagcatctcctgggttggggaggagggttctgttaaaaggcagaatcctcaggctcacccaactttatagaaacagactcttgacatcaactctaatgaggtgcacttttaactagtttcttaggtgatttctctgtgagctaaggcttgagaactgatactggggaagaatggattaccattagtgttacgagacagagaattagtaagagataaagagattgagactaagacagaaagactgagaaactgagatttaataatttactgatccctcagtggaacactgtgtgtatagttaagccactttatgataaggttatctgagggctcatgtaactaaacccacctctcacccatctctctccactccccacacttacccttactttacattggttcatctctggagagaatggactaacactgaagttattatttatttaccaaatactcagagcagcatcctgtgtgctgggcaaggcataccaaaattagggcaagttactgtccaataggaagctccgttctggtacaaagtcagcccatgcattcagaaatgcatgcttgctttcttgaaatttaggttaagggagggcttatatatagaaattagctgctgacagagtttgaatgggctttcaactaaggcattcattatccatgaagccaacccttccaatattccatggcctagagttctttgcaaatggctgttaaaaatcacatttggtgaaagaacagaattttctccttggtaattcagctctgaactcactccatctgtttagcacttgttgggcctgcgaggatgtgcagacactctccagtgctgacatgggtggccacctcccaaagagcaagaaacaaacctgctttcatcagctgctggcatttatgagggtcttaggatgaaattaagattttttttttttttgaaatggaagtttggaataataacaaccttgtagggggaacatggtactcatgttgcttgggtaacatgtggtctaagtagccagaggagaaaatccccggagagggttatctcatagataacaccaatcatatctgagaggccagtgagaacaatcttgatgcctgcaatattttaatctataacatgggatgtcaccaaataatgtgctggaaaacaacagagaaacataaagacaccaaatgaaaaagcagatctcccttcaactttgagaatgagaagttacaaatcatcaatgtctagcaaagacatattccaacaacggtgctcatttttttgaataaataaacaccagggaactagcctgggaaacctgaaacagaaccacatcttctctcaactaaaggcttattaacagcatatgtggggacaaaggataggaatattctgagggcaaggagagtaaagttgcatttattgatcaaactcctaccaaatgccaagcaccatatgcatcgattatctcatttaatcctctcaaaaaacacgacggtacatattattatcccaatttacagataggaatctgaagtttatcaagattaagcaactttccaactgaacagggctttaaagacaggactctaatttctaagctgtgtttttctgctatatgcattgcccatagccccacaaaaggacagaaagaaaaatctagaggaaaaaaatcagatctctgaaaactgtctataaattccccacaataaaaataacaataaccatgatatcctagcacctctttaggtatatgtgtacataacttgcaacatatatatatgagaaattacaaatcatcaatatttagaaagatgtattccaaaaaaggtgctcattatatacatatgtgtgtgtgtgtgtgtatgtgtgtgtgtatacacacatatgcttaatgtaatcttcttaacaatcctatcaggtatcatgattgaggtgaggatgctgaagctgagttagggacatgctcaggtttacacagcaactaaataaccaaactgagatccaaacccagatttgtctggtccccaaacccctggacttcctatcatattgttctaccttttccatccctttcaactggatgtgaaggtgaaccagaatctgaaacttcagctctaaagaggctgaaaagaatatgtcgttccctgccctccaatacctctgctttgtacctactggacacatggcaggccttggtggccagtgtccacagtaaaagttagtgacttgaaaggcatgtgcagcaggcaatgccaagggaacttttctttcttctttttttttttaaagaaacacagtcttgctctgttgcccagcctggagtgcagtggtgcaatcatagctcactgcagcctgcaactcctgggctcaaatgatcctcccttctcagcctcccaagtagctgggattataggcatgagccactgcacttggctccatttttttttaacaggaactcttgtgagtcaatcacacctcatagatatgcttgccccttttccttttagtgcaggctctggcaccagcgtgactccctgaaacccacttggtggaagggatgacagcactggagaggatgccatgaatatggaagtccctgtgttttaatttgcctaaaaatctgcatgttgttaaaacaaatgtagaaattagccatatgggaacctagcttgggtacatatcttcatctgtcaccacatttgggggtggaaatagtacaggatcatttgcagtgcttagacttgtagagagggagaaaagtccacttggaagcaagctaatgctgcacacgtttatgcgtttgacctcacaatatggtaactaatgatggttctgcaaatagacttaggaaaatagatgaatgattacagagggaagaacccagcaagggtgatgagcttcgtttcgcctatgttagcccttaatccttaacaggacagccagcacaaattctatacagcttgcctaaatagatgaaatctacaccttattctgaattcaaatcttagacccagtgcatataatacactgccttaatagctttccaaactctcatttggcctcagttatacaaccagctgacactgaaaataattaatgccctttaggactcgcatctgctcctatggttccaagtcaaggtttttaattgggctattttggcatttggagacaatggcaaggtgaaataacctttctttaatatttttgaggtcagcagatagtcctgccaaaggtcatccttcaggttcacaaatgagtcatttgtatcacctaatgcaatctgtgactcgcaaattgcactgggctgtgttagcgtgcattaattagtccatgtgatgaatactgaattcatcattaccagccggagcttgtagagatgtaccaatacttgttttggcggtttgtggttgcttatttttactttgcactccacttccaaccctggtctgagatcttcaacaccgcaagcccaataattggcacagcaaagttaaccctctcccttatgacatggccagaacctggggaaagattccctggcacaaacatattgcaaagcacgaagcaaccacagttgctctatctttggtttattgaacctgtaaaactcagcatcaaaagatgattcccttttgcctcacgatccatagcattcctaatcttctaaaagagagagagagacagagacagacagcgaaaactcctgtttcaaacaccttgctcagagcagtgctcttagttgtgctgggttctctcagctgcttggcagctactgcctataatgaaggcattattaatttcagtttcaggggatagaaaatcaggatgtggacactgtatggctataccatctgtgccgttgacatatattgattcataccttcttcccatctgtccttgacattgtgcagtaacagaggtcacagtcttctctttcctagaattctccccaaaagcaactttctacccagtatcctctcagtgatttgatttggttgctattgtgcacttctaaggaagctggtggcagagtgtctgcatctgtcatcccccaggtaagtccctttgacccaacataacaataaccgaccacatcaaaagggtgtaggaaaacaatagttcttccactttgctggaagacagagtcagcaaggggcagacatttaaaatagatcttccatttctccagaattttgtggataacaaagagaattaatgcatcactctagaaattagcacattcattttatacagaaaggtacagtagccaattaaattacacacagcagatctaagggttggaaaagtagatttacggaaagttaagaagctgaaaaacagcaggtgggtatgtcttgctctacattatggacactaagagaaaaattaagtctccagttactgggatatatgtgtgtcttatgtttaatgtgcattttttgaaaaaagaactgttcaggttattgtcacttcagaattgagaaagcctgagccagatttcagagggattttatttcaaggactatcatttattttattttactcttttttctaaccactctctgtccaggtggaatgagacacacaaataactgaattcacaatggactttttgagaattcaagtggccacttgtatctgcaaagtaagaagtaagtggctaattgcagccgaaatgaatggctgagcctacaattagccaattaggtggtctattagcaggaggggcgatttgaacgcagaaagcccctccgtggagcccgaaggccttggggctttccagcaaaacccaggaagagcgttagcctcttcatcaaagcaaagctagactgctcagaatcagagaactgtcagtttattcctaaagctctaaaattctccaggtccaggtgataagtaacacccttccaatgggggtaaaatttttttaaagattttaacagctgcctgaaaagcttccttttcaaagtatatccccaaccttactttatccataaaaatcatctcctcctctctctccttctcttaaaattacagattaaaacttatctggcattctcatcccatatttaatgatgaaaatgaatccatctttcagttattccttagagaaaatattgccactttcaaaatattttaagaaattttgccttattatggagggtgggtctcagatcgctccatcaattttattacaaaacaggaaatttagttttgttgaagccatgtagctctgctgagcttctgcaatatcgggcaaagaatgaaagtgctgggtggcgggaggtgggatttgaaaaaagccacgttataccaaagggatatactattagtttccttaagtctgctctagaggaaatagcttaaatcaagaaactggacaagccacgcctcttctgggtctcaaattgtacccatgtgtaaaaccagtgcccagcccatttcactgtaaggtccctttcagatccaagtctcaatgattctgaatcaacaaatctcaaatttcgtgaactagtgatggaccagtcaaaaggaagattcaaaagcaattacctctgagctcaaaagccaaacctgggcattgtttactgcctctttcttttagccttttttgggtacagcaacattttaatggtcttacttgaaactacattcacacagagttgtactgttttaatcactagttttaagcccttgagaccttctccgcagctcagatgtgttattcacaaaacattgtcccttgtgagaatgacaagacaaagtttttagtcatctaactttttatcccctagcattccactcctgggttcaccctggggctcaggcagcccatctacatcagctctgccccatgatgggtaaacaatttgccgagaaggcaaattacgtggtgggctgttgttccatttcacctgcagtctttctgccttttcgctgtgaaagctcactaccttcctcatgccagatgctgcagagtggaaggaggttttccacgcaattccctcatgtctctgtaacatgcaggtcctttcagtgtgttgcaaaagccacatcgtaaggtcctggcagaacacaaatccctggatgccactggacaaagaaaatctccttcatttgttcaacatagacatagatgcagagggcaaatccttctctccccacaccagccacagctgagtgaggcagcatcataggtctgtttcctacacctttctccatgtggcattcagaatgatcttttaaaaatgataaactgggccgggtgcggtggttcacgcctataatcccagcagtttggaaggccgaggcgggcggatcacgaggtcacgagatcgagaccatactggctaacacggtgaaaccccgtctctactaaaaatacaaaaaaattagccgggcgtggtggcgggcgcctgtagtcccagctactccggaggctgaggcaggagaatggcgtgaacccaggaggcgcagcttgtggtgagccgagatcgcgccactgcactccagcctgggcaacagagcgagactctgtctcaaaaaaaaaaaaaaaaaaaaaaaagataaactgaatcacgtgcccatccttcctttctgtagtttagcctcccctctaaatggtttttgctgcttttagaaggaaatccaatctctagcatggccccactcctgcctactcctctacagccatctcttgccactgtgtgcagctttctttctgttcctcaaataaactaaactcaccccaatctcagggcctttgcacatgctgttcccactgcctgaaatagttctcctcacacccaaaatcaatgcattcaccagctgggtcgcctttctggaaagggaatctctcactgcccaatctaaagtaatccctatcggtggccatgaatcacctctttatgaaatcaacctgctttattttcctcacagcacatatcacttttatcttattgtctagctccctgctaggatgcaagagctatcagaataggggccttgtctgcctgttcacctctttattgccaggaataaagcaaacacagagtgaatatacaataaatatttgttaagtaaatgaatggtgcataactggatagataaatggaagatttcctggcctcccttgtggccatgtgactaattctgaccaatggatgcatggagaagtgataagtgtaacttcctcaaagatctccaaagggaaagggctccctcttcttctctccttcctccttccactggccaccatgtgcaggtaaaggctgaagctccagcaactctctctgatggttaggtgaccttgggaattgtagccatgcacaacagaagaaaatagaaaccagggccccaacatcacagagccacaccccacactgcaccatctccagatttcctaaacaggaaaacaaacaaataagcaagcttctgttacttaagctactgttatttggtaggagtgtggtgggtggagatgagtgggaattaattacaacctaacttaattctaattaatatatcaactgtttttaaactgagaaggtcatgctcttggaagagaatcagtgtgctaatacataagaacagaaacagtccacaatattattcccactacccatgtgtccaggaacaaagtttggtgggctctaaaaagaaaatgaatcaaaatggtacaagaggaatttctttcaatagcttcaaagttggaggtttacttcaagacaaaattataaaagcaaatagtgcctgcttaatacattttatttatacttccaccattgaaatgtgcctttaatataagggttatatttctaaacccccaaaaatcctttccataactattattctataaaaataataaagcctaactcttcatatctatgtgtatttcaacaagtataccaagcaccctagctcatttctatttaggtctacttataagcaaatgatagcgcatttgttatatcttaataaatgcatcccctgtgatgtcaaaatttaatattaacttttgcatattgattctgaaggtaacaataagaaacaatgacatcaccatacacattaggattattagatgtcaaaatgttccaacccagtatattattagaaataactatcttattggccgggcgcagtggatcacgcctgtaatcccagcactttgggaggccaaagtgggtggatcacaaggtcaggagttcaagaccagcctggccagtatggtgaaaccccgtctctactaaaaatacaaaaattagccaggcatggtggcacacacctgtaatcccagctacttgggaggctgaggcagaagaatcgcttgaacccaggaggcagaggtggcagtgagccaagattgagccactgcactccagcctgggtgacaaagacagagagactacatttcaaaaaaaaaaaaaagaaaagaaaaaagaaaaagaaagaaagaactatcttatttaaattattggtccacagcaatgaaaatgcccaggatttattgtacaaataatagccctcttaataagttgtctatacagactttagtaatgtattaattgcaaccgaatcaatacaaccacaaataaaggacgttattatttacaaagcaacgagccagtggaaaagcaagccttccttgttgatgcaatgaatgccaagaaataaaagtaatccaggcctcttgaccctacctgccttcacccataactcaaggcaaatttaaggtggcttcaccccatctatgcaatgtggatctgaggtgagaagatgcataaaaagatttgcagcggtattactgtggacaaattacttctttgatgttcatttccatcaactataagtagggataacactagttcttatctgtagaaatatcgtgagcattgaatgtgataactttgcagaatggcgaatagtaagcactcattacatgccagttaccatcataatcatcatcgatgttgtcatcatttttctccgtgctctttccttaactagatcttctatcatgaatgcaagaggtgtcctgagttttgtttcagttcatgaaccactgctttgttcttcttcttgtgtcccggagccccaaacagtgcctgaaattcagtgctttcctcatatctatgagcagagcttgggctggcaagtaatgctatatataccagcaagtacacagcttatcattttccaagttagcaccattattcattctaataatacaggaattaaagtggcttcaaaaaagaaaggcctttttcacatcaatgccagcaggcacagcccatatcatgctaaatgccattctgggtacttcccagaaaatattggcagccaagttcccagaggccgtctgcacccaatagataagatgaggcaaagaaaactgtactggaagagatcaatgaccttgctggcttgtgtttggctatcaattatctttgctatcacttactatgttccaggcactgttctgaacactttacacagattctctcatttaatctttgtaacaaatcatatgaagaagccatcattagtacaccctctttacagttgaggaagctcaggatgagggtgtttaaacagattgcctaaaatcaaacacagctagaaatctgcagatctaggcttcacacccaggcagcctgcctaaaacctatttctcacaacaccactctataatgttctaaaaagttgctttaaccatttaaacatttatggatcctactatctccagccagaggcctctgaggacaacttggagagaaaccatatgatggttaattatgatctcagggtgtcagatacataagggttcaaatccctcccaggcctgcctctactagcctgatctctctttgactcatttttctcatctgtgaaatggggatgacaataggacctgctccataggcttgtaaagatcaaatgatatgttagagtaaaatgcttagcacagtgccgggcacatagtaagtgttcaataaataaatatgttcattcattgttctcccctttttcagaaatatattatcaaaaaaacagaaataggagccctgttacttatcacattcagctttaaaaagcacccctctgcccacatctggatgataaaatgtgattcttatgaaaaaaaataattttttggcaccatgctccctatctgcaattacatcaaaatcacattaattgagctataacactgtcaggcttagcagctggaaagcacatccatacattctaaagagaaggccattaattcagctctctacagcgcagcaatgaaattgggatgtccattcttcagtgtgatttactgtctttcaagccgcttaagtgggaacctctacaaaaagatttaagttaagtgactcttgtgctgctctgaagctcatttattattgaattaagttttcatttcgtttaaagggaataaagaaatatagttttatttgaaacaaggtaaaacatttaaaagaaatcagctattatgatccaggaagccagtttatatatctgcaaatgatctcactctgcttatgctctgctgaaaagccaaatttaaactcataaatattgctaatatgcatataatttgagacttttgcatgacagctcacccttactttttgtgttttatcattcctctcttttaaaaatttttaaatctttttttaaaaatcaagacagttagacactgggctagagaagaaaccaggcagaaataaacatccattttcgaaaagtctagattttctttatgacatgaagggaaaagtaggagggagagacagaggcagagagatacatgttataggttatcagtgtgtggcagaaaaatcaaagtatggcagacatataatattaaaagatttagagcgtcctggtccacagatgaatcgcgtgtggcaagcaaacagagagtaattctctactagtagagtatgtacaacttcagtgcctaaattatcagcctttgtatcaggcatcaggcgacaaagcttctttagaattagtgaccctgtctgtccacagtacagataaaagaaatggtatatttctacataatgtttcctcttctaagcctcatgcaaaacagccaagagtaatattccctatacgaagaagtccctaaagaactaagtacttctgaacaaactatatttttaaaaagtctgctaggacccctataatggtgtcatttacactccagtcacatgtgtctacagcacaagacccttcataattaggtatatacactataccagctcactgcctaattagcaaattatgttgaaaatagcatcctgctaattaacagttattatggcatttctgaagctgaggctttaattatcaccaacctaatgcttgtgtacagagaaaaaaagcccctcccctttttaaatgatcaataagtgcaaaagattattataaggcaaatctgctgacagctgattaatttgtttgatgcaaagttgctgcgtgtttcagattattttatgggagttgcaggaaaaaggtacataattcggtttcattagcaacctctgcgatttatcactagaaaatgcaccccctacaccttttttgttgtttgttcaattccctctgtgtttttgcctgtaccagcatcaaagtcaagagcaggaagttttaattaagtgacactaatgaggtcgttgaaaatgatacttcagcaattcagcgtgctgttaaatgtgtttattctataatgtcatcaaaggtgattgttttccctcgtaatagataaaattcattaccataagcattgtacttttgagtgttagaaatacgaaatgcaagttagtcaggtgtatctgttacttttttttttcctttggctgccaattcaaattactggacctaaaacaaaacttgagcaaaaaaggctcgagctgttttctagtttttttgtttttttttttgtttgtttttttttggttgttaagtctcccatgtttagtaattaacagaccccgccagagaggaacagaacaaaaatgagcatgcaaatgactaatcaaggaaagctggaatcaacaagatatgggtaaaaagatgctcctctgagcctggccatcatgcggcaggttctgcgcctctgatcacactgagctgcccaccttcccatgccctggaggtaaagctatgtagtcctaccctggtagcataggctgtgccactacacaattcagcatttgacttgaacaagaatgggatactttggatacttttttctttaaaatggttccagtctcccaaacacaagtatggttgtatgatgcattttaggaatttatttatcacactgtgaatttccacactgccttcttcataagaattcaaaatgcttgttcacatttctaaggcatctaatggggggcaagtattaaaatgcctccattttacagataaggtaaactgagcaaagtaatttatcccaggtcagaggcaaagcaagtataagccctgttccaatctcaccaagtcataccacctctgcaattcaaaatggtctcctttaattttctcaggttacccaaaaaaaaaaacacattttcatatcttgcacaaactaaaaagctctacagtgtttctatggcagcctgtttctttgcaaatgggggtccagtgttagacatctacatttttaatctttcatttttataagcaatgctttgctgaacatctctgattttcttacgatggaaatgatgatgctgtgcacagcaaactcttcatcaaagcagcaggtccagtcccatatctcacctgctttagccaacagtaattatttcccactaagctgcccatttctagtttactttttttaaatgccaaagaaaagccattctgacccatcacattttataacttaaagcggtcactatttttcctatagcggtgttgctgattcagagtaagctcaacatactccacacttatttactgactacccagccacagatcaggaaaaagcaggtgttcgggggattttgtcaatacacttaactactgtgaatgaaaaatgaaaattgttttccttcctcatggtattcatgttttgggctggtttgatcctagagcaaggggttgaattagatgacctcgtggagttttttagaacactctcaaagactgtctccatcaaaatttttagtcagttccctgaaacatctcaggaaatgcaaacatcagtatcatggagcaaatcaaactttgacttaatttgtcatttttaaactagttagctgcagaggtacctcaaaatgctctaatattatataaacagtcacttgctttttattggagggttcagcataggaaagaaattagaaatggctcagaagttctaacaaggtggtaaacattccaaatccctatctaatgtgcattaatgccagatgagaatatatagagagaggcataggggcagctaatactctaggaggctgtgaaatgttgacacatcctcctagaaataggagatactcatctacaaattaatggaaggatgtttctagaagaaccagatgcctttaccaattttcatttattgtctggaatttaaacttctgcttctcttcacagttttttttgtttgccaccttacctttagcaaccagccatatgctctttaataaaatggcaaagatgtcaagtaatgatagcactcagcaccagtatggatacagtggatgggcactctcacccgtgggaggggagggagcacacattggcacagcctctctgggaagcactttggtattgcatcaagaatttgaaaacattcatatcctttgagcctgtaattgcacttctaggaatctatcataaggaaatcagggatgcttatcaaagcattatttataaaaatgaaaaaattaaaaacttaaatgtctaacaattgcagattggttagataaatgatgatatatccacatgatacaatattatacagtcattaaaaaacatgtgttctcagaatgcatattaataaaaatagcaacaaggagagggctaaagatgtaacatcaggtataacacatatgtcctcatattcataaatttcaatgcatctatttatgtaagcaataaaataaaagagtagaaaacagatacctaagcgtgaacagtggttattgagggaagataaagtgaaaggcaattttaatgtttatctttatactttgtaaaaagtattcattttaaatatgaaaattataaaataattcaataatatgtcttttttagaatatacccagatgttattagaagttttatattatggtataatttatatcattacataatttataacataatcagtccaaacacacatacttcctctatgaacttcataactatttagccacattcaagcccagagattactgaaatgctggaactgctattatgagacttttagtagggcactcccagaacactcctttaaaagtatctctgtacatcaaacccataatagttacctcagtttgtataaagttgcctgtagattcacatgagacaagagtgtaacatttggagcccagatcatttcttagcatggtccaagatcctcatgggtagatattttccttgaaggatttatttactcactttacagagtgatagacaccctggtctctgatccctcagaacttctgaagccacttttcctttcactgggcttaggataattgtagccaaggctcagttcatttactcttttgtttttttaatttttttcttcctaatcagtgagaaactgtcaatacatacatacggggtatcacttaaattttgaaaactaaaaattcaaagcaaactgggagaaatattttgacatgtaaactttttcccagagactgtttttcaaaaaaaaaaaatgtttgaaattgctttttgctaaaggaagcggggatagttcagctgcaggtagaaaacttaccactataggcaaccatcattcttatgaaggataacataattacaactaaaatgaagacaccgaaagaggtgcacaaaacaagccatcttgtcagctggagatgaggggatcaataaattgtatgcttaacattttcccaatcaaattcttaatacaacaggatttatgtgggctttggagatgctcagaaaaataatatagatttttccctactggagagtaaataaaattcaactactcattaaagggttcactgattgtttgtttgaatcttttcaaagctatgaggaggaagaaagacagctgagaacagagagaccaggacttgcatctttgtcctgttgcttagtaattctgccacttcaggcaagtgacttaacctctctgagccaatggtcactcaccttatttctcaaagggtgtgtaaaagctaagtaacctaacacagagctggagaaatagtaggcattcaatataggtttctttttcactttaaagtaagcatacaaaaacaaataaattagatctgctcacaccccaaaacaaaagaacccaaatgaataaattgaaagcacagatctttcagtaaacacagcacctcctctgctttgcacttccacaaaggacagtctgcgttgatgtcacaatgctttaatgactcttttttgtattttgctcttttattgaattacacaaaaacgaaacttgccctcattcagtatctatcgtactattgaaaatagaatctcaaaaccatgatatggagccacaggcagatttcaccatgcccattacacacaggcaaatgagaatggtgtgtgtgtgttgggtgtaggagtgtgtatgtggtatgattaccaggttaaagggatgacacagactctcctgaatgacttatgggagccgaatctcactttagaaccatgtgtcatttatatgcatattagttccttccttcattcattcattcaacaacctctgcaatgccagtgtagtacagtgcacttcatacacatacacatacacacatacacactcgtacaagagcaatcccaccatcgccatgctgaattgtctccttaaagttatctggaagactgcatgccataccactctgtagagatatgaggggaggtcatttgaaagagagagaaatggaagcttccagagtgaaagatcttgggactgacctttttcttcctctttctccagctctcaagttcaaaggtttttcgtagttcaaataactcactcaaaattcaactctcagacagaccttgcaatgggcagtgttgaatatttggaaagagtacagagtctggcactgtagaacttataatcagtccaaacatttttcctctgttaatttcataactatttgagttagaattcccacaagttatttagtcaaataacttcaatgtccttagtaggttgttatgaagatcaaaggagacaacatatgtaaaacgtttagcacagtgcctggcacatagtattcactaaatgtccttcccagaagaagcagtaagtaaaaattatagcctgaccctgagctaaattctttatgtatatgattgcactcattgcaagtctacaaggcagacattatcattatccccattttacagaaaaggaaacagacttgttgagtttaatttgcccaagattcaacaaaaatgtgttagagccagggtgcaacccaggcaggctggctccagagcctaagatgtaactgactacactacattttttaatctattagattaaaatacatttaagaaaaattggcactagtgtttattcttgggaaatggtggacccagtttttgtttggcctcaatggaggtgctcgggcaggcaagtgtccttcatccagctccccgcccctcatcctattcccctgcccaagagaagatgagaacaaggcgtttgccagaggcatcttggaggcagcagccagtcagaggctgtgttccgagggcacagttaaggtgaactcagagagcacagtccagaggcaccaaggagctgaggacacattccggagacgcaaatgtgctgctgcagcacagccaccccgcttgcccagcaagcctctggggagccatgggcacaggtgctgctgtcccactcccagattagcataagtgaactggggcaggccagctggtagaacaccctatatccactgctgcagactcactgcatgtgcacgcgtgcacacacagatacatacaaatgattagaaaacatatgcagaagaaaaactagacccatctcccaaaaaaggcatttatcaaaaggatagcacatagaaaaagacaaactaacatgattattttcttccctttagtgactctgtttaagatgatcacaattcccatcactataatgagccatttcttggctggagcacatttatacaactctcacccaaaaaagtgcaaaatgtatctgaagtagggaccatgtattcatttaaacaaattcatgacaaacacccactctgtgctgggtatatgccagaaaaagccaatatatatgattccaaaaatctgccaagaacccagaggtttttcaaataagtagatgattcatatttcatttttattcagctatctttgcactgggtggccattgtctgagacagatccctctgctcctcaatagcccaagatagactggttgaattatgtgatgctactggattagaaaatattttttaaaaaaggagaggcttggttttccatcctctttccaaagcaaccaatgaaatgataaataaatatatgtgcatgttccctaggtgtctgacaacacaaaatgccttgctacctccatttttgcttttttgccaagaccagcaaaggggaggtgacatgggataacacatgaaaatggtctttgattagctaccttgtgaaccatatttcctgcctcagtttcccatctcagctgatcatgaatggatgacccacatatatatagcagagagcacaggagaacagacactgcaggcaaagggtctcagttcaaactcagctgccacctgccacctctgtgacttcaggttcaggtttgttactttgtatcctagagacgtggtttcctccttcctatgtaaaggtaataatagtacctaaagttgtaaagactaaatgacatacacatacaaagtgcttagcacattgcctggcacatatgagtgcaccatactaacatcagcatgtggatggcacacggtaggcttcgtaggcttacccagataaatcggtgtcccttcccacatttgcaagctcacaatccacaacaagaatgagaatctattgcaagtcactcctatttcatagtcatgcagttttccagcacatttccactccagcatctgtctacagctatgcactggcttcctcctctggatgggaaactccttgagggcaagaattttgccctgtaaccttaatcttgttgatcttccacttcccccagtatgagccatagtatcacgaacagagtaggcacgagataaatgtttgctggatgggtaaatgaataaaatggagaataggaagtaccaccaaagcaagccctgcaaaagtactgtggctagtcataggaaggagggattgtttttatctgcttataccaaagtagaggttaggggagatcaaagagagggtcatggaggagggcaaccgaaagcttggcttggagaataggctgtacttagtgcgactgactggggagggtcatttcagtctctcggtggcctaaattcatgcttcctctgccctcaatagtacaatgaagtacaggtgcatgaatatcagaagactgggtgggggtacttttccttgcattcaaactcatttttttctgaagtgtccagagtccttatcacagggagttcacatcagctccgtctttcaaagagatttttattttccacccaacctggtttagcatcattgagaaggtcttccatataaaatattaataaataatatagttaggaagcctcggattcattctgggcccttcagtacccctgaaagaaataggcaaattggacagaaatcaaagaagggaagccacgaggattaaagagaacagcagcaggagctacttataagggttcccgcagcaccagccaggaataagcaaagctcagggatgacaaaaagaaccgaggatcaaatactctccctgagcaagggtgtaggcacaccgatgaagggaaagaattgctcagggtcacgcaaaggggtagagcagagcggaatgggatgtaattacagaaaggaaaacttgggctgaatatcagggcaaccttcttaagagcgggctctattcgagtgcggaatggcttcccaagggaggcagtggaagccccatcgcttgaggtgcataaagccactggacaaagagctgagaaagagagtgtgaggaataatctgcctgggcagggggtgggacaggtgacctcacggggccgcacggctccacacttcaatgacacgtcaagatgtatttcatcaggcacccactggcgagagcctgaagcattgtcccccacacccaccccttggccattgtgctttctcaataaaccactcaagaaatattcccattcacttcaagagctcctccatggctcctggctgccagtcagagccatgagaataatgtctcgtcgtggacctggcatgttcacactataaggcaaaatgtacctttctttgaaggaggaattttcactccggctcaagtgccttggtctttgctcctggaatcttgatatttttgttttggttttgttcttgttttgtttgagacccttttcaattcaaaagaaactcattatccttactgccagatcctgaataaccaacataaaattgcgatactttaacatagcctctgaattaatcaatcacctcctttttgctcccaggggagagtccagcatttctgacatgaaccctagtgccttccaggccctgacccaggacagcctgtgcagcttcacctttcacccccctcctcccctcctctgctccagcattataagctatttagggttttccaaacaagctatgttcccttctcctccgggaattgtcccagctgttccctctgtcccaaacactctcatgctcttcccatctttattactgtcttagttggctggggctgccataacaaaataccatagactgtgtggctgataaacaaaggaaatgtatttctcacagttctgaaggctgagaagtccaagatgagggtgctgcagattcaatatctgctgagggctctcttcccagtctgcagagggctgccttcttgctgcaacctcacatggcacaaagaacgagagagagagcgctctcctctcttttcctcttcttatgaagacggtaatgccatcatggcaggggagggctataccttcctaactttctctaaacctaattacctcccaaaaacctcacctcctaataatatcacatcgggggttggagctttgaaataatgaatattggaaagacacaaactttcagtctataacatttcaaagctcaaagctcttctttttttaggacctacccttaaatgttagcttagggcccctccaagagacatctatgacatcctggatttaagtatggaatcactgaacataacgtgtgcttactggtccaactttcccaccagtctccaggagagcaagagctgtgtccatattattttctgctgtaatttcaagacctggcacacatgtgcttttatgcatctaaataaatcaagaggagcagcacattaaatggagcccgtgggcacttggtgctactcattggcctcacatgtacctcagggcttattatgtgcgggacaagggctgagtcttctgaaaaacacaaagataaactagaaactaaccctcaaggacttatagcctagacagagaaaagatgcacatagaaataacctgtgctccaaagtacaaagctgaaagtgccagaagacatggacacatgctatggaaattcagaggcaagatgagtacttccagctgccttagagggagctggaaagcctcctagaagaggctggtagtcaacgtgaagatgatgaccagaaaatgggtataccagatcagcagaccagaataagcaagggcaagaaaatggaaaatctccagcacacctggctcaaacctggatttaattgaaatttagttaaaagggaagctatttggtatcttgaatgtcaagtttgggtttattatgcacacaggggaatgacataatcagactttgctctgtggtatgatttggtggaatgtggacatctgcactacaattgtaggaaaatctttagtctgccactttttaagcactcaatcagcgaatatcagtagtcatggaggattaaccgtgtctgctttccgggcgggggtgggggaggctgcgaggtagctcctacctcagaaatcatctaacaaaatgtcatcatggaaatctgtccttcttggacccacagagcccaggatcccacagaggcgcacaactaccaagctaacaaacaccatggattatgaagtctgaatattccaatttggaattctgaaacagaatacacttataccctctcaaggaatacacttataccctcttaccactctcctcattaaaggcttcacccaggggctttcctgctctctttctaactgcagcacccagtacttacttacctggcgggtagctgtagtgccttgcctcgccctggtgcattctgggagagttttcttgttctcacttcaatttagcagaatcaccagctgcagcctttgctagtaagagaaccacaaagcaactagccaaggagctgggtgtgatggatcctgcaaactgcttcacctggaagaggactgaacaacttggagattgtgtgcaggacggtttctcagtccacacacctgctgaaaccaaagggcaggatttgcccaagaattggaggtcccacatcagatcgcgacgagtccagggagtagtaataactgtgacaacctctactactgtgtccagaactgtggtatcctaggccacttaaatacatcctcttttctaatgttctgaaggtgaagtgattcgtctgatgggaaggatcagtaaacaaaagcttaaagaggtaaaataacttccccaaggccagacagctggcaagtggtgaagctgggatttgaacctaggtttgtctgactctagagcccaggatcttaagcattttgctgtgctatttggctgctgtagttcttggaacgttcttggaacattctcagggagacatcaaagacaggaagttcatacaggccaccttatccagccttttacaaggagagaagataaaacaggctctttccacacaattagccttctgactgcacccccttcaccccaccgccccccccccccccccgcaggtcaaatggaggatggactccaatggaaagtgaatccccaacagaggacacttcctggtggactatctctggaataaaaccactccagatgaaaggatggcctgtatatgaattgaaaccaattatgattataatcattatctgtgtaacatttgggtaggagacagctcctgacagctttttgtgagaagttatgtctgtctgacagagcagactttaattgaaaatgtcaaccaccttgaagatcattagggcaaagctcttagcctcaagaaaagacaaaactgaaaacaatcatctgttgctgactaccaccagctgtattggggtggacagaaaaaagatgaacatatggcacgtggggcttttctgtaaaccattcacgcacctcaggtttgctgtgagtgaaagagacactcattccagacacacacatttgaggaagaatgataatgtgaggggttagacccaaacaatgcagactggagacgttgaatcaggaacacgtacaaatacagcaaacctctcaagcataaattcttgtagcaagaacccagcttttcagaggcaaaggaaccaatacaatggaaccatctatagtcagagcctaataacactgcaagtttcgaaggaagatattcgttcatcctgtctctgtcctcctcctaaacacactctataggggcacacgcacacacactcatgcacacatttatcatcaggatttccactgaattatccaaacttaactgcttcttccaaggatccaaagatccttgatcctagattttaagatctagatgctagaacccaagatcttaaccattttgttatgctatttggttgctatatatcttggaacaaagccttggtatagtgggggtgtgatagcacctgcaaactgcctcacctgtgtgcaggatgctttctcagtccacacccctgctgaaaccaaagggcaggatttgcccaaggattaggggtcccacatcagatggtgatgagtccaaggagtagtaataactgcaacaacctctactactgtatccagaactgtggtatcctaggccacttaaatacatcctcttttctaatgctctgaaggtgaagtgattcgtcggatgggaaggatcagtaaacaaaagccttggtatagttgtgaatagtttcccagctgatatgtctttagtagttttctgaggaaacaaaaggcatgtgactattagagaaagatgcattttataaatatgcaatattcttttcactacaaacactgaaaatgagaaagaaagcagtgggtaaaaattcagatattaatacatatatcatttaggggatttctctgacaaactgtgctatataaaataaaatatatacacagtacttatttttaatacttttatctcattgtgaagcagtgtcctaagatatcatcacatttagcattgtgtccctgtatatatgaaacccctatctggtaatatacaaagaacatcaaatataatatcattaactaactgtcaagagccctagctctgaaatcagaccacctgcattcaatcctagttctatcactgactcatcatgtaaccttgggcaagttacttcagctattttagctttacaaagtttatttataaattggggataataatagtagctggaaccccataggaaaaaaacatttagcacagtgtttgacacgtggtaagccctcaacaaatgagagtccttattaatattgtatgttgttttgcttcactggacattagaattgggtaagtgggactggattactagttatcatgaattccaaatagagactttaatttcaaatacaaggaaatagggatccagtgaaggtttttgaaggaggaatggtctactaaagtggtctttaagaaagttccagcccgtggggtttaatacactgtaaggagaaatgctggaatagagtggccatctagaaaggctctacaatgacccagggttggcgccatacatctccagaagagaatagtagaaatggcaaaagcaaggcaagtgttgttgcaagaatgtggtcgaaggaggaggagggggaagaagggaggggagaggagagaaagagaaaagatagtagaagagggagggggaaggaggggagaggagagaaagagaaaagatagtagaagagggagggggaaggagggaaggaggaagagaggaagggaggaagggaggaaaggaggaagggagggaggggggaaggaatgaagggagggaagtgggagggagggagggagggagggaaagaaagagaaaagactgtttcaggtgactagaaagactgatcatgagtcacaaatgaatccagggcagtcatctgacgaattgaatcttctgtctttcaggaggtcacattaatgcaaacagaggccagaatgacacataggctagtcatcattctaactagacagtctttagggaatctttagggctaacttccagagtctaaaagtgtactgataaccattcattcacttcatttagcaagtgtttattggatacacacacacacacacacacacacacacattccggaggcactgtgccaggctctgaggacacaagagagaaaaaagcagtgctcctttggatcttaaaatctagcaaggtgaaaggctatataataattacagaaagaagtaattaattccagttgtgatatatattatacgtggcatccataactggatccaaatctccccagaaaagcttctaaacagaacaggtctctcttgacatatgcatacaagacctctaacataacttccagaatcattctgggttctagaatcagggaggcaagctgagcagattttacctaagagtgtggcagtgcctcttctaagcagaagtctgaattcctgggaaaactgtgaaccatctctgaaatctcaactgaaatgggaaacagaatagtggggagggcagggggcgccagggaccctgaaatgggaaagaaggcattgaaatattctatgcagcacaactgctccatgtttgggtcaatcaagtgacttataatcatttctctcataatctatagaaaataagattatgcaaaatcagcagttggaaatgccagaccctcttgtgcagggaaagctttatcatcacactgatttccactgagcccggactgcgccttcctagacttcccatcaaagcactccaagcagccacaagcaattgatttgtgtaagcaggagagacaaaacttatttgaaattcatcagttattctttacttttttattattatactttaagttctgggatacatgtgcagaacatgcaggtttgttacataggtatacatgtgccatggtggtttgctgcacccatcaacccgtcatctacattagtttctcctaatgccatccctccccttgtcctccacccccctacaggccccagcatgtgatgttcccctccctgtgcccatatattctcattgttcaactcccaagtatgagtgagaacatgcagtgtttgcttttttgttcctgtgttagtttgctgagaatgatggtttccagctttatccatatccctgcaaaggacatgaactcattcttttttatggccacatagtattccatggtgtatatgtgccacgttttctttatccagtctatcattgatgggcatttggattggttccaaatctttgctattgtgaatagtgcttcaataaacatacgtgtgcatgtgtctttatagtagaatgatttatgatcctttgggtatacacccagtaacgggattgctgggtcaaattgtatttctggttctagatccttgaggaatcaccacactatcttccacagtggttgaactaatttacattcccaccaacagtgtaaaagtgttcctatttctccacatcctctccaccatctgttgtttcctgacttttgaatgatcaccattctaactggcgtgagatgggatctcattgtggttttgatttgcatttctctaatgaccagcgatgatgagcttttattcatatgtttgttggccacataaaagtcttctttagaaaaatgactgttcatttccttcacccactttttgatggggttgttggtttttttctcttgtaaatttgtttaagttccatgtagattctggatattagccctttgtcagatggatagattgcaaaaattttctcccattctgtaggttgcctgttcactctgataatagtttattttgctgtgcagaagctctttagtttaattagatcccatttgtcaatgttggcttttgttgcaattgcctttagtattttagtcatgaagtctttgcccatgcctatgtcctaaatggtattgcctagattttcttctagggtttttatggttttaggttttaggtttaaatctttaatccatcttgagttaatttttgtataagatgtaaggaaggggtccagtttcagttttctgcatacagctggacagttttcccaacgccatttattaaataggggattctttccccattacttgtttttgtcaggtttgtcaaagatcagatggttgtagatgtgtggtgttatttctgaggcctctgttctgttccattggtctatatatctgttttggtactggtaccatgaaattccgagttgaaaattctttaagaatgttgaatattggcccccactctcttctggcttgtagggtttctgcagagagatctgctgttagtctgatgggcttccctttgtgggtaacccaacctttctctctggctgtccttaacattttttccttcatttcaaccttggtgaatctgacaattatgtgtcttggggctgctcttctcaaggagtatctttgtggtgttctctgtatttcctgaattagaatgttggcctgccttgctaggttgggtaagttctcctggatgatatcctgtatgatattctggatgatttccaacttggttccattctccccatcactttcaggtacaccaatcagacatagatttggtcttttcacatagtctcatatttcttggaggctttgttcattccttttcattcttttttctctaatcttgtcttcatgctttatttcattaagttgatcttcaatctctgatatcctttcttccacttgatcaatttggctattgatacttctgtatgtttcgggaagttctcgtgctgtgtttttcagctccatcaggtcatttatgttcttctctaaactggttattctagttagcaatttctctaaccttttatcaaggttcttagcttccttgcattgggttagaacatgctcctttagctcaaaggagtttgttattacccaccttctgaagcctacttctgtcaattcgtcaaactaattctccatcctgttttgttcccttgctggcgagcagttgtgatcctttggaggagaagaggcatcccggtttttggcattttcagcctttttcactggtttttcctcatcttcatggatttatatacctttggtctttgctattggtgaccttcagatggagtttttgcttggtcgtccttctttttgatgttgatactattgctttctgtttgttagttttccttctaacagtcaggcccctcttctgcaggtctgctggagtttgctgggggtccactccagaccctgtttgcctaggtatcaccagcggaggctgcagaacagccaagactgctgcctgttccttcctctggaagcttcatcccagaggggcacccaccaaatgccagccagagctctcctgtatgacgtgtctgtcgaccactgctgggaggtgtctctccatcaggaggcatgggggtcagggacccacttaaggagtcagtctgtcccttattagaactccaatactgtgctgggagatctgctgctctcttcagagccagcaggcaggagcgtttaagtctgctgaagctgcacccacagctgccccttcaccaaggtgctctgtcccagggagatggaagttttatctataagcccctgactggggctgctgcctttctttcagaggtgccctgcccagagaggaggaatctagagagacggtctggctacagcggctctgtggcactgcagtgagctccccctagctggaacttcccagtggctttgttaacactgtgaggggaaaaacatctactcaagcctctgtaatggcaaatgcccctccccccaccaacctcaagcatcccaggttgacttcagactgctgtgctggcagcaagaatttcaggccagtggatcttagcttgctgggctccatgggggtgggatccactgagcaaaaccacttggctccctggcttcagcctcctttccaggggagtgagcggttctgtctcactggcattccaggcgccaccagggtatggaaaaaaaaaaaactcctgcagctagctcggtgtctacccaaagggccgcccagttttgtgcttgaaacccagggccattgtggtattggcaaccgggagaatctcctggtctgtgggttgtgaagagcatgggcaaagcatagtatctgggccagatagcaccatccctcacagcagggtccctcacggcttcccttggctaggggagggagtttcctgactgcttgtgctttccaggtgaggcagcgccccgtcctgcttctgctcgccctccctgggctgcacccactgtctaaccaatcccaatgagatgaactgggaatctcagttggaaatgcagaaatcacctgccttctgcattggtctcactgggagctgcagacaggagctgttcctattcggccatcttgcctgggaacttccttaaggttttctctaatctatgccatgacaatctataactctagattcaggaggaacacagagggatagcagccaacagaaatcgtaaaggagaagtaatcatgtctgagcaaagctaaatacgaaagtaaagagttgggatgaaaatcatttacctcctgtgtagaaatggaggttgaaggagaacaggagaaatgtggagcccccttttaaaagttccctccctaaatcgctgaagcatccttactccattaacaaccagcttttgcttttaaagcactagttctcttggtatttacctccagcactgcaacagaaaaaaatttcagcatatactgaagaacttgtaatgatcttttaagacatgaatcccccattcctagagggtgagtgtgcttcctaagaactattctggaagcaaaattgacagactgtcacaggaacagagagattccagtttttcctgcatcggggtggagggtacgggtgggtgtgtcaaaacatcactacattctcccaggttggagccctcattccgttctttgctggggggagatctgggttcttctcacacacatgcttgtctctgtgatgtaggggaggcccgagggcaggccaatggcagctgctgcccagccaaaggagaggaagctagtttactacaggatataaatagagtgacagagcccctcacagagggatgtacactggaatgtttaaaaaaaaaaaccactgtagcaggggcattattcaagcatactgtataagggccaaaattgcttaaaatggctttcaaaaacataagtctgagattgctccttgggtgtgttatttttatctattccactgggattaagcatggcctagaatcccagcttgaaaggggagagccaaatttgcactacctgctatctctctgtatcatcaggactcatcttcagaaatctggacgtggacaccactgacacaaaggaagcacaattaaagcctgagaagaggccggtctgcgctctcccagagccaaatgaaccctcccttgctttctccagtctccagccctgctcagcgaccctgcctttgactgacatgtggcattctcgtcttcatggacagagaagccgagctctcgatggttatcgacattagaaaatgtcatgtctgaatacgcttcagccggaccttcctcccctacttcattccctgcctcccgcccctcagtttattttaattatacaatgaaaactctcaagtatggaatggctgcctgctgtatcacacaagcccttaattgtactctggagttggatcatggcattttatcaccctgcaatggtaaaaggcacatttgcaacaggagtaggtcatggaatattttctggaaatgccaatggatttcaaggcccttccttttttatactagacatttgtgatttttgtctgtgcatataggagaatagtaatttatatccccttttataccttttcctgttctccttacaattctatataattccccaacttattctttacattgatgaatattaatgacttgatccataatcacttgtctcttatcaatccacaaaagcatttgagcagatttaattttcgaattatcatagtttccacatcgtgatggcatacccatttatcattcttctagttcctttaaaacgttttcattatgggcaaggtgcagtggctcacatctgtaatcccaagcactttgggaggtaaagatgggaggattgcttgaggccaggagtttgagaccagcctgggcaacacagtgagacccccatctctacaaaaacaactttttaaactttttaaaattaaaaactaaaaagaaaatattttcttcaggaaaaagaacagatcacaatagacaaactatgttcaggctttttccaaaagaggccacttcaacaagtaagataatttcctagaagataaaaaggtgacccacacccaatctagacatggctggccaatgtggtactttggtttagatgtctatatctgcctctttcaacaaatacaggctttcccattgtatctattcaataaatgttcaccaagtaaatcttctcagtcatgaacttcaaatgtgcgctaagccatacacaccctacccatatttatccaagaattcccctgctctagttgtctcatgttagatattcattccctaattcacactaggataacaaattctctcctggtaaccaccgctccctagctcaatccatacttccaggaagaactgtgttcacacagtttataagtcatgctcccacagcagtatttgtcacttgacaggttcacgttgtatcacttttaagcaattcccagtggtgtacagtggtgcctgttcacagatgtttccctaatattgctaagtaacatcaaaagtttcaggctggcttccacacaggcagtgggctaaggagacatggattacccatgctcttctatttcctggcccaaaggtctccaattaacactgatgaaattggcttctcttggcactcctgcctacttcccttagatgttattcacttcaggacttgggcagaaacaaggttttatgtaacaacatcattcattaatcctaagtgaatgtacccaagaaaaggtgctcaaggtaggctaaagtcctagagtcagtagccgatgaagaatagtaacctgttcttcacactgccatttatttcacaacaaaacttcagtccaggcagagcttccactatagcagtccaaagctttccattgactactgctagagtccagcccacacaggaccagaaagaagtggatttgtgtgagaaatgctccgcccagtgtctagcacagaagaggggcttaataaaacaaattctgagatctaaaaaagaaatacaagaagtcttacgagtaaaattggccccgttctgaggaccatgcagaaagccaaagaagtacttcctcagtggcctgggagacaaccttctttatctctgacattttactctggaaaaggaaaaggctataaatgagtggcgggaaccatctgaaatctcatcatgactataccaccagcatgtggagagtgtatttggtggagtttgtccaaaagtcatccttccctgttcactctaacccatagtcactcctacctcaaatctctattccaaagtaggaaacttccaggcaggtgaggtattcaaatgaaaaatgcaagcccgggctacttagctctggccaattgttgccatgtgggatggctggcagcccatgttggtagaccttctgacttttcaagagaagatggaaagtcagatttctatataaatctcccaatttttcaatattaactccaacttagaatgaaaaaagttcaagccaagtaaaatgcatctgactctgggttggtctgaacgcatggtttgccactttgcaatccctgaactctctaattcatgtggcactaaatcatacattacttttgcattatttcacttttcactttgcaagctgtgacttccaaattgactataaacacttttgaccctgacacacttttggctgggtgggcctgtgatgccatgcgtttactaaacagtggctctattatatattgccatgttgaacaatggctacaggcagatgtagcatttcccaaatgagagaaggcaatggcaaaagagggaacttggcgtcaacttgagtgaatgcccctccttctctactccattctttttttcctggcaggtgcacgttcacaatggtgatttctcatttaattgctaagtatttccacagcacagtaaaatccatcatgaaccagacacggagtatgctaattccccaatctctgataatgcacagattcaatggggtcttcttcccgccaatgtgcattcataaatgccattaatagtaatggcagtcaaatgcaaaatatgactaagtaggccctagtgcatgaaatatattctcaaccacaaggacaagctgccacacagctcactgccttgtactaaattaggggctggtgattctctgattgggaccaagagggtgataatgacaaataaaaagaaaaaaagccagtcctcttctctgcttatccactacgaagagtatccctgacttacaggtcagagacaatgaggagctttcaggcttggaaacagagacaggacacagaaagatgcaaactcgctgtcttgcagggaattagtgaaacacagctaagccagttcaacactgtgccctttagtcatcccacccactaaaagacactgttaaaaacccgccagcttttattagcagaaacaaatgaagtcgactaccgagcactcaggagtttttcatcctgaaagtccaggatggctttggcataataaaggtcatatctcctaaccacggtaatgttcacagagcaacctgagctccaggcagggccaggccggcctctcagtattccccctgtagaaggtgttgccgattaaactatcacatttcaaagagctccttacagtaaataggaaagaaaggaaaaaagagatccagggccttttgttagtcaaaaagctagggaaaggcgataattaacccatttttgtagagaaatcatttggacaaaagtcaagggatttaccaccctgtcaattgttaagtctagataaggacattatattccacggcacaaagggtgactgagatggtgaatggaaagtaggccactactactactttacctcgcatctgaaaaaggactttttttttgtcctcctggtacagtgatggactaaagaatcttctcccccttgcactaaaaacataacttcagagcctggtttttgcattttgttaaatattcaaaggtattgtgcaattagcatgtcattaatgaataattaattacagctaaagcagccctcagatttttgcagctaaattatttaaacagcaaatataacaatacaatgcaatgctctcatttggtgttttgttattgcattatttgaagggaacagcaatattacttttcattagttgcaagaattatgtgcaacaaaagctgttttcattttttttcttacctaaaagttgcttcgtgtgccctaaaagggaaaattaattcaattcagattagatttcctaagaattaattagctgcaaatatctgaaaactgcggctagggacataaggcttaggtatctgaacttaaaagaaaaaagtaagcctatttaaacctgtcctttaaaacaacttctgcaccaaagtaccttttttttagatatttggttaccacttttaaaagaggaaacttgtttaaaaatccttttttttttttaagcaagtgagcattacaaagctccccctagtaaacagtcaagagttaaatagaaagtaatttgttgctacttgcagacatacatcactagtaagacatgagtttatatttataagctgcacatctgggatcagttgacttatccatctgctaactacaccagtaaacagtatgtctgggaccgtcaaacccttgcatccatcacaaattcctgctttaattgtgtgtttacgtggcaaacctctgcttaagtatatttgaagactgttttaagcagttgtaattgctcctttcttcttcatattaactttaacacattttatttaccattatgacaggccgcgattttgcaagcctcatagatagataaatgccagagatcatcatgctacccaggaaaaggcagcagagggacagaaaccggagctgtaacctgtccagtccggagagtttgggcctctttcacaaaatccaatgacttgagtcacaagttcaaatctcagtaaggccagtttaatcctccactgtcttgaactcagaaagttgacaatcatacactttctttttgagaaaggagcagaagagagggaagggaagatttagggggaagaggcaaatcacagtttggaaagataaaatggtgccaggagttttccatctttttccttaattaatctgctgtgtaggagaggtgcatgaaagcttgagagatttgtaagggtagagatttttcaagccagtggcagagggctggaagttctcaggagccccagaatcaaagaggagtatagcctgtgacttgacttaatttttaaccctggttttataattgagtttcataagcaagctgaaaacacaggctcagaaatgaatgaattcagaagaaataaaaggctaccttccataattaggggaaaaatatgcaccattctctgcacaaaagcggggattttactgtatttttcccaatctgcctttcacatttatatgaatagcaagatgtcagatttcacacaatgttgttaaaccttttctcaggtttagggaactgaaagtcgtatgtgcctgtgtaatattgtgctgatgcaaatagttaaacttttctacacgattaaccatcattttctcagagtattctgttcacagctttcttccagtttcctgatacatgttgagatctatgcccgtgcggctgatggggtggcgtggaggttgtaaactgaagacccaccgcgaagctaaagagtcactctgacgcaatctagttaaatgacagtatggcagtaggccgtttacccaggccaaggaagctgtggcttgtcaaagacattaaaatccaaatgtgccagcaacggtgccaaatgtactctaggccttgcaaacacataatccagacaaactgaattaaattgcaaccagtttataattaatttgcttttgaaagttgtgccatgagaataaatgtgccaacaattatttgcaatgaattgttcttagggtgcccccaacttaataatgcctctgtaagcaagagagggtttggtattggttacttgtattggcattggcttctaacctaatgagggggtacggagaatttagagacagattccaggaaccttaacctttctgtcaacctaatggagtctgttaccaatgcggtcagtagcgtggccctgtggcctccctgacctcagatgccagcctcactctgcccaagatgctaagattagaaacatatttatctcgctgaggcactgcctttctggacaccattttgtaagcacaaatattcacgggaaaggtaaaaacagtaagagactaaggcactaatgcttcatgtgaattcatttctcataccatttttctctaggacttacggagccaagcaaagtgtgagccctgagtacatatgaacaaaaaactaaaataatgtaaaaagaagaaataatcctgaaacttaacatggagtgttatgtgccaagcattttttttccccaccaatcctcaggggaaaaaaattacagagaagtaattgggccgggcgcagtggctcacgcctgtaatcccagcactttgggaggccgaggagggcggatcacgaggtcaggagttcaagaccagcctggccaacatggtgaaaccccatctctactaaaaatacaaaaatcagccgggagtggtggcgggcacctgtaatcccagctacttgggagtctgaggcaagagaatcgcttgaatccgggaggcaggggttgtagtgagccgagattgcaccactgcactccagaatgggcaacaagagcgaaactccatctaaaaaaaaaagagagagagagagaagtaattgcagagtagatgtatattagaggcctcaggacttagagctaaaaaacagcagacgcaggattcaaactgagggctaactcagcagcctgggacctccaccttctgcttttcatatcaacaatggccatatctcactgctcctctctttccagagcacaggggccagagtgagacctggaatgtgactgacttttagaccagagctggacatcaaaatgaattccatcccattcttaattgtcactttggaagactgcttgagagcatttgcagctcttcttggaaatccaggcagaatgttttgagttcatctcaatatagtagttcccttacagggacgcatcatttctgatctaaaatgatctttaatcgactgatgttttacaccagcctcgttatcaaattactgctggctgtttccgaaactcagatcaaccctcaaagagtagaagtgtgctaccattgaggggagtcacaagaagatgctgcaggttcagccagcagctgaaaggaagagtagcaaagagttgcttagcaatggcttaccaaaggaggagtacctgcaggccattgctttgtttatgcaacaaatacttatttcttacagttgttacttatttgttacaagctcctgcttgaatatgccagatactgcattaattaaataaatataaatgtgtgtgtgtgtgtgtgtgtgtgtgtgtgtgtgtgtgtgtgtgtgtgtctttcagatttagaaatttgcccaaggtcacaaagctaataaatggcaaaggcaagatttgaacccatgtcaaactccagcaacacactccagtccacagtcttgtagtaccaaggaggcttctactttggagcgacacggtgtgtcacaggcttttcagatcaagttctatgctgcagtttcctttcactgagatgcagcctaatggtctctgaatgtttttcaccaggaggagaatgagagctgagagtaactttccctgaaaggacatttgtaaccattaaaagaaagagaactcaaaaagaagttcaagagggttttcaaaactggacttttaactggaagcttaattgcaggatgtaccttagaatgcacgcacacatagacacacacacacacacgcacacacacacacgcacgcacactttcagatattccttctaaaatagctcttgacaatttgtttcaaatcatgaaatcacgaccttaaggtcttccaagttatcttcaaccatccaaacaattaattctttgagaaagacatacttactaaaagaaaaaagaagttgaaaatattgaaaatattatagaaaggttccaatggaattaaccagaagagaaggttctagatgttaagcatgtactaccactcccactacctctgccaccaacacttcttttttttttttttttttttttgagatggagtctcgctctgtcgcccaggctggagtgcagtggcgcgatctgggctcactgcaaactccacctcccgggttcacaccattctcctgcctcagcctccggagtagctgggactacaggcgcctgccaccacgcccagctaattttttgtatttttagtagagaccgggtttcaccgtgttagccaagatggtctcgatctcctgaccctgtgatccacctgtctaggcctcccaaagtgctgggattacaggcgtgagccacacttctaatgaaaaatgctagcagctcccaattactaagaactctgtgccaagctctctgctgagtgctttctatacattataccattcactcttcacaagcgccctgtgagatagacattattatccccattttacagatgagaaaactgaggcttcataaatttaaacattacttgaacagccaataaaattatagatatttaccagacttttctgtaaggtattattaatacaatggtaagcactgtcatggatgcaagaaaatactggaatttaaatgacaaagattaagtcacataagaaatgaaaattgatgaggcaggtctaagcaggaagtcccaagagggcaggaaccaaatctgttttgttgcaaattaggtctggcataatatctggcctataggagatgctgaatcaacagttgtagctaaatgtagaaaacaatacgtagcaagtgagtatattagaactctctgaacattttatctccagagcacttggttaatcaaggttcaagaaaaaaatggtcccaactctgccactaccatttcaaagctccttgacccagggtgtttcaggtaagccatagttccatggcatgtgcctcttctttttatttgggtctggcaccagaggctgaatcagaaaatctccatttccctttgtccctattctgccatggacgcttcctctgccaaacatttcatagttcctttatggccgcatgatatttttcaagggaaatgattggcaaacagccaatacccctaatgcagaaaagatgccaacatcactcccaggtttaaataccttcaaggagaccctcaactgaagtggtccttacaaccaatctgactttttttcactctctttttgtgggaatatcttttacacgaggcttagagggaaaaaggaaaaaataataataagaaaacgtaaagaaaaagaaaacctgcctgaaatgaaaaattccaatcttgcctctgtaaaaatccttcaagcccagtcagctgcccctcccccttgatccaagcctctgtgtttcccggcaaagaggttagaaagctgttgaaaaacattctcctgctgaattgagactgacatctgacagagctcggtggtgtcctaacttgagtgaatttaaatgacaagcttggctttataagtaagggatcctcttttacaatagaacagcatgattgcttcatggcagagggggaaaagagggagaatcaaagttttcttcaaatccccagtggtgccattgacctgtcagaaggttgtgacccactcctgttaatccatgcaaatcagatgcctccaatttgcggtgctgattggagtaccacacctttaaattcaggaagcggccttagagtgaggttccgatcacagagttcagttcacctctcatttttttcttcttcaaaaacatgatgacagctgacttccttcccgccctgcccttactcagtcagggaagactgtctgatggtttcctgattagcatcaaggcaaaagcagcatgtttttcataggctatcgctattacctaaattataggcctgttgctctcagcattttccccccacagacaggttaatatacacatcccactggtattattgctttgcgaagtcacccagtcatttttatgacatagaggggagaaggcctggaattccccggaagaggcttcagatccagatgagagactcttacacaaccagaaacgccgttttctaaccatcccattcaaaacttaacaacacttcccacgttcaatgccatgtgccgtgcatattttaaaccatgggtaatttcaagcagaaacattcagaaaaagaaaatgaaaaggctggtattttggatatcaggaatatgtgattgcccacacgattcgcacattactcaagttgtccccaagtcatcttgaactggctacttaaacaatgtaagtgaccagaatttttgtgcatcatatcaaggtaattcaaaattctagtgagaggagggattatttaaaggacttcagtgaatttgcattttccaaagcttggaaaataactttcttaaagaacccctgaaccattaacatatctgaggaataaataattgtaataaccatttgcccatattttagaaaatatactattcctaacaccaaaaaaagatgccaaacataaaacaaatcgaaataaactaaaacaaaaatataaagaaaaactctagctctacttaagaattttttttttttttttgagacggagtcttactctgtcaccctagttggagtgcagtggcttgatctcagctcactgcaacctctgtctccagcgttcaagagattcttctgcctcagcctcctgagtagctgggattacaggagtgtgccaccacacctggaagatttttgtatttttagtagagatggggtttcaccatgttgaccaagcttgtctgaatctcctgacctcaggcaatctgtctgcctcggcctcccaaagtgctgggattaccggcctgagccaccaggcctgttcaagaattttaaagacataaataatatataattctttcaaaataggaagacttttaagacaaaagaatatatatgtatgtatatatatatatactttcaagatagaaagactcaatttagtagagatgtcaacttccctagtctttaatacattactcaactttctaaagacattattttaaccaaaaatatgattcattcatatacaagaataaataagcaataatagtcatgaaaatgggggatgattatataattaaaacacattatacagccatagcaattaaaatcatgcagtaagagaatcaaactagatcgaccaatcaatggaacagaacagaaagccatgtgcctatatatccctagttagggtggctattcaaaatagcagaattgacacctacattgtccctggagctccagtctggaagacataataccacactcactcctttaaatgcaccagagaagcccctttaaattgatagagaagggtctgaactgagggggaaggaaaggaggggacacttagagcagcagatatttaccaatcagcatggaagcattttaagattttaataagggctatagtcatattgtaagtatcagtggaatatctaccctatatttactgataataaatgaggcattctaaatcattaagagaaagtgagcttattcaaaaattgccacttaaataaatgttattcagaaaaaaattgctgtatctaatttatttctaaaaataaattatagaaacactaaagaggttacatgtaaaaagtgaaatcaacaaagaactaaaagaaaatataggtgaagatttatctgaccctagagtaaagaagacattgttaagcacaaagcaaaagaaagactctaaaactggaaatgattaatagacttaagtatattaaaattgtacatctctgtaaaaaaaaatttaaattgaagggcaaactggaggaaaatgtttgaaaaatgtttttaaaaaataggttctctaatggtttttaaatatatccacaaattcttcaagaggtggaacttcgtttctctctcctgaatgtgggctagagttagtgacttgctcttaacaaatagaagaagacaaaaagtgcaatgtgtgacttccaagactaggtcaaaaaggcctgtcagtttcctgtttgctctctgtaggctcactcagtgtgggagaagctggctgccatgtcatcaggatacccaatcagccccggaaaggccttgtatcaagaaactgaggcctcaggccaatagccctgtgaacgaactaccttggaaacagatctcccagccccggtcgagccttcagattgctacatctgacctgaaattcttgtgagacaataaatgtttattttttgaaacctaaataaaagcccataagggaaaaaaataagggagaaaatgaataggcaattcaccaaaatatgcatataaatggccaaaaacacaaagaaaaatattcgagctcagtattcaacctcagcaataatcacaaaatataaatactatatttcagtttaccaagttggtacaagtttctaaatgaggtcctttgaggacgccagtgaactgcactgtcttaacacatagtgaaagtgtaaacagtataacctttttggagggcaatttagccacatatatcagaaggcttaaaaatgatcatctccttcaattcaaagattacactttgaggaattaagcttaaaggaaaaaaaaatcatattcaacccaaagatacacaaggtggctcattgctgattttaacaattgcaaaaaattgaaaactgactacagactctacaacagagtaaataacttatagccataggatgtaacgctgtgcaactatgtgtttaaaaaattatgagatacactataatattcacaataaaagaaaaaagcaagtcacaaaacagcataatccaattttgtaaatacacagttctgatatatacagagaaaatattctgaaaaaaatacagatgttaaaaagatgatttttccaaatttttggataaaagataattttttctttccagtctgtattcttttaaattctctacagagaatgtaagttactcttttaatttattttctaaaaaataaaaatcattttaggaacaagagataaattatgtgcttaccacctaccactaagtaaaactccgaccagtggaggtcatttctattttctcaataattatttctttatctaagcttctgagggaaagagagcgaatttttttaggaagagagaaaaatgaaattttgaaatcctagaaagtcttattccagatgaaacagggaaagcttgatactttttgtataaacctgagtggttagtggcacaaatgcatcaaccccatttgtttacaccttgcatctgtgccgatgcacaggccgatcaaccatctttccatacaaacgctgaaggttaccaattgtcacaggtttggactgctatcgatggcagcacaggactgtgtttaagtgatctgataaagccggtggcagcttgaggggcggtatgcttccaaaatacgtaaacaacattgtcaacaactagcccatcccataaatgtagcccccttctcagatgttttgaaaataaaataggcatctcttgcttaccttcctgtaggccccaaacaaaacaaacaatcacattaaactcagagcttccaattcaaaagccttggaaaccaagccaataacataatgaagtgaagctgccaagaggctggggaccgaggcaagcagaggaccatataccccatctacaaggcaacaacaccacaatggccaaacgaaacgcttccccaagctcaatatgatcacagttgccagtttgcaactttgactctgcacactccctaggaagagtttctagaatcatgaagtttctcagtgctataaaccagagtgtcattatagaaagctttgttttatcagagtacaacttcttatgttctattcactttcctcagttaactagcattgctttctgtactgggcttataagagaatgaaagtaaatactttttaaagcctacaaagcccatataggtacttacagttcagggtgaagaacagtatattagaagtctgagagcaaggtataaatctcgcctgcgggactaaaaaggtataggacttcgagccatctctgcagcctccctttccacttctttaaggatggggttttatcagatcgtgggtaagtttcatactgactcaaaaggcccacaattctaaaatttaggaaaacaactcagtgacaccccagagtgagttcacatctagcccaacctcctgtacctcctataacactgccctatagacagaccactatttaccaaaaaagatgatgaaatccttttccaccagcaaagctgaaaaagcataacagatcactccatttccctggcattctggccagtcaaggttttactacaatcacgtatctccttaacttcttcggtggcttatagcttatattttcacttacagactgtggaggtccaggaatgaatgatattcactaaagaatactatcctcaaatgtctgttccaccactagccaattatggtatcccaccagatctgaatttctaaagaaaggttctctacacactagagtcttaaaaatgttcagaggtttaccacaaaaaaaacaaacattttccaacagatttgcaatgatactttgctattaacttttacggaatgacagtacaggttctttgaaggtttcatctcctacattggatgacagtaagaacatcttcagaactgacccctacgacatgccacaattcaagcttagagaatactccgaagtccatgacaaaggcttctccctccaactgaaaaaacaactttcctacctcttctaccagttataggcctctgcctacacacaaaacatatcacaaagcatgcaatgtagaatcacaaatagaacgaccccagggatcctgtgcttttaaaggtgctactagggaagctggtggtcacctgatcccctttgtaacttgggtaggaaaaaaacaaagatattaaatcgaaacatttaaacatgacataaaaaggcacccatccagctattaatgaatggcagtatataatggaatatctaacgaaagagtgttggaacattttctctgcacaatttctagtgtaaattcttgttgaggtttattgctttgtttccttcctcccacatttattgatttcattcttggaatcagacatagtacttggaaacaaaaataggaagacaataatatcctgcaccctgccctcaaggagctcgctgctggggatggggggagttacatggtaaactgttaccaggcagtgtgaaaaatgctatgacggagaaagagtgcacacttgtaccctaagttgatgggtccaagaaggcccctttgagaagttaatgctgaatttaatcctaaggataagtcagacacagcaagatgaaagctgaggcaaggagaaagctaagaagagtataccagttataggggaaaacaggtgcaaagacaaaagcaagctcagagttcacggtgagtgtgcatcagtgcaaagtggtccaatgtaaggaggggagtagcaagaaatgaagccaggaaggacactgtacataactcttaaaagcttgcactttcatctctgggacaatgaggagccaggctgtccaagtgggagccactttaaagcagaagagtgatgtcagaagcatcagaaagatcattctagctgccgtgtagacagcaaaccgagtagggttaagactggaggccaggagatagctaagaagttactctagtaatctggatgagagataatggtgaattcaactcagtcagacaagcagaataaaatggaaaggagagaacaaacatgggagctggttagaaggacccacaggtatggagaagctcgaattgataatgacagtctgttagggtctctgtaagcacagtattctctacctaaggcttccccaatcccagaaatattatatgatcaccaaagcccagggaaattctctgagctgagcttggaaggacccaaaacaccaatatgtaatcctttgagttccttaaacaggtagaggcccacgtataaccaagtgctctaattttcatttctcttggtacagtgtttactccagaggagcaactttccattttttacttgacacatgatctgacatctgcctacaagtaaaaaaataatatgaattttcaagtagtggaaatgcaacaaatcatcaagatgtgtaagaatatatttcacatttgtcaaacagatctgacttcagtaaacagagatagcttaacatgtgatgcgtcaaacaaataatccaacgtgttgagatatttggtaaccagactagagatatcgtgttgtttgttgaaaatggccctgaactatgagtcaaaaactttactttttagctctggttgtcactaactcgttatgtaagttttgtgctcccttgcctgggaataagggagatagaataaaagagcttcaaggttcttttcaacccagattctaggatccacctccatattatacggtggttttctaactgtgtggccacaggatccatgtggcataaaagctcttaggtggagattcaaatctcccatcccctttgctttgagcagtccccttacatcttttatacatattgtttgtttaaagaaaggttatttgggaaaaaaaatgcttgcaaacttgtgctcagtggatttgcctattttctgaaagatcccaattgtactttcattcctaggaagattaatatcatgcagaagtttaagctttaacagagagtagagactgctctgcagctttggatctttgcaattgtttttgaaaatccatacagttaaatcacggtgattcacttatgcaaattctgcatttatcccaacctctaagccttctgtggcatttgagtttataacagcttttgtaaatgttgatttaagatttgggattaaagaaggaacacaccacctgtcttaaagttgacataaatgttataaaatgggatgctacactttttctaatccttgtctctaaccagacccatatgtaaatttcacatagtagtatttagtagcataattaatccctactttatgttatgagtaatatttcctattcccgaccctgtaacgtcctttaagaagatccatgttccaattagactagcccatcggcactcttttaatgagcagattaatcattcagatgggtacaacggtgtcatcacaggttttaaatatgataatctacatcctaatggtgctgcaaaaccttggcttagagcaaaaaaggtagacaaaattggtgagggtttcattttgttctctatctgggacaaggtagaacacaggaaaccttgagtaaggcagaggatctgatttgggaaagtaatcttaattcagttacaccaattatttctagaagaagtaacattggttgcttccctaaaacacacactggtatttgtgactcttgggaaaatgttttatattttcttgtccaaagagcttttcttttagaacttcacacccaactttcccttctaagaaagagtatagaaagggaacttccaagtaacagcggttttaaaataaagttaattttgattaagcctgacccatattgaccaaaaggttctgccacacaggtatggaaggagaaaaagaaaaagtccttccaatttgatgatcactttttcacatagggttataaaaagctatttatttttctatgccttcatttcccctctctacaaaagcagcattacagtcaaatctcagacagcatcaattctctgggcaatagatggcaaaaccactgaaaaataggctcacagagagaaatatcaataaactggaattggcgataaatgattcaccccgacaaaaagtacactcttagaaggcaattaatagacccaagaaactcaaaccaaacacatattctttttcctgtacctcctagggctttatcgtaactaccctgaaagcaagttcctttttgaattcttacactgctatccagcttcccccatctcagttaaacttgtccccccgaaagacagccacctggcttggtactgaaaaccaggtccaaatcacctttttagacaagcaagtcctgattatatttttaatacaaatagctgaaggccaattcatctgtatctacagccaagggttagctgccaagaaatctccaaagagaacataggcttacttaagcagatagtgaaggatagtaatttagggcagatgtcaagtatatgataaaggaacataatgggatggtgctgttaatatgctcagggtaaccccaggttcatcagaggcatctgtaataacaacccaagtttctggatctacacagataaaaaaaccttttcaggaaataagagatttgggggaatgtacttataaggggggtggggaaggctgctccatagtgataacttcatcccttccatttaacaaatgcacagggagctcccaggagtgctgggcactgtacatgcagtagtgcaggagagatacaaatccccctcagatgatttcatacagctctgtttctgttttgaattataaggtgaaaaatattcttattttggaaaggctaaactaaaatacaagtttcattctggaattatggaccagaatcaatatgtatctttaccgtaaaatggagcccttttctatggaacacaaaagacgtctttattaccatcaagatgcttgttgtaggataaagtttctctttagtgctactcccatacccaccttccagcctttcaatgctttccctatcaaaactggctcttgagataatctaaaactcatccatatacgtatcgagtatatgtttggaagagggcagagagttatgtagttgctcagaagccaaagaatcaatatggtaggatttcagacagcagcaggattacgaagaaaattttagagagggaaagaactgcgtgaggtggttttggggaatggggaagtggggagggatttcctgtttcaatattctagatttatcactttggaagtttctttaaggcacatgttagccctgcttctgaacacccatgaagtcaccactgtgagtaaacatgaattcaactagtttccccctagggcaatgattcagccaaaactacaaaagggctgaaatttcccaaactcagaaatttcaaaaagttgtgaatgaattacacatagatgctattgagaacaatggcttagtatctgtccacaggaaacattttgtaaatctagaagacctgtcttgaaatgtgggttaaaatatgcaactcaaacatgcttgtctccagtaggtttaactcattcccgttaagtaccacatcatggaaaaacacatgtcaacaactacaaataattgcaaaaaaaaattataaattagttctagatgtctaagtcagtgcgattcatttaatgcttccactgagatcccagtccaagaagagttaatcaagcatagcggcttcctaatcagaacagtgaactaatgatcctatttctgagtaataccagtcagataaagctctcaaaaggtagttaacatcactttggtggaaaggaatgacaagtgcaagtcctggtaggggtaatgcatcattcatgccccctctcattctgacattttaacgttatcttgttttactgtgtcggcctaacactgccactgccggcaaattaaactgtgaacttacaaagtgggtggcaataaatacaaattatgagagttcaaaagatgtccctggaggtgcactgctagacacagaatgtctcttgtttttctgtcacatagcaatagatgagagacaaagtggaacaggcatttttggagacaggaaaaaagagaaagaattaacttgctgctgatgaaatatcagataaaaatgaagacaaaacacatacttaaaaaattgatttgggaagaacataccactgaaaaagagaaggggcctcaaaatgctgtgtaaacatcaaaggacttatgatcaacttgtcttttatgaaaacaacttcaaaaatcatttttgaaattgaacagggtatttgtaaattatcaacactaatagctatgtattccaagtaaaatttacaatgagaaaatatgcattgatgccacaaaaatcttgttccttgtataaagttgtgaaatgacatctgaagtccctagcacccctcccagcccagaaaaagtaagaaaaaaagaaaggaaatttgcttcttgtaagtaattctggatgtaccaacctagcctggataccactgaaaatacaaatatcaagagtttctcaggattggctgagcacggttgctcacgcctgtaatcccagaactttgggaggttgaggcaggcagatcacttgaggtcaggagttcgagaccagcctggacaacatggtaaaaccccatctctactaaacatacaaaaattagcccagcatggtggtgtgcacctgtaatctcagctacacaggaggttgaggcatgagactcacttgaacctggggggcagaggtttcagtaagccaaaattgcaccactgtgctccagccttgggcaacagagcaagactcggtccccccaacccaaaagaagtgctcctcaggaagcatttgtaggctaagaaaagagactttcaggaatcttaatttctgcagcaatcccatgtgccttcctggtcacagcatcctcaagggtcaatgggcaaagtcaaggagaaaagaataaaaattaaaatgtccctagaaagactgctaggggccgggggctgtggctcatgcctataatcccagcactctgggaggccgaggcaggaggatcacttgagcccaggagtttgagatcagcctaggcaacatggtgaaaccccatctctacaaaaaaaaaaaaaaaaaagcaaaaattagttgaacatggtggcaggcacctgtagtcccagctactccagtggctgaggtgggaggatcacttgagccctggaggttaagcctgcagtgagctgtaatcgtgccactgcattcgagcttgggtgatagagtgagactctggaaagaaagaaagagaaaaagaagaaagagagagagagaaagaaaggaaagaaagacagaaaagaaagaaagagaaagaaagaaagaaagaaagaaagaaagaaagaaagaaagaaagaaagaaagaaagaaagaaagaaagaaagaaaaaaaaaaaaaaggctgctggaagttttgcaaacttcaaatgcctacaatgaaaattggaaacacaccccaaacaaaagaaatctgcccctttttaggcacatgaaaaatgacaaacctaacccgtactacagccagggatcagattttttaatatcacctaacactgagactttttttgctctcaatttggtcaagttccactaatgaatcttataaaatattttatctgcctattccatgcccacaaaccactcacaggagacttggaaatcatcatttcttccagagtgcagatatcagttgggccatatgcaacaacggtctgtttatttttcccataaaccaccggtttcatagaaactcattagcatcacctgtgttaattacactagcaaaccaatcaacagctccttcttaattaggttttctttattaaagccggaaattgccaaggagacaaaagtcacctggggaaatcatgtgaaaaggagtgtttatgccaaattacacactaaaataataataaaataacccagtttgtttacaggaaaaggaaacaatattaatattcaaggtcactggcacactccttattaattattctcattatattacattgtgatcatttctgcttcaagagggttggcttatagaaagcctttgtactcaaagttgactcacatcagattttaatggctgcggtcagcgattatgactttcttattccataaacacaagcacctacgggttaaagcagttaagactaatttcatgagctcatgtcccaactgtaactcaaaatcctgtatgtctgttagtaaacctagaaaggcatataaaaatctactataaaaggaaaagatacacatgtgactcttggaatttgtaattctcctaaaagagaaaggaaaaaagacttccaaccatattcctctcacttccaagtgcctttcagctgtagggaggaggagtcatagcactgagaccacaaaagtagcttttagaaggagattctttctccaagtttagccttacagggaggttcccctgggacatttaaaccaagactggtcaaagcactagaaagtagattgcaggagcttctggtagcatggaggtgaagagggaggggcaataccgggtaacctattaggccttttcatcttcaatttactataatgctaagtacatttatcatggactcaaaatctatcttcggaataatgaaatctgggcacgcccatctgtaaagtggggataacaatgcttaacctgattcttgcaagaagaatgagttcatatttagaaagcacgtggatgatgaaagtcacagagcgagcgagcattgatctgatttccatgggtctcggaaaatagcctgtccagggaggcccatgaattccggcactgtgtggccagcccagtgagtgatggtaaaaagtcaactagacttggaagctggaccttgaagaaaagcaaatggggactttaaacaggcaaacataaacgaaataacttcccggcatcaaggccctggacccagcagtacaggctgtcaggggactgccttcttggagtcgtggttgcttttgcttcggttgcaggacacctcccgcccaggtcaaggctgaagaggttccatgacttttcactaaaaatcagagtgtttgccccaagatactgagaacctctgttttctagaataaatgccataggaggaaattgtcaaggagatgaccaaaagaccacaggaaaaacatcacaagcagtcccaaagcatgaagaggtctaaatataagaagatttttactgtggcctctaaaaagcccacagaaccaacacgcccatccagcactgtcttcaagagctaagcctagggagtgctctccctcacctccaccctggaaaagtgccgaggacctaaagtccataacattgaaattgcttcttagtgttcagagattaatattaaagattcataccaaagactatagccctaatgctagaaagggaaccagaagaaggacactcatgtatgggtaacaaagcatttgaatgtgaataataaactatttcttcctcttcatcattttgcaaattgccacaatgaattttaaccttccttttggagaacacactgggttctctagagaatgaaacttcagcttacacaaaagccaaggtgtccgtgctgattgtccatgaagggctgatgacctttgtgggaaggtgctcatcctgacaggccattgtctttcctgcccacctcaatctgtgtccccagctgctctttttccctccctgctcttccatctacccagctggatgccctgtcactcagccctcagctgactttatttcagtcacctgcccatattacccacgtactgtctcgtatatttaggtacacagttgtcacataaacatagatggtttcgtggaaactgagtttgcaatacggttgtcaaagcggatagatgtttaataagtacaatggatctgttcccaaaatgcatctttatgaatcatgatcggcttagccatcctgttagtggaactgacccagaagccattctaaaaacatcaaatcactagttgtagtggtcttaaggtttcactcaggaaatgtcagatgacctggaatacccaaagcctgttgttggaaacgcttccctttagtttaaggcttcttggcttaacgctaatgactaggtggatatcttcttcattgcttggaaaccttcttctcatctatttgtcctccactttcgatggcttccgatctcactcagagtaaaagcccaggacctccatagcgcccacggggcccaagaaatggccccaggatgccttgggcagcgccacctgctactttcttgcatgcacgttctgctcctccccactggcctccatagccttcctcaaacctgtcaggcacactccctgcagggcctcacactgcctttcctgccctgtgtttgcttcccctagctatccgcaaggctctgtccctctgctccttcaggtcttggctcaaaagccaacctatcagtgaggctttttctagttactgtatttaaaatgacaacttcagcccctccccaaatatttcttcaccctatttcccaaactattttccttgcagaattcatcaccatttgacgtactggatattttactggtttgtgtgttgattgtctgtctccctgccctagaacgtaagctccatgagggcagggattttttcactcttttatttgtgctaatccccattgctaagatcagtgcctggatcttgaaaggtactcagtaaatacttgttgaaagaagggaaggggaggagagggaaggatatttccaccctcttgatgcacctttttatttctcctctttctagccttttctctcttcatcccctatttccctctctagaacattcttcacactctcctaccccaatcccaccccttcacctacatgacttccattcttctttcaccactttctcagaggtttccctcaccttcctaaccagctcaaaccaacacacacacacacacacacacctgctgccttcattagataggaccagcaaatcacccagatatttggcgtcctcccttttgtaaacttatcacattacagatttcacattcaggtgtgtgaattttaaatttaatgtctgagctccagaacccccaatctcagtaactataagttccatgggagcaggaccctattatcattatacccccaagtaactagcacacagaaggcatgcaataaatatttcttggttgaatgaggcaaacatttatcttccgtggtaaaaattaattcatattctattcttagctaaatgtcccataaaatcctcaataattcctagtagtagtagtggtagtagcagctgtggtcattgtcattgttgttatcacctgcatgccatcttctggttctcaccacctctccccacctgggccagctccctcagtcttttgccaccaccttgtaccctgaggaaatgcacagacacctagatcttatgaacagcagttccgttcttattcctaaatcattttgctggtgtttcgattcattcatgcctccattgtagatttgccacagtgaacgtgtttgtaggtctgcatgctccccaagggcatagatgcagctcatcctcttaatatctctaattcctagcacaatgatacagtcagtacgtttgaataaaccaacaagtagttgccctattcagactgatttctagccctccatgattggatggcaacctgtggttcagagaacccaatataatcagagccttctctttttaaaaacttcaggcttgaggcagaaagtctggaaaattacctaaacctttggtaacctatgttcacagcctcaaggaaggtagccagtgtttctgagctttcaatcctgaaatttctcagttgccacttgagaggcattgcaaaaatcctcaactctgaactgtctcacttggatgatctgtctaaatttcaattgttttgcataatttcttcaagtttattggtgagaaaaaaatcctcattggaaacatacacggcttcgagatggagttttctttttgtagacaatttcttgaatacacacacacattatctccctgataggcaataatggctctttaaggcgctgtcatgatcaatcgtaaaaatacatatttagaacattttttaaaatgtgtgtattataaaaatgttttaaaatgaaaactatttacccaaaagactataatggttccaaagagtattttgtaaatccatatttgagactttaaggagaaaaaacagcaacaatttctgacctgggagattataaagacttcactgaagctattaacatttattgtctttcaaaagctaaaaacgttgctggggacatgcttgcaggttgaagaaaaaacacagcccatcttctaacaaagggtcttcgatgcacctctctgtcctgccccaaaggctgacagacaccagtccattatactaactaatggcacacttagaagaaaatgccatccagagatgttagcccagggaccttgactaatgggtactgtctaatgttcaaagaccccatcagctctggtcactgatgagacattctaagagtagtgcattaagaaccttggtagagaaagtcactgtgggaaatctgataggataaattgaatatttgaggggaaaaccctctttatcccttttgtcccaagcctgattcaggaaaaaagaaatgattaatgatctcacattaaaacccagtctcctacacctcctgtatctctttccatagtcctgaccccactccccccaaaaaatatttgaataagacccctgagtcctaatacttagtacataccgtatgctgtgtttactgagacaagaaaacaaaagactttctggttcacagggaaaaaatccaggtctgttgaatagcagaaaaatagatcagatcagtgctaaagttgtgaatgctgtgtggtgtcttcatatattttccaacttttttaaacgaaagagtttttggtgttgtaaggaaaaaaggagttgggagtgaaatgaaagacagagagaggcaggaaaaaaagagtgagagtgaaaggaagaaaagaaaagaaaaagaaaggctgaaagatttcaggcatctgtaatattatatgctaagtgctggcctgaagcaaaatgtcacaagcaacctacaaatggaagtttaaaatggaaagagggagaaacttatccacagccacatgagaaacactgttggacataaacaactggggggtcagagctggaaggggctcacattgacacatttttcacatttttatattgtagaattcacaaatctctacttggcttcctcaaaaactttacctgttgggaccgaatgaccagctgggtttgattaggacagcaagcacgcccccatcctctcattggagatctgggatgattggactcagctttacaccaaaggaagttaagtccctaatagttaatgaaacgaggtgatttcctttcttgcacctgaaataacctgcctcccagagcctgtccaatagactgtctccaaaagcaaatagatccagcaaagagtaccttcaaagccaagctttcatttattgtcaagacagaatgaaattggtcctttttatgtaacacatgagttaggctgacctagccattcatacatagcaaagtagtgattcattgtgttggcttttttcccctctcctgtaatgttacaaaaagaatctaaataactcaagggctcccaagcctcttgatgagagtacttagctcacatcaatggtaatgggacttaaacctaggcattttaggcagaatggatttctttgttgggtacttttcctcctcccctcaacccccctccagcttgatttcacaccagttatgtgtgcaaacccacaataaatcactaggaatgtaaaatacactacacttccccacccccacccccaagttggcctaggtcatttatcattctgtggatttcaaaaagatggtagtgtttttattgcaaaggccttgtcattacagaaactagaaaagaaagtattgatcacaattagatcatatattagcagccctgatgctgggactgctaaggatttcaacctagatcattctgccctctgttaaaattctggacagcaatttcttttatgttagaataactagtataaacccataaaatgtaacctaaaaatgtaattataattgccatgccaaaagcaagccagtcaatatctttgagattctaatagtttcaagcactattaccttaacggtctcacatcacagtactgattaaagaaacattttgtatttttatctgtatggaatggccagtgtaatcactgaggcatagagagctaaaatatttattagtgagtatacatcttggttcaggcagtgaatgtcaatttagggtggaaagttacagcagagctctcagttcaattcattttcaggttcttctactgctcctggggtagtcatcccatgcacagaaggaaatctcagaatctgcccctacacccaaatgaactcctcctgcagattttccagtaagaagctcttgttgggaaatttcaaactggtcttaaatggacagcgactatcatggaaccagagtgaaccaacacacctgaaaggaggcagagctgagtagatgcaaaccacaaagtgaggcccgcctgacagccagttccccaatccacccttcttatccctcaaaacagacaagcaagcaaaactattcatttgaaccttattgatttaaaaataatgtaatctaaaatacattaataaaaacctatcattctctcacagaatacataatctatgatttatagcttggaaactaaatactaaactcacaattagaaagtacacgtaaagggtttctttaagttagacacttaatacggtttctttcaacaaactatgcaatctcatgacatggatttggaatgtaagaaatataaaaaggtgtttaaaaatgaacagaatattcctgatcatttctctgagaattaaaaatatacgttctcccaattagtagcacaggaagaaaatttagcatcctatcagttcagaaacatcagcacagtagccaaataaaatttctaccatgggatatgcactattaatttcacaattaaacttatctgtgtcatgtgcgtttccacagcaagatatgaaaggggtggttaaaaatctgcttcatttagggaaatatactctgtgacttagtaagaatgccatggcgctgacctcccagtgggctgcctgggaatgcatccactttgacttttcactggttcttaaataaacagggtaccaggcctcaacccgccctgccttaggaggagggaggagagagaaagagacatacacacacacaaaggctaaaggaagggaaaatgggtgattctgactcaaaaattaagtgaaaacgccaaccctgtcatcccgggatggccagacaaagggaagaggctgcctcacacccacacggtctacccgtgggtaaactggcatttctaatacttttcacctagtcttgacttgacagatgcctaaccttagctactgagtggagacaggctgatgggccttggccatacagggggaaaatttttgatgcttctcacttatgacatgattgattttctttcagcggcccttcactttgggaagtggcgagggctggctcactgcgccccggtgcgccctgacccccgacatgcggccgctgtgaggctggaaaccgatgacggcagaaacctaaaaaatcaataggccctgtcagtcaggggccaggcggatgtcttttaaaaacccaatcacgacatgtatttgctgcatggtgtggaactactgcacacttgagaacacactgaatttcccccttcccttatttatttatttttttggatctgctttacacttcattttgcctctttttaaggttggaaggggcagaagccttaacctttaaggcagcaagggaaaggggcaagccatgtggtaagttctgttcatgatttttacaggaaaaattccctggaaactatttgaatagtatgaaataaatagagcaccttgccgctgccaacataaacagtgacatcatttttttttttttacattatctggaaagaatttagatataagacttttaagtctaaaaacatatgagggcaaagctgcttaataggcttgattaaggaaagactattgtttgatttttctttgggggtttcttgaaggtaaaagaattgaagatacacacacacacacacatacacacacacacacacacacacacacacacacacacacagagagagagtccacagttctcttttgggaaagaacaagcactaggagaatcactcagtttccaagcagggtcagtgtaatattctccattcggtgtagaagaaaaatcaaatatgcatcctttctttgagagacagacaatgcaaaaggtggcatttagcttcttcctgatctgaggtgggaaggataaatatcaactatgacaagccaaaaagataagagaaataccatcagctggaatgtttcagcataaagaaatccacactcacacaaagagaaaaaagaagaaagtgaaaaaggtttggagactataggaaaacagagaagaatgctattagagactattaaaatgtataagatctatatgaaagtggatgtcagaatttctgcgacatgcttttctcctttcttttcagagaaatagataggtatattacacattatcttaaaattcacttaaggtaaatatcatacattaaaaataaaacaaataaacaaaatctgtgcctgaattcccaaactaagcccaattaaaggtttctttatggctgtaaacctgacaagctacaatttccccctgttgcagtgggtgtgtgtgttttaatgtaatattaatgagccaggatggagggtcataaaaagtgataggtttttgcgatggtaaattataaatcggtattgatttttcccggcactaatgcagccagcttattgtaagacaccacaggcaaagtgcactttatcagattagactggggccggtatcaaatatacatgagaataaggatgcatttgtgagttagactagacttttcttccctaacaatgcatgaaatttttaaggaaaaaaaaaaagcagacaaggatactgggaaattcaactttttttttctttttctaaagcaaaaatttccagaattgttgctcttgagataatttgattcaaagtgaagagaaggcagtaataacgctaatcaaattataaatagttttatttaaggctgttctaagtttctcttattcatttgtactttaggttggtgcccaaaatgcaaaggtcattctctggccccttccctgcgttcactctctgcttgcagcatcattgctttcctctacccacaagtcactgggagtgttttgttttttgttttttgtttgcaaatgaccgaggttcttctccgttggtattttatagtcagaaggacttcattaggcaattgagtagagatgttcagccatagagagaaaaagagaaggcaaagaaagaataataacaggaggaagaaaagaaaatgactagaccccatttccttcaacaaagatattattatttgtcctctctccaaacctgggtcagcgtctgactcacttcacgtctcatatgtcaacagagaagaaagtcctcaccctgaacgtgtgcttgccttttgttctttggagagacttctccagctttgttgggaatgctagcagccctgtttccaaacacttcccgatttcttcctaataactgctggcacgctctctatcaaaatctgccactttcctccctgcacaaaagctgtgcttccaccacgtgatcgcaagccgtgcccagctctgaggccagatccgcagccaagactcctctctctgtctccatggcgtgaacaggaattggaaaccagcacactcaaccccaatatagtctttttttaagaagtcgagagaacatgtgtttattgacagttcattaacaaatatcaaccccccgcaagctgtttactaaggaatgtagttaagtgaagatgtgtgaatataaataactaacaaaggaagaatggagagaaaatatctcatggcattccccctttgaatgtagtttgaatctgttttattttctgctagaaacatgttgctactgaaggtgtctctatgacacccagaacagtaaaaacagcaggtgtttgtgtgctggtatctagaacacttaaataaaactctgaaaaactggagtatgacatgccttctcatttttttccccttgtctatatcaagggatttaaacaattattttaaaaaggaaaaagaaactagtaagtttcataataaggttaaggctataatataattgctaatttctaaaacatgatgaatatttaaaaccactgcaaaagtttacaaaaaccaagcccaaatcttgaggaacataaaatcttagttggggataagaggaaccagcaaagaatatatactattcaataaggtgtttctcatttgttacaccaatactcaaaatgggccatattcagcaagggtagctaaccatttccaaatgttaaaaaaaaaaaactgactataatatccttgcatcaaaatgactccaacaattacagaaacaagggaaaatgttttgagacaagaacaaatcaggtaaaacctaataaagtcaaaaggaaattagaaaaatagaaggttgttttcatgggagtttaatcttttcactggaaagtgatctttattgtatgtcaaatcaacattttaaggtgcttttttataaagttatgaaagtagaagcatacatttttacctattctaatttaactgtattagtggtgccaaaaccctcatttacatttttcataaaattgtgaagaggttctctctgctttagggatagagctaataaacaaacacataaattagtgtattttaattaaacattatcccatgaagtaatattgtacaccactgcctaatacaagaacaactttcttacttaaaatccagtataatattaaaatattaaaactcattaaaaattaattttaaaatactttataaacattcaagtaccctgagttctgtatttttaaaggttttatgttgttggttgtgcacatgatataatccacaagctcctaacaaaatggcgcaagaagctacagttactttgcagaactgcactgactgatgtagaacaattactattgttttattttaaatatttcatcaaaacagtgctgatagaatcttactaaaaataaaaaaaaaattaaaagtccagcggacacatatagcaaaacagcattgactaatgacttcaaatcattaacatacagatctgagacttgactcatgatctagctagataagcctcctgataatatcattttaaaattgcatccagttcactcaatcagaacttgtttgtgttcccactatgtgcttaaaatgggatttcattgtcaaattatggtttggggaaaaggattcaaaataagttacaatggcctagaccaaactacacgctaattgaaactctgtaaaaaaggtagataggttttaaacatgcctaaaaatatctttagaaatcctaggtcaaatagataaatgccctgagacaatgagctaatgaatgtaaatcatttgacatttattaaataaacattagctgctacagttgttactaatagtattatttgcacagtaaggctcaatcaaaggtgcagatttaccaaggcttaaaaacacagatgaaaaggatgcacttgggcatacttcacactcaagttaacagtcatttattgagggactattgcatgtcagccactgtgtcaggcaacgaggatataaagattaacaagattaaattacctgagggccataactttttagtctgccttacttagtgttatacatccagatcctagcacagtgcttggcaccttgaagatacttgataaatatttgttgaatagatgaattaataacaaaataaaaatccctgttgacaaggcattcacagtctaattctttttgctttacacggtacttaaatttttccatcacaagtccagcttgcttttttttggaaaactccctagctaaatataatttaataaagtgtccatgatcccttgattccgagaatataatcctgttggtatttaaagcaaaagatatatatatatatatagtggtctaaaaagggtcaaattcccattcagcatcctatgtatgaaactcttgatttaaccagaattatcttgggaggaaatccaaaataacaaatggttagaaactatgaatccttctggtctgctcccctatgaggaactgctttgttacctcatagggcaaagctgtcccaggatctgccgcccctggcaccaggctccacctgccacactttacctaagaggccctggatatccatcttgggggctcctgactccctcagcccttactctttcagctctctagtaggtctcttgtcagaaaaataccagcttttcatttcaatcaaattactgtgatggcccagaaggtggtaaaatagtataagggttctctttgtcaggaaccttgaaaaagctgtatcttttattcggttgaaatttctactaacctgaagacatgaaagaagaaaggaacaataagtcccaaggaagtatgtaggggttttttttctgtatataaagtgtgttttgaagaggtatattcacttattaagttctctgaaagtatgactgacttgatatttcccatacgactaatttacaacacaatttgaactctgctgcatccactcgtggaggcaggaggcatcttttcccaatattggtggaatgttgtctagagtagtattgattgcacagtgatgggaaactataggacaaacctgaactaattaagcaataagctcaaagactacctaccttcaatagtgtttgaaggtacatttaattattgcgtggatgcaacgacatgaagaagaacatgtcatttagggaaatgtatcaaatagcattgaccgggtgactaagactccctattggctctaatgtctttggaaaaatcaaagggaatatgaagcaagtgtttcaatttggaaaatgaatgctaccacatgggtgggagtgagatacggagagagggaaaaggtatgaccaaatctgaaataatgtgctcaaccaaaatctagaatagattccaggcctaggatagtaatttttataagtacctgagagtatgttagtactttatctgggcagattctcatcctgcaactgtaagagtgtgtgtgtgtgtgtgtgtgtgtgtgtgtgtgtgtgtgtgtgtaaccaaataaagaacatagaactatgtctcttccagtggaaattcaataacaaaaaatagaattaaaatgctggttactgttataatatttgagtcctttagttagaagcttatttgccatgaatcttccaaatcatacctggaatctcaaaagaaagagtaaaacagaatctcaagaaacacttcttaaagtttccagctcctctaaattcaacttattgctttagctgagagcactacctacaagtctgctaacaacgatatatcaatggtggccaaaaccataaatgttaagattctcacctgatttgaaaattgatttctatggtgctgttcatgattagttcatgtttctaactctattctctaagtttctcaagtctcttgttcaacgacctgagtttatacttcatttttccattttgtagatactgacctttttttagactactttgcttattatataagcactaccatcacttgttaagggaaataaaactgtaccagtaatgtgctcaggacaattctaatggtacaaggatatgagcattaaataatatggaatcacatagtaagagtgccgttttcaattttctcttaattgttctgattacatcaatgagggagtctcagtttggtgctagtatctggaacacctaccacttaccaatctccatgtttagcagagtcattggcaggcaacagcgtccagctacaatctaacgacgctgctttcttcctttttttttttttttttttttttgagatggagtctcactctgtcacccaggctgcagtgcagtggtttgatcttagctcactgcagcctctgcctcctgggaagcgattctcctgcctcagcctcttgagtagctgggactacaggcacgtgccaccacgcccggctaattttttgtatttttagtagagatgggttttcaccatgttagccaaaatggtctcaatctcctgacctcgtgatccacccacctcggcctcccaaagtgctgggactacaggcatgagccaccaaactcagcccaatgctgctttcttttcattgaatttttcttgtggttacctcccatctacggcaggtgaggctgaactgctacttactgcggcactatagtttcttttcaaataaattcaagtttaaagagtaaattgatgtaaatacatttgttttttaaaacagtacagatgatataaagatatggcaatagtcatgaaaatgatacgagaataccatttgcaaggaaatctggtgtaaaataaacacctgggctgaaaactggcaacctggatttccagtggtagttctgcctaaccagctttgggaccatgtgaaagccactgaacatcacctatcttgaccataaggtgaaaaagttagatcagtgttttcaacctgactgcacactacaatcacctgaggaacttttagaaaatgccagtgttggtctctaccccataccaattatttcagaatctctggaggcaaaggctagacatcagtatttgctttaaagatggccaggaaattctaatataagtccagggcagagaaccattgggagaaatgatctctaaaatcttctgaggcttaatattgcattcaaaatacttttaaaatgcaaagatctcttttctccctgcatctacttttttgtttgtttttaaccttcccctccttttctttcaaagttctggatccacatatcctttttgaattttgctgatgtgacatctcccaaatcactattatccacaaaagccattaatgtgctatttgcctacttctcagatcagtaataaagccattaaagcagaggcatcagagtctaaagtcagaaagcctggacaggcagtccagcttcctaactcctagctcagtgtgtgtgagaagggcaggaggaagaaggtatgattccttgacttgggtgccaagaggacccatggaggtcagcactgtgcaacaaagctcctggagatggggtaaactgcagaggctgggagtgagctctagggcacataccacttaagccccttcatcaataaccacttaccccagcaatggcacatcagcaaagccattctgagcaacttggctctcctgtccggcacaggccccgggtggagcggggagttgtgtgataaatgctgagccacaagccattccgctcccagcccctgtctccttcccagcttaattaagaaacagcatgatttctgtccttctctctctggttttcccttttatctcccccttccttggtctgcaacaacgggtgctgctctctacttcttagtataataggtggaagtaaatgctgatgacaagtcctggatgaaatggggaacaggtacaatttcaggactagactttttttaagattaaaaagagtcacttctatctcctcccctaggtttcctaggctgactctggtgtttctcaggcaggggcctcaaactcaaatgcctacaggaacacacagaagtgctgcatccccaggtaaagagagcagctatactcagcaacagctggggattgctgggcaggcatgtgagcccataattatacattctccaattttataaaagcagccagatatatggatttgaatgtgaagcctgatttcatgatgttggcatcaaattcaaattcttaaaaaatattctgccgaccaagccaaatgcatctgaggaccaaattaagttaggaagctacccatttgtggacttttctcagttgtgaggttgggggaaggggagagaaaattcctaagaatttaatctctatcatttcattgggctggccagatttatataatctttgcctggaccccagtttagaaatttaatcactcattcaaccaaatattagtaattattattactatttctataactttgcatgtgcacttccgctaaagacacctatgaataaggaactactattgccaccatttcacataaggaatctgaggctcagagagactgaataactcaacttcaatcacacagctaggaggtgtcagagacaaatgtgaagttgaggttgtctaatttcagcttccacatttttaaccctacatctgctgtggagcttccaaccctagcactaacagatctgagaaatatgagggagttagacagggacagcattcattcatctagttggagagataaagtagacatgtattcattaaaatccaggcttatgcatataccaaaccataagcccctgggcaaactattttacttttctgagcctcagtttcttcatctgtaatatggagatagcatcagtatctcctacagccactactgggtgggcattccaagcatagtgtctggagtataataaaccccagataagttgcaccactattgttatttttctattatctttactatagagtcatcattcctcatgttaagccctctagccttcagccatagaatcttaagcccttggggtttaagaacacttttaatttttcaaagccttttaatacccattatttcatttgatcctcccaacaatacaaggaggtaggcagggcagggattaccttgtatgacagatgagagaatgaaggcaggaaaaggttcagaggatgtccaaattcacacagacataggctccataaccctgtgttttcttgtagttattagacactccaaggaggaagtgggggatagggaagaccactaaaagtagaagcattacatgtgtccgtgggtgcctagacatttcacagggatcacaacacaactaactgcccaggaaaaagatataagaactcttctgaagtaacataaatgaactggaagtaatatactgcaaattatgtagataaatacttataggaaaaaattactagaagcaattgcaaccaaggctagatagtaaaatatggaaactttctgaaggaggaaagtcaaaggcctagatccccttctatgcgtatcctccatttactagcattgggaatggcatccccccggggctcactggagcagcactgtggagaaaacaggccactctccccagctcctctgtttctgaagcaccgtttataacacagacaactggaatattaaatactgtattttcagcatctagcacattatctggaacatagtaggtgcttaaaataggtggaatggatgagtgaatgaatgaatacctctggtcacaaagacggaagaaactatgagccagccatccgcagtggacctggcccattctggtggaagtctgttatttttcctgcccagtgcccccccttctcttcgtaattgtacttttcctttcgtaaactgcccctggtccattcttcatggtcttagggaaactgataaccatgtcaggccattctcactctttccctatacgctgactcttgagaagagtgggacctaggggaggaaaaaggaggagtccaggcctctgccaggcagcatcctgagcgactacaccacagccccagaactgcctcacatcctcatcttcccaacacctccttattcaactcctctcacttctaagctctccaataaatccctttccatttgcttaagttgtcaagagtcagtttctattgcttgtaaaccaaaggactctgcctaatacacccaccaccctatctttgaagggaggagttgaggggatagggttgctattgtatcagctgatgtgattccaagatgctttaaataggcccattgttcttctgagtctgcttcccgaacttatcaataataatataaatatgacaagaagtgcatagcctgttcaggttgcccctagctgatgcgaaggagagataactacttcaaatattttgctccttttctctccatctggcttagcctttgcaaagtgtagccagtgaaataacacagagaggagggaaaagaattttttaaaccttcaaaggggccttcactctttgcctcattcagcagctggtatctccagttgaattagttcctgcataattccaacagaaaaccctttggcagccactggtcttgcccaccgcaggcttaggccctcttctctgccccagaggaacatcgttgacgtgtccttcagtgtcatgcatgtttccaggcctctggggcacaccaggagatgtgtgttgacttcctggctgtctgatacccagcaaatcctcccacccacctccaacacctaattgagcgacaaccctccatatcacagcagctggacagcgacagtctgtacctctcttgttccagcacgaaacagaaaagaacaaattggagaagaagggctttctgcaaagcctcctcttcaatccccaggtcagagagctgtgcttagtttttaacacaatgcacagtcgggcctgaaagcaggctgctagggtgggagattgctgctcctgagccaaatgatggacaatttcttgtcagactggagagcaaacacaaacctcttcatgtcaaatgatggatacgagtgatggtgaggctcttggaaaacctcagacaagtgcttagtcacagacatcagtgtaatccaccaccatttaaaaccaattgcaggcatccctgtgatcaaggcagacagaaacctggcggggacacagcttttcttactaaagccttcctctgtttgtgtgcagctccaaacccagctcatggtcagaagagcagagtggccatgaggagagaggatcagcagtaatgacttcaaaactttcactcttactcccctttctcaagtctgtaagaggtcaagtgcctatcacagccattcattcatgtgttcattcattcaagacatattaatttattataacagcatgtctgacatgctataactcactccttcccttattccagacaatatccgttgactgcctgacctcccctgctaagtgctatggagtgcattatttctatgcaaaactctagatggtacggcccttcaggaacttgcagtcttggcagggggaataaaacatggaaaagacaacgagaatacaagatggaaaatgatgagtgttatgagacatgcaaacaaaacacaacaacacttcagagaaaccattggagggggtgattaagagacggatcaggaagcttcaaagagggagcgaaatgtgaacctcctgcggcagggtgaaaatgattctagacatgggattggggcaccaaggggttcagtcaaagtgcaggtggggcagcataaagaacgcagagaaacaccaccctgataccaggatggcactcttctgctggtgatggagcacactgtggggacatcccagggaaaccagcctctgggttcctaccaggaaggccttggggcaacattcagcaatcctggctccgtgaagccagctcaagcttcttcactggagaaaggcataacagaagaggcactttaaagatctccctagctgcagtgtggaggaatggattagaggaggagactattttaagcagaaagtcaagttagaaggcaactgcaataagacaggccttgaactaaggttgtgataccaaagagtaatgacacaaagacaagctcttattgtgatgtcagtcatacaatcccagaaaataagcaccaggcttggctttgaaaactaatgtgattccatacagaactgggctccaagtcagaaagtcttgtttccagccccaattcaagtaaaaaccagctgtgtgaccaagcaagtcccttagtctccctgtgccttgttgtccttgtctgttcctatccacagtaactcttaatgggaattgcataaatatgttttcacttttttataagaactaaaaagacaaaggctcataacagaattctactattcctataatgtgatctgtcgaggctctttactctcttagtttctctgtcagagataatctcactcaagacatgggctaatctcaattaaacccatcaatttccatttttctcagcacccatgggccaattgataacaaaagctggtatataagaactacactaatggatcccaacactgagctttagtcataggacctgctcaatgtctcaacgtccaataactgcagaaagagtaacagacatcgtagggaagggagggaatcataaatccctgctctgctatgtactatctgtgtgatcttgagcaatacactactgaactttgatttctacgtttgttaaatagagttaataatccctacccctggcactaatgagagaattaaagaaatatgttccacagagcacaatgcctggcacatagaaagcacttgataaatggaggctatcattcattgttatttttattattgatgacatcataggccattgtttcatgaatttcagactgcaatatttttcatattcattctagcataccagatggttgcttaaaaatatctgaatcacaaaacagctttagacattccattgaataaagcaaatttattttttaaattaaaaagtctcatattttatgtaagagatgcctttgtagagatagtctctttaaaaacactaccacatgttttgccactacttcttgacaaaatgtttttcaagaaaagaagaagcgcgcacacacaattgttcactgtcaagaaaatatatcaagcctgagatgttaacattgccaaaagatgacagtatttggcagacctaaaagtatttgtcatcttaaaagtatttatgcaaaagcaaaaaataaacaattcaatattttagtcactttaggtgattacggcaagtcattaggtttttgtttaaaatgttcttggaggaaatgcacccttttcaaccaagctagttttatccttttgcatataaaattcaagccatttcttatgttgtgtctgtgttacctgtggagtgttggcatttgcacaatgcaagagctgaacaaagcccctccctgcctgcccatttcacccctctccaatgtttttgcaacacattttaaattaaaagcatttattagctgaacgaccttcagcaactcaccaacttcccaagactcagtctcctcctctattaaaaagttgagatggtggtagggttgaggggagatagactactaaatcctgcttggctcaccacacggggctaagagagaacggatctgaaaaatctttttgttaatggtaaagccatttaaaggaaaaaaggaggttggggaacgtttaaaccatgaagcaacagcttattcaactaagactttcctcaacgtttgccttccagaatccttaaataaatccttgtaagggaaaaaaaaaaaaaaagtattccttttacctaaatgcaagtcactgtactgtgctcatgtagcagtggaggccaaaatgctctcaatggctttccctaatgatttttttttttcatcagaattaaagaaatgtatgcccttttgaaactatgaatgtgtatcttgtgaagttataaatacatttagatccatttctcttcccttcttataaagacattgatgtgttttttctgacatgcctcatgaactcagtcaatcacaagtctttcttaatggaaaccacatgtctgcccagaactgtgtaattataatgctaggattcttggcactgccaggaaaaggggcattgtcaaaccaattaaagtttatttacttacataccatttctggatcagaatgttctttcttttatgctgatgctgagaaaatatatatctcatcaagttgttgcaattgttttttttggacagatttacgtttcttaccaattatattcctggttttcagttcctttgcatgtaactaaaaatttctttaaaaagacatctgggaacagcatcatgagatgttctgtaaataagactttgcacatttcacaccaaaattactgtgcttgtctattttgctgctgaagtgtaattttataggatttatctccactaaggggtatattaagagccctgctgtttctttctttttttttttttttttttttttttttttgagacggagtcttgctctgttgcccaggctagagtgcaatggagcaatctcggctcactgcaacctccgcctcctgggctcaagcgattctcctgccttagccttccaagtagccgggattacaggtgcacgctgctacacccagctaatttttttgtattttagtagagatggggtttcacctccgcctcctgggctcaagcgattctcctgccttagccttccaagtagccgggattacaggtgcacgctgctacacccagctaatttttttgtattttagtagagatggggtttcactgtgttgcccaggctggtctcaaattcctgagctcaggcaatccacccacctcagcctcccaaagtgctaggattacaggcatgagccaccatgcctggccctgtttcttttagacttgttagggattgagtgtgacctacaaagaggtctctggttggtatctggcacaactactgaatcgatggattatcaagggggaaaagtttcttaaaatcctagtgttttccctctgaaaacagggataaaaattctactcacaggcatagcaatggtgatgagaaataccatgattagtagagaaaatagtggaataaatatttggagttagacatcaactactcaaagggcaagtcatttcactactctgagccttcttttcttgtctgtaaaatggaactaacaatactcatcctatgagttcaagggattgctccaaatgtaaaatgacataaggagaaagcacgtgtaaagattatcactgccaatctctctgactctgtccagccttccaagtctaagtcgagaaccaagatcacaaaccagcaaaagcaaaaccaaggaacaaacttcatctcagatcatggtcagacctaaaggattaaacagactgatggaacatctcaaattccagtccaactggggaggaaagggcaagtcaaaatgtaagtctgtcctaggtaaataggcaggcagacaaggaatttgcaaatgcctatggttgtctccgtcactttaagcattgtggataaatgaccccagttatcatcacagcaggtgggaagatgggtgagttacttgggttctcctatctcattctatgctggttcctgcacctcagccaaaccccctcatgtggtgggttaatcattccccttcctgcaggtgggtgcgtctcagaaggagaacaacatgagctacatctctatcccaccaacttaaataactgtgagattcctctttaacttccccacccaggaaagacaaaggggaaactccaacaatatgaatagaccaaagaacactctaattttctataagtacaatgagcgatctgattccagatattatttgggtactgtgtacagtggctttgcccaaacccagcaagcaagccaacctcagcctcttttaactcttgatcttagagtcaaggggcctttcaacttacaaaatccactaagtctaaatgtgtcttgttaaagggagctgtgaaaacacaacataagcaagagtgacacaacctgcggagctgtcacctgacatcataatctactaatgacaactctggaacatcccttgcacgccttttgagtaaagtataatatttcttggaactctacgcctaagattttgcctggctttaacacttataatcatatgagccagaagtctcataacgagagtgactgatcttgcattaccattttacattttatcattggaatggttattttatcagaaattcatttcaacctcaaaatcccaaacatgtcattacattaagagatccagtagggcaaaaaacacagttttgctcaaactaatatggcagaaaattcatggatgactttttgcattaggcaagaattcttcactcttgacaatgccaaacaacaaagttctctaagttcattttgattatcaaaaatttattctgaatttaacacttcagaaatgaatcagtgacatgagagtcacactttcagactccagcaatacacagagaaagcactgatccctctgacgagttctcagctatcaatcaagagaagccagggccttctaattggttaccctctgctttgcccaataaggcatccacttatatcctggtcaagctttgaggaaaactcatcttctgtctcagagttcatttcctccttgatgggagaatttggggaataggagtaagtagtagaaaattggagaaagagcatgccaggtgctaccccagattttcctttttctacttctccccaataacacattgtccttggattcttactagtggcataaaatcacctgaacctaagtattggtggtgtcttcatgatacagtcatattttatttaacaaggcacaatggtttcatgtggaatagtcactgcaggggaaacttttaggcacagtagcagatcaatgctagggggacgctcatatgcttggcttagaactgctgtgaattcagcagcaaatgcacaggtgtcaggattcggtgactatataatctccaaggctcttctgagtcctgagtctaaaaagctaaataatcttccagtgcaagagaggctcttgacacccctcagtgtggtgttgaggaaaaagccccgaacagggcatcctgtggagagcagaatgactccaggatctgccatttgttaagctctgtgagcttggatatatgccttaccctctccgaccttcttacagggtcattgtaaggattaactggatgatttaagaaagaacccagcaccctgcctggcacaggatcactgcatgataaaaatctcagttccttctttcttcatatcacagtgcactctgtgctactccacctatggggagggtggcccttgcctgaaacgatgagctaagaaagatgatctcatcttcggtcacagactcgcaatgcaattttatcacatgacgtgcagagccccccaaaacatattagtgaaacctactagattccagaggtgcaataacggtgtcaagtgctgcatgaagaggacttagactccctgaggatctcggccctgtttctagctgtctggcctccagcctaggagaatacaaacagctataacagattctgggccccaaatccaactttaatttactggtgacctcatggctttcaggagcattacacaggacttatctggaattcactctttccaacaccctttcttttattagagaaatctgatgatcatgctgatttatcagatctttttatctagaaaggaatttttctggaagtacttagtgttgttttaaccagatcaacaaacatgtccgggactttataaataacttgtaagcatgtaatgtcttaatatacttcctgggtaaattagtgatggctttgctacaattttctctaatttttatgaaatttttaactaactctcactttataagttaaccataaagattgttgtctagatttggacagttgtgatttctgtcttttacccagaagtaaggggcaaaggatattgtttcactttcttcaaatttggtttctgaaagtaactttaaaatgtgagcttattctaaattacttaattcagttctgggtgtacatttctaaggttgtggggaggccaaagacatgtagtattggtggaaagtgaggcgaatcttaacacaatttcttgaaaacacttaatatttagtaaaaatccacttaagcagccttacaggaactggacacttctaccatttattactgagtttctagtttaaagacaacaaatgcaaggaattatgatactcaagcccattcctaataaaagaaggctcacatcttacgtgtctaaatatttaaaagctataaaacaagctagcaaacttttaaatgaaatatgttatacctcctgtcttgacaaatacttctttataacaacctggaaagccaacttcgattgtagaattttcagttcttcaatgttcctctcaagtagtcagtggcatagggaggccagccccaactacaccccatcctcttctctttccacctctggctctgatccaaatctcaaggatcagaacacagcacacgtatgaacacagcagtgctcacatccaatctccctcctcatcctccacaaaagccctttgtctactcctcaagactcagggtgcacacatgagtacaccctgcagaaccaagccttgaaagtgaactcagggcctttggagcagtgaattcctgggtcccaagaacgctgagcaacatcttacaagagtgggcagtttccaggtggccccaggggtctctcactccctgaggagagccagactgggaccctctaaagagcagaggccaggcggaggacccttgaactgggtctgtgagcagtgctggacattcagccccattccgaataaatacttcacattctacgtagctaagtattaaatattttgcagtttccagttatctaaaaattgctaatccacatacatagagttgtttatcctccgtctactcctcaattccccaaaatccagattctaccctcaatgcataaattaagctgctttaaattcaccaatgatgcccattctgccaaatccaactgactccctatagctcttttcttcccattacttctttctgggtcttgttgaatccattcctgattttcactggtgcttgtccttacgccatgcaaatttattctccaaactaacacaatagtagttaatgaatgaagcacatgtaacatgtcatccctcttgtaaaaccctccagtggatccctgtggcccaaaggaagaagtccaagcctcccagacacaggcctttgctagctctacagcaggctctccctctactccttacctcaacgctcatgttcttgcagcgtcaaagcactcctcacatcatttttgcattcaacaggaatttaccagatacccactatgtgccccctcaaggaatgttttatacctttgcatatgttgttctctctactgtaaatggccctgtcctgccaccatttccttcccctcccctgctacctcctcctcattctgaaaggctcaattcaggacactgacctcctctaggaaatcttccatcatattacctcccatcaattaggacagccattccttttttccatgctcccaatgtctcctccttgcatcgctttcactatactctatcttattaaattttaatgaagtcctccacccccaaattatgagcttcttctggccagtcttttctgtatttgttttccagagccaaacaccccatgtgtgattgcagaatgaactaaacccaatctgtcttgctttctgctcagatgcaacctcctcgacaaggctttcctccacccttctctaaaactgcccctactccgcaagctctagcccctaaccctgccttattttcctttacgacactaactacctgagattatagcatatatttatttctcttccacatcgaggatgagagttccacaaggccagggactttgttcccactattgactgcctgaatccacagaatctggaatagacaggtattcgatacataacgttgaataagcaaatgaatgcactaagtgtctgaactacttcagcttccgaaaacttcaatcatttgtctatcattttaccaacccacctaccgcccttattgtcatttacttaataacttttctttaaattgactagctattttcagcaaaattattctaaaaggaaactatatgtagaaaaccattcaactgaagggaagcacaaaagtaggcatataattattaaattcaaaatgcctgtgtatctcctgaaatcatctcacaggccagcaccggtgcttttactggtagcttaccacactttgggaagtgctattgacttgatcaaacagatctttgattccccaactgtgccggatcgcgatgtatattatgtatgcttttcacctagtactgaaaaatacccacaacctgaagagtttagtgcctacacccaaagcatttctctgtcatggaagcttcaaaggttcagtccgaataccacacttctcaaattgcagtgaatgaacctcaagcacacacaagagtttttgtgtttcattttctctttgaaagaaaaaaaaaaatctgacagaaaaagaaacagaatgaaagccatattgatggctcttacccagagactccactctgggatgaagctatgctgcagcctgaaacactggcaattcctaagagtgtataatgccccaaaaacagaaaatgtgaccaatagttgttccaagcaacggagacataacttcaaaagcattagtacttataattagtttccataaaaatcccaaattttcttcacttcaaccaagacaggtttcttctttaagacaaactactttcgaataagttgttaagtcttttagagaactccttacatccagttaaaggatctgtcttcaaatctttttctctctcttggctaagcgggaacatgagatgttttcagttagagaacagaaagctttccaagcatttgtgagaaattggtgggttttgcctcttaaaatgctgtaactatacacaaatattttaaatctattccaagtggcaagttttcaggattataaacagagaactgatcagtgtgttccaatgttgacatggtaaaaatgaaaactaagttcagcagttgctgatggtctcaaaattatgctatccactgatccgtagtgtatttttttctttcttctttgaaatgaagcacaaagattcaataagaaataaaaacctactgacattttaacgaagcctctatccaccattacagacagacatacatatagaaaaataagcattaaaactttattgtaagaataatggtatccaactcttttcctactgttcactttttctgctgttttgctacagaaagctgttgatacatccatcactggcatttttgagagacagtattgtgtggagcagcagttctcaaatgtgctcctgcagaaatctgaatgtctctgagtctcttttatgggccatggggtgaaaactattttccttataatactactgacctgacatttgtgctgaaggtgcaaaagcaatgatagatgaagcaattcatgccttgtgaaaatcatggcaatcatgccaaaccgtactcactaatcattgtattcttctccatcacacacttgcagtacagacacacacacacacaaacacaaagcatcaaagccacttcatttaagaatgttgttgaagtaataaaactactaattttattaaacttttttaaatattaaattttattaaatcttgaccctccttacatcttcgtagtattctttgagataaaatgataaaatgagtaatacagataaagcttttcactgcataccaaaaagtacaatggtcatgtccagataaagcatttgtgcaactgtctgagttgcaagctgaagtagttattttctgttttgttttgatttttccatagaacagcatttttacttgaaaatacaactgacaaactatggcttttcaaacttgtgtattgcaaacattttctcaaaaagtaagactgtcacttcaaagaaaactattgacagcaggtgttgccaataataaaattcacctttcaagtaaaaattagaattttggaaaacctgggtccacaactatgagattggcagctctccaataccttttctgatgagatcaatggtgatattaatgaacataaatcgttgatattgtctaacaaagtatgtcacataactcaatgaacataactcagtgaaccaatatttttcaaatgaccaatgagtgatgttacaaaatgatgatgggtaaaagacctattcatagtgaaagatataccaatgtattttaatgtaaggagttaaaaaattcattgatattgtttcaggtatcacacaactaacttttgagaaacttgttaagttttggtgtggtatcaaagaagaatagtcacagctatctgaaaaataacaattaaaatactcctctttttttccaactatatatatttatgaagctgggtttccttcatatactttaatcaaaatgacatccaggaacagaatgtagaagcaaatatgagaatactgtattctattaaaagtcagacaatgtaaaaatgtaaaaccatgccattcttctaactaaatgtttttgtttcagaacatggagttattttatcattataaactgtgtttatgttaacatgtgatggggttgctattgttatttttaaatgagtaagaaagaaattttttttaatttctcattttaatttataagacagtaaatatggatagacataagccacatccacaaaatttctttaaatcttcaacaatttttaaaagtgtaaaggagtctgaggccaaaagatttcaaaatcactggtctagcattgaagagactggaatctgtagttaagaaagatccacaaattatgactcaaccattcactgactgtgtgacccctggtgcaaatcatttcatccctctgagcctcagtttgcttatctgtaaaagaaacgatattcccccacctcacaaggctgttatgagtccttaacacatactaaccccctctaataattgctagcttctgatattaccttcatcttgtcctttttggccaacttattaagttgacactaaagttgtttagatttttaaggagaggataaagtgccctccccaaaacagatgaaggttcctcctctcaggggctataggaccacatagctgttaagcctgagtcacagttcaccacaatattgtttgatacagtgatttcaccagggcttagttaatctccttaccaacctgttcctcaggagagtgggagctaaacatgggagaaaattctatcatttcctgaggccaccaaagtatttttcattatcacccgtgtgtgtgtgtttgtgtgtgtgtgtgcctgcgtgcacgcatgtgtgtatgtgtttaagctatggtgggtgctcagagtagcataaaaccaattacttctaattcaattttgtaatggttgcagggttccaatacagttgttgtacataatctctgaaactttttgccatgatcttagggaaagacaacagcccagtagaataaggtgagaaataaaagaaaccaccctcccccaagccttttttttttttttttcattttccatttactcttcaagtcctgtgggataggtacacaaagtacaaaaataatcatttctcaattttcccctattactttttccataatttgaaaacataaagctctttccactggctgcctttctaattctcctttctattcctattccagtgcaaaagtattttgccaatgaaagtgctataaacagccatgccctcactgaaaaaggcaatatgccgttagcctgacatatacctcgcttttccgctcattgtcaacacagtgattgatggtgtagttcattaatgtgagacgattgtcagcttttcctgaataaatataaaaagaaacaaagaaatctccacccttttcaagccagagtgaattatttcctattttccaggcttatgtttaaaaatccatagggcattcatcttacagtaaataatgaacataccctttaatggaagaaattttagtttgagttcaaggctgacatagtttttatatatatagaaaaggaggaaggagtgctattcaaaggatgaagccatataggcacctaaaattgtacttgaaagcagtacttcatctttagtatacatagtcatgtaaaatgtaagaaattatcacctttggaaatctgtaaagtaaaaaggatctgtcatgtgctaaactaaaatgtaacaagaatcataaggaaagaaagcaatagagtggatggagagctagaggactaatttgcagctgtgtaggaaagttgattaaaatcggtgcacatcaaaaggaagttttgtgaaaataatcaaaacagattttcctttcgatcactctttactcatgatgcaagtttgggatgcttctactgccagatacatttatatatataagctcaagaaaggtaagatcttggttccatttgcccttttatcaagggttattgctgctgtgacttttctctgcactggcatctttatctttctgtctgtttgaactgctttaattggctctttgctaactctgttagtcacaagatcaacaaacatcactgggtgtgtcttgcttttagctttggtgtacaaaaagcaacagccgaaacaaaaacatccccatacatatggcacccacaagctgatgaacatgcagtgtctcactctgggcattctgttcctgtacagattttcttgggtggtaatgtgctaatgacaataataatttattctgaagatgtgctaaatttcttgagttgaattgtgaagtattttgaataccactagaaggcacaggaaacacaactgcaggaaaaaaaaaaaaaaactggcattctgccaccacttgaagatttaatctgattgtaatagaaggtgattattgaggactaaccagaagaccttggatgatttcctcttaaaatgacagcttgcctgtgtattgtgcattcttagagcacatatgcacggatctgttttcagaatgttctaattcttagcaatataggcagagggactcaaagcgtgacaacagcttacattcattgaggactgagcacatgcccacaagccatgtgctcaaacttcatgaatctcacctggctcaatccacacttcagctctagtaggtgtgatctatcactgctcccgttctaaagatgaggaagatggagctaagattacacaagtggctcctttgagatcatggatgagtaagtggtgtagtcagggttctcacccagccctgcctgactgcaaagccagaactgtgagacactaaaatgttgggagaatttctatcaaggaaaatggcaatcatcatttggctttaaaatgcttctcagtgggctgggcacagtgcctcacagctgaaatcccagcacattgggaggccaaggtgggcggatcacttgaagttggaagtttgagaccagcctgggcaacatggtgaaaccccgtctctactaaaaatacaaaaattagccaggcatggtggcaggtgcctgtaatcccagctacttaggaggctgaggcaggagaatcacttgaacccaaaggcagaggttgcagtgatccaagatcacaccactgctctcccgcctgggtgacaagagcgagactccatctccaaaaaaaaaaaaaaaaactgcttctcagtgatatcaaatttgaggtctcatttcctcctcactctgactatattaagtcagcaaagcacatactattatgttccttttacagataagaaaaacaaagtccagggaggctacaggactatcttaaggttcaacagctctgacttacaggacctgggaccagaattcgggtctttccagaacactatcattttgctataaagtagcaaaccaaaaagacagagaggtagtaggtaggtaggtaggtaggtaggtaggtaggtagataatcaaagtctttcagagtcactgagtagaaaggtagttattgctgccatatttcaatttacaactgcttagcttgttctataatgaattccatgtttccctactagctgccaagtagggaactgtgctctggaagtctctgcatccactgaatgtcacattatctcaatagcttcaggtgataagatcctggattcttcatggtgaaggaaggctaagagtcttgataagcttgaggtggaagtggcaatgctgcttgaaatttacagccagacttaccatcatgggaaactcttcctgtaagaagccagccagcaatatatctgcccatacttctcaaacagtcatagcaacactcccagcatgtcacggaataataaaaaccagttgtgaggaatggagaattttagagagagaaaagtgcccttcaacaaactctaggctttacacgttaccatgacccaaagactgcaatagaaaagttcccatggcttaacagcaaatttagatggacaagctttctggaatctgccggggctagaccttgacattcatccagaacatcccacaagggaggaaacaacccacaagagcagtaaatttcttaatcaaatctcaaaagtgcccccaattaataacactactcacttttaggattttaataccagagaatgaagctccacctactactgctttgactacaagaactcaactcacagtagttcacaaagtatgtggtcttcccctaaatattgtcagtaagggagagtgtatgcacttttgcttcttaaagatgtgttgagttgtgggccaatgagaatataatgaaccaacactgataatgtacatagaatgaatttattctgtattccaagggactcttcctattttctccccagcaaattgaaaatgatatttgtaacctgattttaaagcactctgagtgtgcatttctcagagctattaactgagtttggatagcgttttatatttctttcctgtacatttattataggacatccaggagggggaagaaattaaagatcatgaaatatcagagttgtacatgcttttgtcttttctgcataaaaaaaaccagaatatcaacttttgaaagaagacaaaaaattatgatgatagaatgcagtggttccttaatcttttatggcagtggacccttctgagaatttgataaaagcctctccctaggaaactgcctatgacttaataaaaaatgttacagcaattttagaagtttcactgccctacccctgaaatctagtcttaaattgcctataggttaagctataggttaagaatccctgaattataatattcccaacaccataaaaaatcagttcacctaattgacttttcctgtgtactaacagaatcatagctcatgttttgctatggcaaattcagtggctatttaaattttactggaatctaaacttcctgacctctctcatcctctcttcttccttggatgcattactcagtttatggataacggtatagaggagaattcaattagaaactctgtctagaaggctgtttttgcatctctgccacttaaaacgcagaccttcagagaggggtttccccatcaagagaaaactgcatgtgttcccaggacaatcaaactgaaagagttacacttccaaaagataactggggctgaaaaggaaggccagctctttggggagctgggtgatatcacaaataattaagtgataatttccactggagtatttagtggggatgacaccatgagtccttcacccttatcccagagtggtggccactctgtccatttttacaatctaattttacaataggttaactctggaaaggctagatggtaaagaggctatagggggcatatgagtggaactgaccaatttggtcattagtgagtgtggcacttttattcctctcttagagaagtcaagaaccataatcaccaaatcacaaagcaacgtgggaatccgtttcaggtaatcccatctttgacaccacccagaaattaggtttgtaatttcacaaactcatataaccaatcatagccatgttaaaaaaaaaaaaaaaaaaaaaaaaaaaaagcctgggaatctcttgggttctcactaatgatgaaatttaaacacagaattgattggtcagaccacacttaattatacccaactatacccaaaaatactcaaaacataaaaagtttggtccataaataaagcaggagaacaactccaatttctattctctgttaacagaaggtttctgtctaacttgttcttttccttatgaagctgtagaaatgagtctggcttgaagaattctatttttaaaaactcttcctatttacatatgctttacttctcaaaagaatgtcaccttcctattaatgcaacacttaacaaaggcaatgtcagaaatgtaccgttggtgggggctttgtttctcatttgccattttttgattggaatctgtgataattcatgtgtcctcattgtgagacaactaaaaattatcattgtcaatacagtttcctaacaatcccagaacccaggcaattagttataaataagtcattgttggcaaaataaagaatgtcatctaatgtctcagatgaattaaaggaacagctgggaaaggaaaggaagaagcacagagagagaaaaaaaggggacacagacttctttatggggtcccagtaaaaggaaaaactttatatgcctaaataaagacaccaaaaaaaataaacatgcttgagaagtcattatccaatacacttttaagccaaatcctaaaaacagcttttctggaatgcttttggatgactgtttatatgttaaaatcaacatttaaattgtgctacaaagcttattgtgtactacataagcagttctaagacctctagaacaacatagctttgggtctaatccactgaaaacacactctgtgcacatgaaaatttggttcgctctggttgggaaaaagtgaggaatgtgcttgcctccaaattagaagagggtcaagaaagcatttaaaaaatatattcctccatgaatgaccaagtagccagggccccttcgtgcacctgagagatttgccagccaagatgcagatcaattcctgaaagaagcattcataccttaaatatgcatttattctctccccctccaccaaaatgcacagttccaattttttttttcaaaaataggagttcagaaatgaggggtgttagaaacacataagttctatttgtttaaaccaaagttaagtatcatgagatatgaaggaaagaaaaatcttagcaaccagatagatcccagtcacccaacaaatgttaaaattgattttacaagttattttctccaaattggaaagcagctttctaccatagcataccaagtgaacaatgatccatttaatcatgatgtgggagatagattttatttgctagcatgtaagagctgcttcaggttcactactcttcaatactatttcacctaacagtctgaacaactcatcatggttccatgtgtaagaataagagattatttctattgaaacaagtggtaccaaaaaaaagtaaaataaaatgagatcactagaagtttaagaagtcaaacttttgacccaggaattccatgtctagaaatctattctaagattgtaatcagagcaacagttgaagatttatattcaaaggtgttcatcacatgatatttataaccatgaaaaactggaaataactaaaatatccaatagcgaggatctttttaaaaatcacacacacacacactttagttaacaaacagatgaggagactgatatgaaagaaaataaaagaaaaagagaaaatacacctcaaatgcatttatctgggagttggtgtgaataaatcattttggtctcctttttaaacgttttcttttctttttcttttctttttttttttttttaagacagagtcttgctctgttatgaaggcaggctggacagcagtggcacaatctggactcactgcagcctcagcctcctgggcttcaacgattctcccgcctcagcctcccaagtagttgggattctaggtatgcaccaccacgcccggctaatttttttgttgttgttgtatttttagtagagacaaggtttcaccatgttgaccaggctggtctcaaactcctgacctgacgtgattcgcccaccttggcctcccaaagtgctgggattacaggtgtgagccaccgcgcccagcctaaacattttcatattttccaagtcctctataacaagtaatattagcaaagggacactttaaaaatgtcaaaatggcttttatcagtttaaattctaattaacattatctcttttagactcaaggaatgtaagatgctggaagtaggaggtgattttgaccttggccagggggaagctcagccagtggaaagctctcccagcctcatgctctcctcaactacaggagctctgcttttatttactttaattatatttttaacttgatgtcaagccaagccctttttaatttatgaaggagaaaaccccccagaaaagttagaagtcttgcctaaagtcacacagcttgttagttgaagatctcatattaaaactcagatgtcttcattcagataatcctgtgtccactttgtggttctgtctgtccaacaaagagcgcatgttttctgttaattgttttatagtgttaagagacccacacagaactacccaaattgtcttgcacagtatttcctccttcaaaacctaccctcaacctcgtgattgtgtggaacttgacaaaagagcctcgtttaagaaatgccactagaagccagttaacaataaaatatcacactttctttactatgccagccctggtcttaaagtatctttgtaaatgatcatgtctccttaaactttagagtgagaattcatactatgaatacgaaaaagatggcagacttactgaggacaacttcctgttatccaggagataactattttagacatcacacaaaaaacaagcaaaaaaaattagctgggcacggtggtgcacacctgtagtcccagctactcaggaggctgaggcaggagagtcccttgagccaaggaagtccaggctgcagtgagctgagatctgcactccagcctgggcaagagagcaagaccccatctcaaaaaaaaaaaaaaagcaaaaataaattaaagatgatatagtacgtgatattagcatagctgacacttgttttttcatgcaaaagaaacgtggaaaacctcaaaattatttcattttatctctgcataatttgtggttagattttgaaagtgcatcagaacttactccctttgcaattatgtatgacttactcaaaatctaaaattcaggcaatcctcaaaatattaaccattgtaccaaaataccaaatacaggcttgacacttaagtactaagctaatgctgaaatcatatttgaatgatgatgccaggtgagcatgaaagtatacagcccgaaagagtaaagtctaattattgaaacaaaagacagaagttatgctaagtcatgggcaaattttcaataaggtatctgaccaaaaaaagtcacgatatcctcgcagatgagatggagatgagtaggagggtggacagacacagacagaggaatgtagtttgcagaattctgatctggataaataaccttacctacagaggttaccaaaagctctatgggcaaatgcaaaaccaatttctgctcttgcaacaccttcagtatattacctgtccactatttacacaattgcttcttctgtgttctattgttccaaaaattatttatctttttgcaaacaaagaggaaatggtctatgctaggtttaaaaccccggaaaatactcccccccagaagcatgactagtttgcatcttttggacagctaagatcaaagtgatttaaaatgtttatttttaaagtaaaccatttatactgatctttgaaaaagctctttcgccctttaagaactgtatttgtctccacaactcttttagagacatactaaagtcacactacattcaagatggcaccatcagaattgtcctgcctgatttatctgacaccatctcaatgtcagctccacagggagtagatccaaaggagggcagggaaacgcataaggctggacctgtacagcaagagcctccatgagccccgtaacgagatgatgtacgccacagggctctttaattgaaaaaagctgcaaagaaacaataccaaggggaaatcataaacagtgttttttgggatcacttaagaaagtaaccttcgtgaatctccaacttctgtttacagagaaggaagttacaacttaaagtccagttccttgcaaattatagacacacaccataaaacagtagatacaaaatgccacaaagactttgcggggagggtgagccctgctccctttccttttcaaatctggagtgtgatttgaattgcatcagggtcaccgtatctggaggagttttcccagccgcctaactttatttcacatctcaagcacaacgcttcttttatgaaaacccagcttaaatattaatgcgtgttttcttaaggaagttgaaggcaaatcaacttcctggtacccagggtatctgatttctaaaatggtctaacactgattgtcacagctccgccagatgtgaagggtgaagctctgtaaaaaacggaaaggccagctttcaggctctctgctgtgcaggtcccacgcctccctgagctgcatcctctgagagtatatttttgttagctggctgccggaagccctcaactgcccgagttgttttgcgatcctataaggaccttcccagccctgctgtcagccctgaaattaagagtgtgtttgtgttggtaagtttggggggctggttaaaataataagtattttcatcaacatcgctgtttcagcagaatggaagcgggtggggtaccagagcagggctccaaagtttgctaaaaagcctattttgagaaaacctttgttctaaatactcttgttacctcctgcatcaagaaacaatgtcttttgttagaacccccccttctctgactgctgcgtttgtttactgacattttcaatactgggcaatacaaagagcatttcctcatattaactccaaatgtcacaaagaacaaaatctggttctaaagaagcctgtctaaccagataagatgggttctgctaagaaaaaatataatgaaaataaatcttgcgctttaatgtggcccacatagcctttgtggagccttttctttgactttcttgctgtgtcattcggaagccacttggctttgcatcactctaaccaagagagaccttactgcaatgaccctggtctctgcttagaaaatgctgacatgtggccgggtgcagtgactcacgcctgtaatcccagcactttgggaggccaaggcaggcggatcacaaggtccagagttcaagaccaacctggccaacatggtgaaaccccatctctactaaaaatacataaattagctgggtgtggtggcacgcgcctgtaatcccagctactcgggaggctgaggcaggagaatggcttgaacccaggaggcggagattgcagtgagctgagatcgcgccactgcattctcgcctggcaacagagacagactctgtctcaaaaaaaaaaaagaaaaaagaaaagaaaagaaaagaaaatgctgacatgtgatttgaagaacatttggcttccatattagttaagagtctaatcatggccactgccatgggctgaattgtgtcccattccactccaaaattcatatgttgaagtcctaacccccagtacctcagaatgtgactgtatttggagagtctttttttttttctttttttagacagggtctcactctgtcacccaggctggatggagtgcagtggtgagatctcagctcactgcatcctcaacctcccaggctcaagcaatcctctcacttcagcctcctgagtagctgggactacaggcaagccactatgctctgctaatttttgtactttttttttgtagagttttgtagagaaagggtttcgccatgttggccaggttggtctcaaactcctagcctcaggcaatcctcccaacttggcaacccaaagtgctggaattataagcataagccactgcacccagccttggagacagggtctttaaagaggtcattaaaattaaataaggtcattggggtgggccttaatccaatatgactggtgtccttataagaggaagacattaaaacacagacatgcccaggggaagaccatgcaaaggcactggaagaagacggcgtctacgagccaaggaaagaggccctcagaagaaaccaaccctaacagcactttgatctcagacctctggcctctagaagtgtgaggaaatagatttctgctgtttaggccacctggtctgtggtactttgttatggcagccctggcaaaccagtgtgcccatcatgcaactgctaagctttaaatatatatttatattaaagtcctttttgagcagcccttctaagttaccagaggatgatccataagtaatatatgaattttcaaattggtttattctgcggatatttgtgaagcaccacggcaagcacagggaacaagaaggtcagcaaaagcagacacaggccctgccctcagtgagcttacagactaaaggaggcaggcatgaatcaaatagtctcctaagaggactctaggcatgtctctgaaggacacaggcccagtgttataagagtgaaaacaaagaagcctgacaactcaggaactcagagaggctttcctggaaatagcatctgaaggacgaggaacacttgaagaggcagagaggcaaggaaggcactccaggtagaggggtccaattgcagaaggaccccaaggtacagggagcatgaatgaggctggagggcccacaatgctgtgcctgagatccaggctgaggctggtgaggcagaagatcagaccactggagccctgtggtggtgcagtggagactgatccagatgggttcatccagtgggaaaccaataaggactttagcttaacacccccacccatccctatcggctgtactaacaccttgagactgatccaaactgaaggcataacactctctgtcccatgcacacctatccttccagctcacactcctcccaagcaaaggtgttcaattttaacaccacttttcagcgctccaaagaagagttccaacttctggctgaaaaagtatgcctctctcctaagccaatctaaaacagtggtaacctggatagatataaatatagatccagatgtgaaatttcccaattagcccactcctttaaagggtaagttccaaattattttaaattatagttacatcaacattgggcttcctaagcacacaacataaaattgagttctacagagaaaggaaccatctgtgagagtatcaacagaaagagaaagaaagtcaacattatcttttattatttcttcttcaaacttttaaaatttcatgatcagtgaatcttaccacctcagcctgacagaaaaatagatattaaactaaagttacatggcaggcagaagattccaaagtattatttaatagtgaaaacagatcacgaaggagaaaatatagaaagcaagcatgtttctctagtgactatgttaccatgtccccaaaattaacagaaatacggaaggctttgccatgttttaattaaaaagagctatgttttaaatgatgccaactataggacattatgctaaatgctttccaaagtctcacttactcctcatgacacccctaactagagttatcctaactccaggagtgttatgaggcacaagtgagaacaagtaatcatcattttcattttatagatgaaaaagcaagaggaatctaagtgacttgcccaaagtcactatggtgacaaggtctattgctgaccccaaatatctctttgctctttcatatgaagttataacatcctcaatgtttatttgagtacatggctgcccataataaaaactgtatttctcaaacttccttaaagctaggtaaccatgtgaccaattcctggccaatgagatgaaagcagggtgctatctgtaatatgcaagccgtatcattaagaggaagggtctgccctgcccctttccttcctccattctgctgctaggaatattgctgtaatggctacagctccatcttggagaacagggatgagaccaccctctagggatggcagaagaatatgctagagggaacctggctggagggctttgggggaaagagcttccacctcaggtctaggctgcttacttccaggcttaatttatgtgagagtaataaacttctgccttatttaggccactcttgttttgttttgggtagggccagaggctccctcacttgcagccgaatctaactatggctgatgcagtcacctaaagaaaggcatggaacactgagcaaatgatttaatctctctcaattttctaatccgtgaaagaggatgagtaaaacctacctcagagtattgcatgaattaaatgtaataggatgtaactttaatatgtagcacagtccctggcatatcataaaccctcaatgtcagctactgccactaagttcctcgcacaacagaactcatggtgaactcccactaaatggatgaatttcactgtattccctgcaacaaccaggaagctccaacatccagctatacttaaggttgagggcctcataactgacactcttggaagctgcaggaactcagcttggagctgatcttgaagcaacttctagagataaggtgagcgtggctgaagtgaagccaaatacctggaggacctgaacctcaggctgggaagttgtcttgggccgggctgttctcttcaggatgcctgtctgctgccacctccatttccaaagaatgcctccccatgccaggccagacctctgctccttaacttcaggaacactgagactatttaaacttcagtgggttttctccccatcccaccaaagcccacatgaagaacacacattattctgtaagcactggggacagtggctatacggtccgcatctttgtgtccaaccacctggagttgtgctctaagaacttgtacacatttaaacgagttccatttagccacaaagtcgggtcctagacttagcctgaaaagcaaaaatcacgtgtagtcaaaactacccttgaaaatcacttagattacccataaaacaccacacatgtggatttgtgtttacagcctactaaaatttgagcaccactgagctggaccaaagaaaggaacaaaaggaaaatccatatgcccatatctgggcactctaactatcctgtctttaagaaaattgttaaatccttagcatgtctggaggtgggtagagactgtcaagtgttcctccttgcctctcttaagattaagcacataaaacctcagtagaggttactagatgtgtttcatgaggtgagaattaaaagaggtgatgtctgtacaaacattccatacagaacctagtccctagaaagtaaagcaataacatttcctggacttgaatctagagcttgcttgatgagatctacaaacacactgtgttctctgaaaagctgaagagaagaacttggccagtggcttcccatctttccaagttgtttttttcagctatggcccctcagactggttaccaccctcttgcctttcggaattgctctctcataaattaaacttcttgaggtgaggcttgaaagacttgaatcaattaaaatgtgggcctcaatttaactcaaaatgtgagttaaaatgtgactccaatgataacgatgataggaaattttaggtgcttgctctttttcatctaatagaaaataagattttaagcaaaatgacggcaaacaaaagaagtgtgattcccaggaatttgccacgccttctgaagaacctaggcaccaaggactccatgcctatgactgcaatgccaggtgtcagggtcatcattactggcacttgggtgaggacagctgggcatacactgactagccaatcgaaacctgagctcaaagcgtgagatccatctttagctctatccttggatcaaaactgacccggctggagggccccccaaaagacagacctttcttgaccttaggttggtctaagaaggaagaaaggacaagtagataagttcatggtccttcacccacagaaaatcacaaacacactttgagagatgaccttagaggaaaaacccagctcaaattctctagagcagtgagtccaccagaaatataatacaagtcacacatgtaattcaaaatgttctgattgccacattttaaaaagagaaaataaccaagtaaaattaatttcagcaatgttttatttaacccatgatatccgaaatattattttgacatgtaagcaatattaatgattattgatgcttttcataatattccaacatcagtgtgtattttatatctaatgcgtatctcaatctgtgctggctacttctccagtgctcaataaccacatctagctaccctgcagctataaaagaaagttgacaaaccagcaactcacagactaattttgttttgctttcatagtgatttaaatttttgaaaattagttgccatcacttaaaatctgatttcacaataaaataccttctggcttctatcaaaaaatcatatctgataaccctgggttcaaattctccaacagcaacggagcagagagaactgagaatgagcctcagctcttcccattagaaggcacactggcttccagcttgccatctctctcaacccccattccttcagtaccttacatttcctgcctggacatatcccagtaggtctaataaatagcaaggtctcaaccttgtggagataacatcaaaactattggcttgtttaatgtgataaattttgaaaaagaaatgtatttatgcatttgtactttatttgttttcctaccagttaccatttatgttaccatgaactctgaatttaaatggggtcatacacacaaagaagaaacaaatccttgcttactgattcaggaaaagacggaaatcagcctagggaaggaagctatgctatttactttgtttttcaaataactgaagacataagactgagaaggctaaggagtattaggacaccttgttattcaaatgcatcactgaaaggacagtctctaaaaatactagtgcctgtataaacttctttctccctgtgttgcttatttcccacatggggctaagcacccagtcggtctctctgcggctcccattactcagaggcccatttcctgtctcccccgtccctgccccagcctcctgggcaaggagccatggcccctcccaacacctcccatcgctaaccccaccccctcttctctctctccctcacactggacatttaaggatctttcaccacttctccccactaactgttttctctccttatcaaaatcatccaaggacatctagatctaatccaaggtctcaactgtagcttccagtcactccatcagctaccctatttgttctttcacatcaagccaatagtaacactatcaacacaccaacaacagtggcttcaactatgatgtgggagttagtgtctcaagtcagggtataagataaaacttcagaaagtctaaaaaatctttgcaaatccctgaaactacacatagagtgcagtatgcatgcgtttgcaaccttgagcattaacatctatatacaaaggtctgatcaccagcctatttacattttgggctcactaggaggcagatacacagtgagtgtatgaagaacattatttaaactattcttagcattcttttctcttttttaattttttgttccagcacacatagttgaaatcagaaggataattgcatgcacagtgagaatcgactgtgatgataattttataacagctaacactggctaagcactttataatgtactgggccctgaaccaaatgcttaataaatattctatcatttaatccttacaaaaactctatgatgtaagaattattctttttgcctccattttacaggaacaggattggagtggccaagtaatttgccccaaatcacgtagctagtaagtaacagcgctaagagttgaacccaggtctgtcacagagtaccccttttcaacaacaaagctgaagtccacagcttcactcctcctgtcttctgtctataaactgaaaatatgtctataattgccatctactgagtctgagcattcactcacctcctccgcaaagactataagccgccccggatcttggagctgtcctatattccctttgctacaaacatgcctgtgtcttctccaatcattgtaagtccagtaagtgtttacagatggcaaatgtttagtaccaaaagttcagaagacacccaaaccaaccataattcccacgaccagagaaaagtttttaaatgtttattaaagtctactgggggtaaaactcctccccttctctcccaagactccatgagaaagccctttagtaagccaccacataatttacattttcttctgtaaaaattctaaatctctgtataatttcccacaacatttaacaggagaatatttaaactaagaaatgtcttgtggatataaatgtcgggctcatataactaagtgtgtcacattatataactaaataatatcctagactttctgtgtatacctgcataacagtactgcaaatataaatgaaaaataagtaataatttatgaaaactgatttgcatttccaaatataaaatgtgtaaaatccaactaattagcacgagtgagggctgaggtgtttctatagcaactataaaaatgctaaattattttttctccaaagtgttttatatctgcctcattaatgtttgtttttcccatttgttttgtggatatttccaaagtgaaaggtttcaaagattgcaaagattctctgctttatcgcaaaattcaagaagaggtttctcactaagaagtgtctcatgtgccaacagcgatttgcattaaaactggatttgatagagtttctttcacgccagtggctccatcctttgttcttagcttcttcctaaattctccttttctcttactgctccgattgttctcggtgcatctctgataaggatacgttaacataggtcagtttttcatcttgcaccctttgctgccaccctaataattcctgagaaagtcagatccaagcaagaagtttccattaagctaaggataaaaaagaacccctaggaacaacttggggagcttgggcagtgacctcagccctgggatctcagtttccccacctaagaatgaggtggatggacaatggcccatctctaacgttctctataggtcttttcaaaggacccctgttgcctcctatgtcagtcaaactcctttgccaggattctaagtgtccttacctcacccctgcaaaccagcccaccttaaacttatggcccacattcccatgaggcagcagttcttaaccttgagccaaaggatcaattgatgggcttcagagggactgagttccttgaattcggtgcaaaaaaatttttattccagtggaaaggcacatagattgagaatggccgcaagaggctctaagtcccctgagggtagcacaatgtcttacccatttgtgtccccagagcctaacacaggacttggcagaaacaaggctctgcctcaacccagcaggcctttgcagtatccgccaaagcccactgctcagtcctctctgggacttcaccctcaatcgagcgatgcggactcctctgctctctttaccacctcctcccacctcctccttcctgcagttctgtgtccagctcaagtcccatttcctgcacgctctgtggccaaaatacctcacctactttgtctcttctttaaacttttattatactcatgactagtaccatgtaatctagctctgaacaagtttctcttttctgttaaaattgcctattcttcccagctggattgtaaactccctgaggcaagagtcatgtctgatatgattcttccccctctccaaagtgcctagtacagtggaagtcataaagtaagtagatgctcagaaaatatatctgatctaggcaaactatggggataagtaataacaattaattagctacagttatttaatttatacaatgaagagaagacatatatagtataatagttatgaataatatatgtgaatatacttaatacggcaacctacctgttcttatttgcaatgaacaccttctgacccttgacctcttcccgagaagactcgctccggggtgtgtttcagtcttctctctcttgcacccctgacaatactggagttattaattcatgccatgttcattattcgagctcagtagcaactttgaatttattctcaaatttctctctgcaacttccttacttcagtaaattgaaattgaagaccctggtacttaattattccctaaagcagtatcctgttgtttgggcattgagggagttaaaataacttaacacttaataatgctaccaaccttggaggaagttctgggaatctcccgccaaaaaaaagggcaactgcactcataggaggaaaaaaaataggagactaatgtatgctgaggattatgaatcactcttctttcttaaaaacgtggtttccaaacagaattctcattggcattctaacactaatgccctaaattctgccaagttccaaacagaacaaccacctcgaacaatccaagcaactctaattaacttctgggtccacctgtgcctgtgaggtcaggcaaaagtacacagccgcatgcagcgcatgaacacaggcaatcccgtgtgtgagcacacgtgcgtgtgtatataaagacaaggaggatttgcccaagaactactcagctccacttaactctaagccaagtttaatcaaaccctaattcccagtctttttgtcggatgttatttacaccttcagtaaagctcacggcagcacgtctaaacgatcgtgaacaataaggatatccttaaaggactgtactgttgacaaagagcatatacaaccaacccagctggaagggattcacttataatgcccttttagcaatagccgtaataatttaataccattagtctcagtctcaactgtaaatggccttaatggaccctgtggtgttcctccagattatatactgatattggggcacagctttaatgcctgcattaccgctgctaattgtgaaacgctgtgttggatacactcgagtgttgcaataagtgtcttcagttaacttcttaagggcatagctttaaaaggaacatttgtcagcacgataaaaaaaaaaaaaaaaaaaaggcaagagaacgtttcatctggtttcaacatccagggggatcctgcaaaatctgattgcctcgctcctgacttctttgcaacaagcactgttgcttcaaaacttgttagcagccatctcttcaaaggatttattttgatagttcatgaatgtgttgtcacacagcataattaaagcttacagaactattatcaaaacacagaggaaatgtgctcggggaggctgatggctacccggccgcctgtgtctgccgcttcccacaggatgtgcgctgactgaccagctggcttccaagttctgacactaggcatatggaggaaagtcaggcctcggggtaaagtgcgcgggcaggcttcagtgagcaatcaattacaagtaacagccaactcctctcagtgactgtacatattcccaccatcacacactgccagcttgcctctattttgaatgcaataaaacttgtggggagccaacgcatgtgcaactcttaaagatatatggtagggattaaccgtaaaaacactaattaaggatgggctaaggaattaggggacaggcaaaagggctttctgccttgcagtttgtatataatgaagaagaaaagggactgaaaaaggagtcttttttttgaaaaccagccgctgggataagaacacaagctatttaggcaatgcaacgccacttgtttctcaaagtcactcctcaactcagacatattcaaagagagacaaacggacagatggacagagaggaaaaaaaagaaaaaatgcaagaagagccttcaatgcaagaaaatgcaagaagaagtactcgaagttttctctttgttagcatttgacttttaaaaaaatattgtaaagtcatcgagccaaatgctaaaagaaattatgaaattaaatgattatattaatatttccaaatggccctgaattgagaccttgccttcccagttctcccttcaacatagcaaagatcttgcgcttgtttttctggtttgggaatcgtgaaagcttggggccattaacagtaataacagctgtgcttcactgcagaaaacagaactcttaagcaggtattaatttattttctacatcagatgccagaattttctcactaaaaaaaaaaaaaagctaagtttgtgagactcattttatgcaaatggcttcagaaaaaagagaatcaagaggctgtatcagattctatgatcattacatgatagatacagcactaaaaaccttatgaaaaacaaattgtgcccattgtacagatagggaaatgaagttcagactgaaccaagcaacgccttttgactggtgaggaaaatacagaaatttaaacccaattctgtctgatgcccacattatgctttttaaattagtctccccattgtccctgtgcctcatactgatagacttgaccccactgtgttccacggtctgaaaacacatctccaaggagtgaagcccttggaacagaggcacccttcctccaccatagtgtattggcaaagttacaaatctacatggtttgtaacatgcagatagtgattggaaaggaagatgtttgtttaatttttatgttacgttgccttttactcgcaaaaacaaaattctagcagctagttttccataccactcactctgttcagatttatagggaaagtctgatgcatcctaaaagaatagtcacaaatgtattgcttaccattaaatggcatgatatatgacaaagaaagccccaaaacaatcagacctcattgtgtaaataaaactatcctaagttgaatgtggagttggaggaaagggtgggcaaacaggaggagtggaaggtaggaatatgagaaactcacatgttctctttaacaactcacagctttatgagtatgtttctttggaataaaagttctttctttagattgctagtgggattattcaagcaaggaaagagaaattgtcagtgaaaatagtgtttgaaggccagaaccttatctcctaagaaagggaaagcccatagtattctgataaaatctccatgacttgggccaccccagatgctgagatcctggaactcttacacttcacaaaccagtttctagagttccaggagctcaacagatccaagcaaagaaggcagcaaggtcacttttcgtagactactaattccctgctggaagactcttcctgagaatagaaacttcaccttcaaaaactcattacctgcgtgacagttgacaagctaggactataaagtgataggctgatgcttagtcaacacatctaccagaacctaagtcttggagaaactacgtaatttttccaattttacggcccttgcttgatatattttggaaagcccttgacagtcctatcgaaaaccaaaccaaacaaaaaaaatcagtgcttacacttcataatctaatgcaacaaagaaaaaaatcacccaacgtgatcacctgtttgactcctaatgttaggctctttccaaacacagatcccaaggatggaggcttgtccctaccaaggatagtcaaagtaatatgccacaggctgggagtcaaaataggtttgaagcaatggaataagccctcaacttctcaaaagagtaatattgacttaaatgtgtaagtggggtgtccttctttaaaaaataaatacatcatatgattctttgtactcatgctttatagaattgtctctaagtaagagtgaccactaaccagaagcattctccatagccattgagtctggaagtagacaagaaacaataaaagtgaggtccacaagtcagctggaatggccagccatcaaccagttaaaactgagctggagcctggcacttacacagtaacataggtgcgcagagccaccttgcctgcaagatttccatctagggcacaacagcaagtgtctatggctgtgaaggcatttcagctgcaaggtcatcaaggctttccgttacttacaggaaatacacaaatgtacagaataatctgcaaaatcctttggccaccaaagccctgaattttcctggtcagctgggcaaatacagcccacacaaaaggtatctatctgaccttcctttccagggtagaggtcaaaggggactgaaagtgaatcacctccttggtgtggtggtttataactgcctttctttgacatcaggtgctaagctaccctggctctgctcttcttatattttacacagtctgatagatgttagaaaattcttctaaaaggggagagagtaaatgacttccagagagaaaagggggctgttgatgtgtccaagtaagcatgtaagatgcccaaggaaagcatctgggatgtcccactgaagaattcctgcaactactgcctgagtacatgagttatgatttttgtttttcccgcactgtgtatacatgacatgacatgctttatttattgatgctgatttatccacaccgctttattgttgaccagcttttatttcttctttaaccttattaacccttgctggtatttgacagcttaacaccctccatcactctgcaacattcactctgagaaccgatgtggaactaatagcagcctttttatttccaatctttgaggtcacaagcagttgccctagcctgaaccctgtaagatttttctataggaagctctctttcaatgggtcatctccttaatgtatctcaacaggtctgcctggatgtttgaaatgagatgtgattcctgctaactactgtcaccaccaacatacacctctgaataggaggaataagttttacctttggaaaaaagccctgggcaattcaagtgaagcaacaacttggtgattttcttcttgggcattttatcacctttcaagttacatccaaggagcatctatttggggatatgtttgattgtctcaaaaaaatacaacagcgaaacaaaactcacaaatgtctgttacgtgaaggaagtgtgaatgaaatagagcatggtgggagagatttcctagctccgtttttcagcctggattgattaactctaataaattcaggaaggtgatttcagatgatgcccgtcaagctggatcttatggcccagttgtttattatttcacactgccccgggctcagtctttgacattcacaaccctaaaaggtcatgaagtgaaattctacagccagacttagtcagtattttggtgagtaggctcttgtgttaatgaagactgtttttttttttaatataagttggacttagggaagaaaaattccaggttaaatacaaatagcctcaactcaggaaattcatgcttttaaatagccaggtcagtgtaagaacatttaagactacaggagaaggaagagcatacagagggaagccagtcagtgctaacaaaccaagcaaacataggagttaagaactgtgggggcagaaataacatttcccattagcaatgctgggaaaactagaactgacaccaacagagtcctaggctggccaccattgctcttaccatcccaacgaagtccaggcctttattccccagcacagaaaaaaatccaccccacatgctggactcacatttctccagaactacaggccttagaaggcatgcatgttctcaaatcaaatttttatttccctaagctaaatgcagccctagacatcgaaatctactacatcagatcagcagatagttgatctgggaaggacatggcccagtacacaagcagaggaccaatgtcgctttattttctaataatcaaaccttcctttttctgctccttgccctccctgtgtctctaagctaagagaaaaaagtaggcctctgcctgcagcacaaacaaattcccacttggggggaatcaaacaaactgaaaaatgaagagaagaggagatacaatctatttcatttagtttgggccctgcctaatttccattagccccacccagttggcttttctggcctcaggcatctatctggaccattagtgcatattttcatggctgtcctggatccattcgtccctccattagaaaacaggaagagggtatgtccagcatttcagcaggggcagtgccactatgtagcctgatttttttcatgagcaagaaattcctacctgtacactcctcccattcctgatgttgtagacacatggacattgtgctagttcacactgatgacttgaacacttttcagagagctactaaattcctcctcctattaatctatcatttatccaagaccaggcctcaaccccatcccctcctagctaacccttactcctccaagttactaatacaatgtcgcttcttccaggagccttctcagaccactgttcatccccagaccaggttaggctgccctaacataccctctcctagcactttgcttaacattcagcactcaatcattattttctgtctttctttctcacactaccacaccagtgttcttcagaccttagaatgcaaaagaatctaagaggagcttgctgaaaatgcaaattcctagtcacctgaccctagatattctaattctggctgaggcttgggaatcttcatttgaccagttgatcttcagatcacactatcccaaaacgttagttctttatcatagtcactgcctgacttctcagcactgtgtagcagctggcatctgaaaaacacttactggattgaaacaaggacatgctgattctggttcctacccctctagccggaattttccagccttccaacaactgtcactcagcagggtaggccacagctgaattttgagtagatctttgcagctcctgagttgtacaaagtacatgcaagtttgtcacacccagggttcccccagctcatatggatctttcatttactctcttctggaaaaatgaactttagcccatttatcttccaaataaagcttgcaagggaaaaaatgacacggacttggtaaataagagtttctattattaaaagcaggttgaagttggggctttgtgcaactgcttcctactttctgaagtgtctctattttaagtatgtagacggtgcttgaacaatcccagcaggctctagatgaaagagcatcctcctcattaaccctaatgggaactgggctcatgcactaaaggaaaaatacatcctttggatcaaacctcatgagtggcatcatggcaataggaggacttggggtaaggatagaggagagaggatattccctcatttcattctatccaggaacttggtgacaaggaagagagagtaaacccaataaatatactgctggactaagaaaatctaagcttctgaaaagatgctatcaacataccaagcaattgtaatggtaccgtactagaggaggagattgcagaaggggtgggcttagaaatatttttcattcagcaaatatttatttagaaagtattgggctggaatgtaatggtgagcaagaaggataaggtacccgttcacacagaattgccattctacgggtgggggtgaaggagtcacacaattaaagaaagaaacaaataagagtaagatattcaacatgaaaacagagagacttcatctgttttgttcacagctgtatcccctgcaccaagcacagtgctagcacggagcatggattcaacaaacatttgttaaaggataaatggaggactggatgactgggtggcttgatggttggatggaaggttggaaggaaaggaggagcttctctgaggtgatatttgagctaaaagacaagaaagagccagtcatggttattctgcaggaaaagttcttgaaagaaggaacagcaagttcccaagggatgaacaggtttggcatttcagaagaaggccagtgaggctggagtgtggcagagtgggtactgggaataaaatcacagttgtttgctttgcaaacaaaatggaagaatcaatcatacgtgtttcacaaccctaaagtatatatattatttttgatagctattatctttattctataaagccttaaaccaattgataagcaaaataagatctccataaagaatgaatcaatgggaatgaaatagagaagtcaccaaaaaagacatataaataaaatatgcacatatgggaaaatgcccaaccatactcataagagaaatactcatgtaagtaaagcccaatttgaatctattaagttaggtaaaagtaaatttaatgatagatacacgatgttggcaaagatttgaataagtggtattctcacaaataaccaatagaatcgagcactggagactcaagttgttggaaaacaatttgacattatgcattgagagccatgaaaatgttgaagtgtctgaaggagtaattcttctgagatttatcccaaggctttcaaagtattttctgcaaagccctaggattctgcagaggggcttcaagatttctgacagcaaagtccagggaatgattatgaaaggggaagaatgcgtggggctatagggattctacctcctgacaaccagcacagttctgttgtagaaattcagattctgtttcaagtttacttgaaaaagaagttctaataattttttaaaaatcaccctactatcttaaagaaatgatccaaattataaaaaataactaggccgggcaccatggctcatgcctgtaatcctaacactttggaagcccaaggcgggtggatcacttgaggtcaggaattcgagaccagcctggccaacatgtgaaaccccttctctactaaaaatacaaaaattagctgggtatggtagtgtgtgcctgtagtcccagctactcaggaggctgaggcgagagtatcatcacttgaatctgggaggcagaggttgcagtgagccaagatcacaccattgcactccagcctgggcaacaaagagcaaaactccttctaaaaaaaaaaaaaactataaatatgaatatgttcatcagtattatttgtaaataatagttgaaaatgaaaaaacctcaattttcaacaataagaaggtaatttattatccattaaacctaggctatgtagagacacagaaaaaatatatatatactttgttttacatatatatatatgaatgtaaaacaaagaacacaaaattgtagttgcaatatcataatttttttaaaatgtagaagtgcacatgaattaaaagtgcaataagatgattataattggattatggggtctttccttttttatgtcttttccaatttttctgtaatgcaattaaattacttttctaacctttttttaatgtttaaaaataacccttgatggccaggggatggtatattattattcatctctacatcccagcataagcaaaggagctggcataaaagaaatactccacaaatatttgttgagtaaatagatatacttttaattaaaatctgatcatgaatgaagcactagagagaggcaggacagattccctccagaggagctggagaaagcctcctgcagaggcgagcctttgtgtggatccttacagggacaacaggatccgatctgagcggagggccaggtgggaaaggcagccctgcagaaggagcaaggggagcaagaaattggcgatgagcaagtactgaatgtgtctgggaaagagaaagaagtctgggtcgcagaagcatggacactcctgagcacattaaaggaatataaggctgaaaaggtgaatttaagcccacaggccaaataagtcaaagcaagagggttccaatgaatgtgagccacagtgacatgttcagaacaggactttatggagagtagcatggctgtagtgtgcatgatgggctggttgtggggccgtgaagtatgaaaacagtagccgggcatggtggttcatgcctataatcccagcactttcggagctcgaggcaggcggattacctgaggttgggagttcaagaccagcctggccaatatggtgaaaccccatatctactaaaaatacaaaaagttagccagatgcagtggtgtgtgcctgtaatcccagctactctggaggctgaggcaggagaatcgcttgaacccgcgaggcggaggttgtggtgagctgagatcatgccactgtactccaacctgggctacagagcgagacttcgtctcaaaaaaaaagaaaagaaaagaaaagagtacagcccagggacaggctgggatgtggagaagaggtcaggggcctaaacaacatttggagctgtcggaatttataaaagaggatcaccaactagaaagggatcctgtatgtggaattctttaacaacatgtccagaatccactaagacagataatctgtcctgaaaaaatctggacatttgggggaagcagtaaccccctcctcacctcccatctccaccaggctttctttaatgcccagcatatgcatatgcacctccaacaacgaaagcctcctttcttacacgtatttactagcagtcccaaatgtttcctgtgctatataaagtctacatttgacttcaactggggaagtgaaggatggagctgggagaaggggaggaggcaaagtctgtggcacagtcactagcacatctccagttttaaaatcatgcattcagtctgaagcccaaatcgaaaggtcgcaaactcacataaagcaccggtgatttagagcttgctcctatacacagttcagcaatgcgtggaatgtaaaaatacatggaaaccacaacacagcagggctctcgctgcgctgctggcagaagtctctgtttcccacacaggccctaaatctaacccagcaatgaaacttttaaaatttgtaaaaatagaacagttggaaaatcttcaccacttttagttaaaatataaaacaaaacccgccatcttttgtgggtgcagttgcaaatcagccacactcctcccgtcttcgaaggaattttaatgataaaaaaaaattttcaaatgttgaactatgtatttcttctaggttacctggtgaatacattcttggatgctctggtatgtgtaggttgttttcagtttagcatctccaccaagaagagtctcaaaatgtccagtcaatatcaacaggtgtaacaaatgccctgtttaattttctgaagaataacaatagaacaactaccacttatttatacattaatttgtgccagaatcatctcctgtaatcctgattcctaaatcctcagtccaaaatcctgtgagtataggtatgattatctccgttgtacaaatgtaaaaaacagaataatttacttaatttttccaggtacaagtggtagccaggattcaaacccagggccatctgatttcaaagactaggccctttccattatatttattgcataggaagggatttccctcacccattcaaaatggttatatttagaaatcaagacacgccactggctcctcgatcagctcttagtttccttggactattacataaagctgcataaaaccgagtgattatttctagcctcttcaacagatctcttttctatacattgttattcttaaacataggcaaatcctgtgccttatggcagattccgggttacattatagaagaattctatggaaacataaaccagagtctgtctgtctccctatctctccgaaaccaccctctcccttcaaagcatctcactaatatttattttggaattgtcatgaacagtattatgacattggcttccttaaaaatttaacattcatgattagcacttgaaatgagtatatccaaagaatgtattttgctcagtgcttacaaccaaattatctcaagaggctatcaagagctctcaagtcattttgttaactatgttctctatttaaaggagccccacacagagagaagggaggggaaggaaagcaagacttaaaaccttgcttaaaaaaaaaatcaagtattctattctgtctctctttccctcctctaccttctccaccctcccacatccgcccccacccccaaactaaatatagagaccaaacaccaaaacccaaacttgaaaatttccaaaatgataatcaacaaatcatggtaacatggaacacagaaattaaatgtaatgcccaaattcacaggagcagccgcctggaagcgggaagtggggtgcacctgagcatgctttaggaagttctgcacacgtttacccgctttgcagccatcccttccttccactccgcagcacaggaaaggcagattctgagcataactccagagccccagcttttcctaccattaatcgtaagattagatcctggatacagaaatgctaaatgatcaacaaacatagttagctctgaactcaaatgaatgtttttttcctttccctttcattgaagagaggggaaaaaaagcttcacatggcttcctttccttgacctacaacaaattccattaaacctcaaaaacaatgctttgagatgctagaggatgcagacaggaaactgaagaaagactttacacaaaagttaaaacgtctttttcggagggagttaaggaagggttgtatcttgacagtgagagctcatggcaactgagaacataattagatttgaatgtcatgtagttgtgcctgggatgcatagcacatcaaaacagatttactgctcagagtaacagaaatgtgcaaatgccattggctggtaaataattaatgattgccccaaagtttacaaatgcataaaatgccctacagataaaattccatcatattttcaagttactgaaaattagctttttttctggaataaatatcagttatctgtccaggattgattcctctttaagaccaaaaaagtcttcattctacccaacgacctcctacacccctttgtctcctgggacatctaatttatgggtgtttaatgtaatagggtaagctttccaaaaatggtgtaataaaaatgggcttagatgtcatcactattattacatctgttattataatatgtagtgtttgcagtgaaaaccaggcttgcatctatatttcattggcatccatacattgaggccatcttgaaatttgactcaaaggactaaaattcaacatcaaaaaaactgcttcaaagggatattcagcattgattttattgggcttattttggggagcactcaaactatgctttttttgacttgttggccctaaaatgcaagaagggttaatcttgattgcaaaatcaagaaacaaagatacaggcctattgtgcaataaacagcccacatttcaatgaataagtaatatttctcacaaacccaagttagatagtggatttatttaacctcttggggtcaggtaataaatactaagtgaattattcagcccaatggctaatcaatacaattccatgatatattttttgtgtttcataaaaggttgtacactaaaggcagtgagcaattatggaaattgggccagagcgcctctcaattcctctctggcttgaaaccccagcaggccaccttgacagcaaatcgattagtgctccagtgaagcggctcagtgacccctgacctgcttccagcgaggcctgacagaggagagagtattttatatttattttattgaattaactccatcttgcctgtaccatcgctttacacacattaggcagcaagctacaagctacttcattgtcgttgttttccattgctcttgctaaccaagccccaccccttgccctgcagatttctttgtcctggttttcctttcacttttggcctcaatgcaagatttcaatccaccctgagactcatgatggagctccaggtaataaaaaccaagagcaaggcacaagatcctgctgcctgatgcttcctgcctaccttgtccaaccaggacaatgccctatccccatttttcccctcatgttgagaaacaaagaccagtcaataaaaatctggcttcacatggtgctctttggaaaatatatgcaagagaacatcaaggattaggggtatttcctactagaaaatcaaaaaataaaccagaagccactggttttctctatttttgtggcctaattacattattgactgattgaagccatcagaaacagggggaaagaaagagaaagaaagagagagagagagagaacgagaaccaaggcagctgagtttagaccaccatttcatcaggggagcaataaatccaaaggctcatcagccatcagtgactgaaagcttacaagaagggaaacatctctaaatcaccaaaaattttctgttttacttctgctaaatggaacattggtaaaaaataaaaaataaataataaattaaaaaaacaccaaaataagtgaaaagtaaatgccaggaagaaaccaagagttttaaagtcagaaaatctatttggcagctctagatgttaaatgataccaaaggttaagttatcagcagaaatttgacgttataaatcacaggattgaaggatcttggaccatatttgaaggaggcagtacagagtgatggtttcatacttagaggctgaaattaaactacctggattcaaatcccagtttttctacaaactagctgtagactttgtacaattcatccaacctcgctaagcttcagctttcctcacctatacataaggatgacaacagctgttgtcacataagcaatgttgactgacattatcatttttatcagatcccaaattattttatatgggtaggcaagaaatcacttttcagacttgttttatgaatggagaggctgaagaatgtgaggaaacagaatttgccttccaaattattgcccttcccagggtcatgcatgcacaaaagtattgtgataatcactcactcccttaaaatctccttttggggttcgaaggaccttgaactttaccattaaaagattcagtccttgggttgatctccccaaagatttaaaagggaagttctcctttcctgacccccagtggtgggggacatgaaactatttcactctattcatatcaccttgcctttctcaggagagacttggttcttagggaatattggcttcatgggtgcagagtaagggataaagtttgtgatgcaggataaaagactgaagacagtgattgagagatcagaagagaagaatttcagagttgcacttcaactgctcaattgtcgcatcagggatgggttggcacttttagataccttgcttctgataagaagatcagctcctcatttacagattcaatgccatccccatcaagctaccaaggacttccttcacagaattggaaaaaactactttaaagttcatatggaaccaaaaaagagcccacatcgccaagtcaatcctaagccaaaagaacaaagctggaggtatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccagccattccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcacaccagcatggcacatgtatacatatgtaactaacctgcacaatgtgcacatgtactctaaaacttaaagtataataataaaaaaaagaagatcagctcctctctcaacccctccaagcttccttatcaataaggaccactgccaccatcacatttgccacatcagccatcctctgatctcctagggaaagaggactggggttcaagtcaatttgcagggactgtttctgcacaaatacccatacctaggttcgtgtgcagtgccagagtggcaagagaggctggctgccaaggctatttttgaagaactcaccacacttctctgggatactgtgaaggaaatgtcttgattttgccccatatctttccttgtcctttgcaatcccagagattcaagaccatttcatttcttatctcggcagtcctttctccctaaactcacggcccaccatcaccatgacagacagcaaagcaatctcacctttctctttaacctataagctttatggcaaaaagataaaacaccatgggaaacagtggagggaaatgaggggggaaacccaccctactctgaccttgccctgccttctccattctgcatttaggtaacagcccagatattttacacttttagaaccaatgaaagagactttttatgtatacattctccagtcgagatggacctacctactcatatcaaagggagacattaagactcacggtcaaaacaacttaaaaaaaatcaaatgcagggtggcactagtatttccatacaggaggagagtatgggggtgaaagaaattagcaaagaggccatgcctcacagcaagcaaacacacattaacttagactgcatttaagaaggccagtgggtagctgatagagactatggagagtggggatcagacctcattcctaagccattccttggtgtagtgctgatcacctcataatatttgcgctgttttgggctgcctgacctattagcaagactatcaacaacactttgaaagttccccttgatctagtgtctgagcacctaattgctgtggaagtctcagaaattccaccctaactcttcccaggagggctaatgggatggggtagaaagagatcctggttcagatgcccactagctgtaggatctcggacaagtagcctctttcctgggcccccatctacaaaatggagaggcgatttccttccaggataaacatatgattcaaagtggtgtttatctgatgtgtgagaagcctgagatggaatgtttacttcctttagaaaattggaatttaacagccaaaagagtcctttttcctctgaaggaataaaaaagaaatccatttactcaatctgctaaccccaaaaccaaaacaaagagtctgtggtataaatgagttggccaagatgcctgcacgtgctggctcacaagtcagccctcttccctgagtcattctgcaaaatggcacagcagattcctctgggtccgtcagaaaagaaaatcttttacacttttgtataactctatgcattaaaccataaattattattcccctctcttctactttcagaatctatacaaaagtgattacctcagtcatttttcaacattactttcatacttggaaaatgcattttctaaaagttatttatttttcacagcatgtcaggttgttatattgtactagttaaaataaaactactatataaactactgtctacttttgcatgcattacatttccctacaaatgctgtgaagcaggattttcacagggcctaaatatatttatctgaaatattacattatactttattttagcaccattccagattttaagaaagaaagaaacaggaaagccagttgttaaagtaacttcgctattaaataacttttttatttggagttccccatttcagaagaaaaattatttaaatattaaaagcggttttgtcatgaaacttaaaaccaacacatactattattccttctcaagggccctgggaagagctaaaaatgtcccattggatttgattcatgctcacctaaaagcaagacttgggcagggagtaaaacaagtaaggaataaaatatcgaatgagtacagaccaccatttctaataatgaggtccccagacccttgatatacacagctaggtttaaaatattttctggagtacctctaaaaggtgacaaaactaaacaaaagctttgcttgaggtaatcctaaattttatgcgtaaaattgttttttgctcaaatgtaatattaaccattctctaaagcactgtgaatttctttaaaatgccacctcacttaaagactccacaaacacaaaaggacgtagatccatttgtaactgtagtggtgagggtcctgcagctgtgagtgaggggtgcttgcttgagcatcagccaaaacaaagctgaccctggccagtaaacctaaggaaagtgccgcacaccagcaccacactgggcttagaaaatgctgctctcaggctctctctgtcgctgagtgagaggcagaaagaggaagcgcttaaatatttaataaatgattctgcaaaggcttttgagccttggcatgaagggtttgaaagcactatctactttacatccattgaggccaccaccaaaatggctatgatccagattacaagcgactcaagaaactagttttccttccctttttcttcttctgaagctgagttggcagtggcctatcttgaaatctttcagaattgctttaatctttcattttagtttcgtctgaagccacactcatgtccaccctcagtgcccttggtgttgccaggccttgagtcctggaaacagggaaagcatccttggagaaatacagagaacaagaatggagaaaagaaaacaaagatttttttacatatgtttttaacacagccaaatttaaccaaagtgtgctccctggtagtgcttttaactaacaagcaggcaatatattgcactgtaaaatgttttattttaacaccttacaggtttagctctgtggctgttgcaggtatatccattaaaagcaacacagactataaatcagaattccataccttttcacagcatatgaatctattctcctgctggtaagcacatagctttcactgatgccgatgggggtgacatatactcatgtagggagaatagaccactctctacatgtgaatttatgcttttagacaggtggctgtatgtagacaagagacaccaataaacagattttatagtagctgtttagaaacggattctgtgctacatatctacagaggaacagtcatcttttccaaagagaaatacagaggcaaacccttggcagacttacaatccacagttcagtacaccacaatttggtacccatcgtcacacacatcaatggtcatttgaactgagcttgaccaatccccaatgccttaataaactaacagtatttctgaaattccaattatgctgaatctaactcatccctgctatgaaaacatagcaaacactgcatggaaaaggcaaacgttaactttttaatgttctgtgtcatatacatacctacctgaacacagggtgcagattctcagaggaataggtttttcatgaagtagaaatcttttagatcactgctaaagggactcatacattggctttaagggaatatatatacttcttacgtttaaaaaaataaatactaaaacagcctgtcgcgtatggattctgtgtggttattttatgtatttcatttctttgaatgacatttactttgattttctttctgcattttagtcacttctagaaagggatcccaggaataatgcaaattacaaaagcagatgtagaaaatattttttaaaagcagcctaaatttccataatttacattagatattcacacctgcacagaggttgacattcagcacatgcatctagctgtgtgtgatgaacacagagcttttaccagaataaaatgtctatttctagagaaatccataaactagaaacagaccagctcctatatttagttccttcctgtacttcattttaaagacgcctcctagaagatattggaagggtcagctcactgttatttactgcaccaaatattgcttatgattgacactgtcatgtccgtgtgttgcagagacttaaaggccatgacgagatttaactactcacttttgcttgcatggctgtggtggaggaaaccacagaatactgatctatccaaaagagaaaaaaattagagagagtgtcacagtggaatttatgaatgagagtgctttggctgcaaagcattcccattatagcccctcagccaccacaaaactgctgtgtaattggaagggaactttttcccatgcaaaaaagcttgctgtcggcgccaacccatcaaagccatggcatggagggatgcacacctgcaggtagcctacctcattcatggggatcctggtccctgcctgcatcttctgctcacaaagggatctggatctgagaagatcagatcacagaagcagggaatgaggacgtggcaaaccttgacggtcctttcatccactcaattcagaggtgaggaaactgaagctccaaaaaaagcaaaataaacaagtcccaggtacatagcccatcaaaggcaaagcctggacccgaagccagcctttctcttgcatcccagcccatccatatatctaaaagctgaccctatttcagtgtttatttacctaaaactatgatcaatgaattcaaatatcctaaatgtcattctggctgggaaacaataaacttcctccaaaccagtttacacatattactgttttcccaaaggaaaaaaaaaattctttgcctgtgtgtgtgtgtgtgtgtgtgtgcatgtgtgtgtgtatgttttggctccccagcaacaaaaactatattaaagcttaaaataattacctcctttttcagttacttaaaaaaaatccgtcttctaaagacaagtgtaccatagccctcctacttattaatatcttaaattttaaaaagtctaagttgttaagttctgtagagtgttcacaagtttggatgactttatagcatgtgttacatatattttatttttatttaccaaacattcacagtaaaaaaaaaaaaataaaaaagttaaataggatgtcatgacagggagctactaggtagctgcttaaggttaggcttcaggaaagccctcttaaaaaatatctctggaaaggataaggcctgattcacataacttatattttatcataggtgaaataataatagtagctgatatttatgaagcacctactgtctaattgaatcaggtacctatagaatgtattgtttcaacaacaccaagcaatccagcaggatggatgttgctttctctattttgcagacaaaaactccaagttccaaagagatgaggttacttttccaaggtcttatggctagttaggaacattggaggcttggaacccttgtccatctgactccagcatgtatgtttggactctaaggggaaaatgcaggcataagagatttgctcagtttgatcatcacttcactgaggacacatttccagaaccctcaataagccagttcttctccctggcatatcatatcatcctcctgccctttccttcatagcacctaaaacaattgtaattttacctttatttatgtgattctttgaatgactgtctctcccactagactgtaaagtctatgcaaagtctacaacagtcttcgcttggtacatagtaggtgtccactgaatgaataaatgacccactactccaaacttcaagccaggagaattggtatcactgtcttattattctagccagatctgataacaaccacaatttagattcaaattatgtcttttatttaaacatctcaaagcaagataaaaataaacagctggaaatagcttgcaataaaagagagagagaccaaaataagtttaggactctgccaaaggtcttaatggtagcaacaaaaccataaatgtctctcggcacttcatacgtcatgagggcttgcagatggaaataatatcagtatccattctctgcttctgcttcggctcaccaagacactactccagaaaaaggtgatgtgatttattctgcattctatcattctgaatcttctattaactggcacttgtgcagtcacagtacaatgataaatgatagtcataattgtgaccctaattcacagcaagtcaccaaggtatctctgaatcacagaaaaatgtcactaggtgagaagttctttgagagatgggaacactttatacaattcccccagggaccttatacaacacctaattgttgaataaaactgtattgatcatagctatgttattatatctaaaaatgatgttctgtgtatatcatatgaagaaattatctattaaccagaatgtttaactacatagaatacccactaatgtttgttaagagaaatttaattcatcttaagtgtaagtgatgacaatcttagcagaggatattgggcccaacctcctatttattaagcaacaaattacattattggaaacactgggcttttgaaggaccccaagttaatgcaggtgttgtgggggttgtcgctattgttgttgttttaatctactaaaaactattgtctgaatacttaaattttcatataattaaacaaaccaaaactataaagtgtgttctgtctcacaagagaatcctagctggtgtgtaggagtggaggaagtggactcaggacaaataaaaattcactgcatttttaacatataaactaatcattcctctctcttccagtgtaagtcacgaggcagaaaatacatgtggagtatgtacattgccacagagtattcatataacataaaaattaaaagtaaaattatattcttctaaagtgcaggtccccaagatttttctctctgagtcaaataagtagtctattactcactgttgttgtcatttattcaattatacgtagtgttaactaagtagtgtaatataaagagtgtagttattatgacaatatttccttatctcatctatttcatatcccctttctctcattcatgtatatttgtatatttctaaagtaacttcttaaggatcacaagggaatttgttaatttctataaacaaaaccacaggaaaaagaaaatcttcaatgtaccagagctaaaaacaaagattcaaaagaaggggaaaatattaaacaaccttaagaccttaccaaatacatttaatcctttgaataactgtataaatatttgagtgtcttttatttatgttttcctccttttattataaagtaagataggctttatgaagtagtcctttaagaaaaaaggaaaaaaagaaactttggttcattatttaacttccgaaaagccaacatcaaaggttagatttttggcattcaagatcagatcatttgtaatttcttctttttttaatgttttttaaattttcatgtggagaagaatcagagatctcaagaattcttatctggaggcctctcttagccaagctgagctgatgggagcaacttttttgtgccaaaacgcagaagagaagttatacacagttcctccctccctccttttttctcccctacgtacacccactttctgactcaaaatgaatttttttttccccttgtatttaaaagaagaagaaaaaaaaaagaatccttgtcgtattggaagtgtgacattacaattcattgcattaaaaaaaagatctgaaactcccaaatttacttaacaaatccacaatgtttatttaggaccagggtgaggggtgcttcctatttgcatatggtatcctgtgaatttactatatgcataatttttaggtacttaatgaatgattcaaatagaaacagaattagaatgcagacaatgacagtcatgacactcagggacaatgaagtaggatggaagtccaaagctgtttggctaaatcaaattgtgcatcctaaaatccaatttctattgaaactgcaggagcttgagataaagttgtcataaagtcttatcaagattagtcaagataacatgaacattaggaagccatatttagatcattccaattctcccatcttcccaccacaaaaaggactggaggaaaaaatgatccagacagttcaccttgattctcttctccctcagctccccatagcctatctgagctttgttccctgcccactgccttctagctctgccaccagtaatgaccaagacttcattatctctgggccattactatcccagtaacttcccaaattgatctccttgcctctgggaactgttccctacagctctccgtatattcctccaagtctaactcaaatatcccttctctctagctttccatgacccccacacagaattaatcaattccgatacaggtgcccctgacactctgtcccaccatttaaccatcttatcagttactcttggtttgcatatgactatgcctctcagtgcacagaccctcgagggtagaaaatgtctgtttcactagcatatgagcaatagcatctcccacaaaacaggctctcaataatcttgttgaattgaacccactaggtctactggtgaattttagctattcccataattgtgtcgacttgtgcaatgacaaaaatcctacttattaaaacattctactgtaacataagcggaatgtgtaagagccatgggcctaagtggagtggtggaagggaagagacctcaaataggccaaagcatcatttcaaaatccttttctcaaagagcacattaagtagaagagacagcatgccaggactggagactcaagctactagtgagcgtctttctttttttaaacaggtgcttattgagttgtacactctgctacagattaatgattcagagactaataagatgtgatctctgccctccagaaaactggtgacaaagacatagtatggaggggtaaatctgagaaacctaagattggataagattcatgactggcaggatcaacagtgttctgagtaaagtgggtggagggagcccggctctgtagtgtttgccaatttctatggtgtaaatatccccactatgaatgacttcaagctaccaatgtgatatcactgaacagagctgggaaaagattcactcagttggttctcatgagtccacataagccagctacagcacaacactggacagaatccgtaccctccacagccacaagctacattgcttttcatccaataactcattcaatagatattactgcgtaccgagtgtctggcactgtgtttattattgagtactgagtgtcaggaggaatagaatagtaaacaaacaaccacagctcctggctgcatggggcttagagcatcctatgctgggaactgacccagctggggagtgaaggtgtctctgagaactgaagggaaaggggctagaatctgacggatgaattgagcttctcagagaggaaggaatgtccgtgacagaagcaatgggaacagcagatgagtaagaaagttggcttttatcctaagaacaataaggagccactgatgagttaaaggctacagaatgtcgtgatcagcttcgaattctcaaaagcttactttggctcctataaggagagaagggtctctagagaaaccaaaagattgcagagacaccaatctggagttaaggcaggagtcaggtggcagagttggggtggcgcaaaggggacagagctgagagataactagtatggctgacagagatgggggaggggcaacagcaaggatgactcctcggttcctataactgaagggacagagaaatccatcaataataaggaggaagatgaattcatgttttgacattgagttttcatccacatgaattttatgttcccctttgtgtaaaaagactccctacaaaagaaaacccatacctcttctcatgcccttcaaggtccttcacacatcagccccaacccttttgtacccattgccacataccccattactgctatttccctcccacgggggtataacctttccaaaacttttagtaaattcatagaagcctgtctgaactttttctctcacatcccccatcaaagtctgctttctgatccttgcttcttggaaggacacatgttcagcatcttacagagctgcccaacccagaactgtctgcatttcagacagaagaaaaacctccaatcatgtctcattcatctttgcatcacctggacctttcaggagataggcactatattttccacatgctccatgtggaaataccttattctccagagcaaaatcataacacctggtccaacagcatgaacactcttagggaagaagacagaatggtctccagacatacaatgagcactcaacaaacatttgtggtatatgaatttgtgcacttcttgatggactcaatgaagaatcaccagatgcctcctacacccaagtacgcagtaggtactcaataaagaaaaaaggatggactatcaagcttccctccccataggaactttacactcagcttctataacagatgcatctggtgcctacctcacatccctgtgtcccacctctgacttcagccacatgtctgaccctgaccacaacctgctatgtcgtggcttccttccacggcatgccaactctgaagcagatgcccagcctgcacaccagcaccctgggacagccctcaaccaagaggggacaggtgccaggagataatgctctagcctcttgtacttctggagcctggctctaggaggcacattttactctgtcccttagaagattccaatgggaccatgtaccagccacagcagtgactctgataatacatcactgccttactttttcttccttgccttttttccctcttctctctccctcatttcctgcttcctaagatcatgcccatataaactacctgcatccaaatccctgctgaaggtctaatttctggggaactgcaaactaagaaagcctctgatctaagccagccatttcaggatccacaagagactctttcactctggctgatgaattccacaccaaaaacagggtgagggccgttcagcaacttttcagttctgttgttctctgaggacatctgtggatgttttcagtggaagcagtacacagtaagtgctaaatacacatgtcttccaaattaaatccaggtaaaaatccagcttcttcacaagtagtaaaaaggaggtaataatgtacatggcatcccaaattattcattttgtcacaccattcccctgcattcgtcaggatttcatttggctcctttttccaaccttagcccagcatgctagcaggtatttatcaatatattaaatgctacttaaacttcctaaaatgatcccagaacagtaaaggggaaaaaagcttctgatttaaagctaaacatacacagctatccattagcatgacaatgtctgcattttacttagacattgccattaataatgaaatgatgtatgatttccactccagcagctcttccttccttgcacaatcaattatacatttaagaaaatacttagtggatagaaagctcctctaattaagcatcacttgagggagcttgtgagattcttaaaactagaaaagatatctcagagaagtaggatggtggagggaaaaaaaatccactcaaaatgtttgagtcttgattagacaaactctcaggcattctgaaccactatgaaaggaaaaactcacacacacatatattttaacccaatagactttgaggcgaactaaatattctgcaaaatgtaaaaactttctctttgttccagctaagaagccaggactaaattgaaattagatattttggttgagatccagccccagccccagaattgctgtcccttttttgtcttccctgtcaaaatcattgaggagttaagatagttggttcttcagaactctggaaattgtccaacgttagaatcaaatagaaatagcataagatttcccagaaggcaaaacaaggatggttttcctcactaaaattattacatatcacatcgtgttcttgggaggggtgcttatctggtgataatctccagaatgattttacatcccggttgtcctacaaaactaactctctccgacacagcacagcaaattcattcaatttggtgggtcctaacgctttctctttctctccctctagaggcagaaaatgaagcactaaataaggtttaatttcacggcattaaaaacaaaaccaaggataagccactctgacaggaacagaaagcaggccttggaagaaggcaaggagtatgtcaagaaagtggatacaggagaaccaggggacagcggggagagaagtaaacaagaggttcgtttctctttctctctctctctctctctctctctctcttctctcttttctctctctctcctctcctccctctctctctcctctcctccctctctctctcctctcctccctctccctctctgcattgctcttcctctgcccctgtatctatgactctgtatccctgtctgtctcttcctcttgttctctcttgacttctacccctccatgcttccccaccaggaccatcagtcctcccacaagggactgtctcccctcctgcccaggtggcttctcctacaagaggagacaacaataaatttccaggacaatgtacgtggtgtgggtgtgataaacatgtcaccagagacagcagatgtcccttgactttagtgacttggccttcagaagcccctcctttctccagctcccctgggcccctgagtctcagtcatagctctcagaactttggtcaactgtgctaggccaccagttactttctgcacacaggccataagcatgtttgtaacatacttgtgcatgaactcccttataagggttgactgactcctgcctccgttcatcctgctagccagtctggctgggttcagccaggagccctccttccccgccaaggcttagaagcaaactcagaagaaacccagcggcaagcaagaattgctcccggagggagtagtgggtacaaagctgggtgcctgtgctctttttaattccccattctggcaaaaagaaaacctcaggtctgactttagagcctttgacacataattggtagccaattttcctaagtggtgagtcaattttctgcttgtgaaatgtaactttaccctggtgaacaccaggccccagggttttcagtgtggcttaacagcaattatacgaatgttaggaaggggggaagtgttaaagtccctacatttacatttgttttttatgtttttacctcttaaagggataggagaagtctcctaaccaagtaacctatgaaaaactcacccaaagacaggcacaggatatcctgggaaggaaaaccattttgaagccgcaccacaaagggttccttttttttttattttaattctcaaatattctcacaagtagtgagatgtcacggggagggcacaacatttagaggtcaaggcatccttttcctggttccccttgggctactttctttgctcccaccctgtcccctctctcccctccccagccccccaaacaaatcccccggtgagcgctaggccccgcctcgggccgcattccctccccctcccccccgctcccgcagccccccacccccccaccccgccgcccggcggctgacggctcccgctccacatgtgcgactcgtgtttcggctttcgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtgcacaatcacaatcgcagccagcagtttgccctcattcattttgcactttttcttaatagagtgggagaaagtcatctcggccaccaccacccttttatcacaatttgttgaaaccccaagaggcttaaaatacgttcttttgccatttatagttgtaacagtattacatacaaatgtgtacacaaatctgcgtggtgcacacatacgcacaggctcataagacacacgcaaaaaaattattattattatgggctcttctggaagatttagtatatttgtttcagaaagacgtaagaattttaataaaactaaaccttatttgagaagtatctaccatgaacgcaattttggaaaggtgcaataggaactaaataactgctgttaaaaatcatttagctgagaaaaatatgcatgctaagaattccaccaaaaaaaaaagacattgtatgccacgtaggtatatgtgtattgcttagcagccacagaaaacctcctatctcaaatcaaagagaaaaacactacacgtgaaaactatcctttggacgattagactccattccaaaagatatagaaaaaaaaaaaaaaccacagcaaaaatacacacatggatctttgtaccagattctgtattaaaagattgcttgtcaggtcctatgactacctccccgaagtctgctctgtggttacaaggtttggtgttcagtcctctgcaaatcagttcggggtttctctaaatctgagccacagcctgtcaagatgatcctttgcaataccagccttttaaatcccacacttttgttttttctccctcgctctcagaggaattgtcctgcctaggtcagccattctaagctggaattcagagactggacggatcctttaccatgagaatttggagctgcaaaccttcggcagagccctggggagggataattgttttagtgaagctcactgcctcctcagtggtccgtgagaccctgctgagcgtggctgcttacctttggcaggaacccagggcaggttcaggaaacggttccgtgttcctgcccttagctttgtgtcaatgaagcctggcacatcttttttgtggttgtaatttaaatgagacaaccaactgcacagctgtctcggtcaaattatgcagggccatgtggcctttcttccatctttaaaaagtctggggcacctctgaccatgtttgaaggaagcccaggggagcaatgaccaacaaaaggaatagcgattacgccagcaaaggatggaaatttgcctaaatgaatatattaagggctgcgcttagaaaatggaaatgttagtttttaaatagaggcagaatagtgttatgattaaaaccctgatctttggggtcagacactgcaaggttggcatcccagctccaccacttaatagctatgttgacgttgggcaagttatttaaccaactgaagccccagtttcctcatctgtaaaatgggagaaataagaatactcagcacatagaattgctgtaaggattaaatgagagaatacccagaattcagctaatatgtggcttcataaatggttagttatcatcagtaattacagtaatgacaataacacatagaacatgcaaaacgccaatgccagtcactgccacaccagtcatctgtaaccaagaaaagactaattttactctgcctctggccccttattttacatattacagggatttattcttgcaggcaaaactaatgtgactgaagtttctatcattcaagttttatttattctgttgatctggcattgggtattttaacccctctctccctctctctctctctctcacacacacacacacacacacacacacacacaccccagacatgggaatgtgagtataagcatctgcatagatgcacactacaccaatacaagccagcagatatgcagacacaaaatgagtatatgtaccccggaataaaaggaacataattaccaactttattttgacaactcttttcaatgatacccaattaggcattgcatggcaaaaataaactctttaaaatactgaaagcacaacccattgtatatttgctcctaagggccctttaaaagctgaggttaaattaccatcagatggcaagaggataaggacctcgccttagggcacttccttgggataaatggccagttcttgtcctctttggaaggggttgctggcccaaagcaccatgaggccagtgaccccttgctggtcattaatcgttaccgaattccctagaaccaaggtcattattgctaatataaacttaaataaaaattccagagacatatggatttcttttaatagttagtcttatttctttgctttttatagggcatttctatagaattaatgttctatacattagctctgtagttggtttgtcttaacacttgatcctgcttaaagtaaaaggtttattggacctaaaataagaagcgaaggaaagcaaacaaaaaaacaggaaatcctgaaagggcctattctgtacctggaattctcagaaaaatcattatccatgggactcacaattttatttctttggaaacctgtcaaaatattataatgtttatatttaacggttggataatttaaaatttaaaaaatagagagagagatctggttcccatcctggacaaagttttctgtttctcagtctctctctcgtctcctctgcacatagaaaaaaatttttttcaagattttatgaaattccaatttcttcaagcttaaggaatatatactgtattgtcactcacaagcaaaggatattagcagagcatataatttcatagcttcattccaaagatgctcagcattatttgccttaaaaggaattatacaccctaaaagtacagaaacaaagtggatatgcagaaaatgaacaattatttaatgagcatgtactatgtgcaacttagtgtagattctctgtatatcaacattaggctgcttcatctggaagacaagtctcaaccagattaagagacaacttgaggatgttgcacaggcaacctctgcccacaaccttttggggttactatctcacagagacaaatgtgttggtccacgtgcctcacattttacaagcctacaattttctttttactagatcccttccccatcttgcccaagttatgctaccaataaatttaaatataacaactcaattagccttgtaaggtgcatcatctaaagatctcacccactagcttcctgccttaaggtagattttagcaatagacatgggctgtacctgctgccttatcttcttattacctggctgatcccttggatgaggtaaggaagaagaactgaaagttgattgagaatattgttggttattcagttctgacctctgtgaggttgctatttaccttatagtacatgctacttaagcacatgtttaataataggtactgtccaatgtcagatatgagaggtaaccagatttataagggtagagaggattaaagtcattgagagaggtaaccttaaagatcctaagtgtttacttctctcgttctataaataagaaagctgaaatccagagaagttaagagacacacagacacagaggctcacatatctaaataacagcaggggcagtactcaaaaccaggtctcctgtgtcccagttcagcattctacatgaggttccttctcatttcataatgaatgagaagtcccatatcagaatgagcaatttaatgtgtcgagcctttaacagaaccaaagcatgctttctccttaacagaagaatatgcacaaatttgggttcatattagaactattagtaccttgaagatgaaaattattagcatagtagggaattaacctacactaaatctgatgagtagtgaattactttaaatctctttttggaggtgggaccttaccctgggaatggccaggtaatggcaggagaaagatgaatggcaatggatttggtggtgatttggaaaagagaaagagattctacaccaaatccaatttccttaataggtgagtgccctgggaggaccacaaagtgcttctggggcagtccccaatctgggattgggggtacaacttattttatatagtagatgcttcacgaacatttattgaataaattaacatgctgggtcctttgtttctcctgtctgaggtcaatgaactcaacagctgcttgtcctcaccacctctgtgaatgtaaacaatggtttctaaaggagagactaaccctacatgaaaccattttttaataggtttagcatgattatcctttctggcttctggtatcaaactatttgggagcagaaaggaatccagcctgttgaatgatttatgacaatttgggaagagaaaaagagaagaaaagagtatacataaattcaaaattccaccttttaaaattaattttagtggattgatactgggaagaaagatttagttggttgactacattcagtcatatatttctgtggagacggaaaaaattaaatttttccaaatcagcacaatcttttcagccagaccagatagtcaaataattcagaggtgaaataattgtcacttcctcctttgccccatactctgaaacagtacagaagctgccaactccccacctctccctctagcttaccaggcgaatgaatgcccctttgccttctggaatcattctcctgcagttcagcatgagactatgccaggggctaataatttctctcagcaccatacccatgacttctgcccttccttggcaattccaaatgtgtgacaaacctcttcgggcttaggcaaaactgtacacaaaagtggtttgagtaggaagaaatacagtgtacttttttcccctttcactacaattttttcagaattatattctgcaacaatgcctcacttcctttattattatttttggaaagggtactttcaatttgtttaggtttaaataaaagaaaaattttattaagacttactttgaaaattgccaacgtcaatatttatgtatgtcagtaccttccagagaaagataatagtcagagacaactgctcatggtaagacatctggaatagaaagaccttttgtaaaattcctactgaaagatgactattgatgaaatacctctggcaaacaaaaacaaaaattgcaatttgtcgcacggtgttatatgacatagtatgaacaagcacagttgcaaataaatgaaatatgtgggcttttaaaaataaagtaatattttatgatgggatattctgtagcttcctcctccctgtgactgttataatttctttcttttcttttcttttcttttttttttttttttttttgagatggagtctcactctgtcacccaggctgaagtgcaatggcaccatcttggctcactgcaacctccgcctcctgggttcaagtgattctcctgcctcagcctcctgagtagctgagattacaggcatgtgccatcataccaagctcatttttgtatttttagtagagacgaggttttgccattttggccaggctggtctcgaactcctaatctcaggtgatccacctgcctcagcctccaaaagtgctgggattactaagcatgagccaccgcgcctgacggactgttataatttctgagaaacaatttaacttgtgctccgtgcacaatgctaggccttgttagagatacaggacttaggggcttccttggacccaaacccagaaaagacacgttgtacccttccctaaggctgattgcacacaaggtgaaatggagagcagagcaggacccagatggcccagagtagtagtagaaaagccactggaaccagagccagggacttggcttatggtcctggctctgagactaattaggtctttgggcaacattgctgtgcttctcttggcctcagctttctcatctttaaaatgaaggggctgaactgtaatctctgagagtccactcagcttaaatggaatcgtggtctcttcctacaggaatctagattttttggaaaacctgcctttgggatctagctaggctatgtattagcgttcttaagctattcattctccatatttgtgaaatgatacaaaaaaatcctgcttacctcactgtgttgtcatgaaaactaaaaagagctgaacccatgtgagatctttatgtcattccctcgaagaggtatgtgaatgatagaattaaagtgctagccttccctaagttttgtatgtcttggtatacattgaaggttcttagctaaagggatgagattctgacagtggaattccaagcatcagccagaattgggtgggaaaacctttcctgcattctcatgagctctgcagatagtctttattgtttttaaacccagccgtttaatcagacctcaaggaggcttttctattggagcttacagacttgtccaaactaaaaagaatatctaaacctggaggagggggatgtaggagggagaatgagtaagaaaatgttttgttaatgaataaagatcctgtatttcattcctgaaagctctcactttgctttaggaccatcagcagaagcacagagctagcttaataagctgtaggacgtgaaaaagtcactggtaggtccagggaagttctcagctgaaggggaccctggggaattgtccagtccacccccagccctaccttgcaaccagacaaatgaagctgtctgctagaaaatctggagataccctttcacatttccacaatgacaaagttgtgtgtgggagtccccaggaatcatttataactgaaagaaaaggaaaagccaccttcaaactccagttccaatagacctgagatctttccggaaacccaaaggaactgcctcatttggttttcccagagaatatgaacaacagatcaaactaatccaacctagtggaagaaggatctgtagagtttgggctaatttcttagtaatattcagctgcagccacttcccttctgtttaattttcacgtatcttagtgcttgaattcgtaattcatacccttgttttgaattcccactaccaacagattccataaggccattcatgtcaaacaccctccaaacagttccaagaaaaggactgagctagaattcttttctgaacagtcagaggggctatggacctggtttatatgagtagcatgttctcataacccccaaatccttgacagacattccagggacatggccacttctgccatgtagccaccatttcaatcaggcctcctcaaacaacttactcctaatttctacaatatgtaggtggcaactgtagcccaacgggtgtccgtagatacaaaccaaagctggctaaaaccatgtctggaaagctgacaaatttccaggcaatctaccctgagcagcagacagaaataaaagagctggtaagaagagaaacagacatataatataacagagtttcctgaaattcattataccaaacttccaggatagatcaaggaattggacctaattctgccctgattattttgggtatgtcattatcaatgttgcagaaacatttttaagccactgtctatcaacaatttgatgaaaaaaaaaaaactaacatttcacgagtaatgttgagtgcacagtgattttgaaagaatcactattagtaaactaaacagcactctaaataaagaaaatgactgctgttaagacatactgtctgagaattctcaggaagaacaccacaacgctaactctgctgtatataagaaattattccagtatgcatttgagtaattctgcattttaatttaaccctttgaaacattaatcaaaccatggctaattataggaattaaggaattaaacgatggaatcttctaaaagatattatttaaaaggcagtttatacaattacttgtatagatgtttgctttaaagaggaaaacagttctactgtaatgaaaagggtcttagaaaattaaattaacaaggggggaccaggctgatatgaaactaaattagcatcaaatgcaaattacagggtacttaatggtagaaacaggtgcagagaagaaccctaaatgagataaatgaataaaacatccctctccacaaatgtggaagctgacacaaagtcaatgatatgaataattcagcagcctccacactgctgttgaggtcagcctgccttgacctttgaaacaggaagtaaaattcagttcaaatttgagtgactagaaatataacagtcatttgttttttatattaaaaaatcaacagaattttttaaaaatacaaatacagaaaatataaaatagaattacagtttgaactagagacattatacaatcaaagtacttagtaaacaaacaaaataatttgataagattttacccaaaccatacttcaatatggaaatcctaaaaataaaaataattaaaaacatatataccagtgctcagcttaatgaaactccctgtgagaataaatttttaaatcgttatcctttcttcaaagtattttgttgtgttgctatcaatgtaaaaaaagcatgtcataatttttaaaagccacatattcttattagtaatgcaaaataatttctcatatttgaaagataaaatttggttaaactagatttttaaaaatctatgtaaagttgctattttttaattcttcaattcctgattgaataaatactgcatcctccaaaactattcaccttagaaaaatgcaacctaggttctaaaaacaaactattctcataaccgaatatctattgtggttttacgtgtcttttatcctttttttttctttttgcatgcttcaaaagtattttgtacagtcaaatagtgaaagtactctcctcatttcaaattgaatttagtgctgttagagattaacagggtatgacaacaaaccaatttctacaagctagaaagacagcaaaatatatatggtatatcaccctcgtccttattttacaggatggcataaaagatgtttgataatagcagttatctctgccctccaattggttctattaaggggacccacaacttggctatctacctttcatctatctactgtgcttgtcagataaaagattatgttgaaagatgagcttaattttattttctagatttagagagggttaaagctacatacacacacacacacacacacacacacacacacacacacatacccctcagccatctatgagagagcagtggtaaactaggtctatgattgtaatcactgtaggaagaagtttgagaaatgttccttccaaaccggagtgtttagttgaggcaaaattaaagatgcagggtgtgctgggtatttcttaattattattattattattatcatatctgctaaatcactcctcgctcgacatttaatacagggtgatagacaaaacactgctgatttggggtttgccataatgactgacctgagcaaaggctttgtgtacaaagtggctccccattaaataagggctctgtggaaccagctggttctcattttgaaacaaccggtttctgtatccccaagtgctaaagaaaataatccctgccatctatgactgcacactttcacagaggcagcaacgagaatttgattgtggagataattaaagtcattcctggaacttccaagaaaaaaaaaaaggtggaaagaggtggggtagaaagaaagaatagtcaatgatagtgtttaaaattaaactatgacaaatcattttgagtggagaagagggaggaggagcccccgccctttatggaattcagttgaaacagctctgttttcttccccactcggctgctccagagggaggtccgagatgcgattagtcagggcgacggcccccagtgtccggctcggaagccgaagaatcgaaacatggctcaagaagctacttgtcactgatgacacatcacaatgagattgttttgttttttttttttttacgtttcaatcctaaataaaatagccgcggaggaatctaactggactcttcaacaaacattctttcctagttgatctgaaatgctgaggttagtttaatataatattaagaaaaaaaagagtgtatcagacattcagagacactcatctttcaatcttgaggagagcttattcttttattattttttgaatgctacattgttctacaataagaatccatgttcaaatagcctgaatgacattcagctgaacctacgttccctgcctgcctacattatttcataagcttttgggaaaaaactaaaatatgtgtaatctgtctgtctgcgctatctgcctttaacaggaagaagagatgggctcaatgaggacgactcacggcctctcaattaacctgattagttcagcacattgctctcatgaatgacaccttatcttaaaataagggagaacttccttcctcgagtagacacaggagccccctaaagccacaaagatgcagcctatcaaatgtgagggcctctgcttctcctccctcttcccagctcgcaggtcagagagactagcaggccaggcgcctgattggattttgtgtcctaaggacagaaggcaagctcccgtctgcccaggtggccttggagaaggctggggaaagggatgccctgtgggtaacttcaagccccttctttcagagtcaaccaggcacatgatgggattgggggtgggggacaggaagattggggagggggagggagggaaagagaattcattaacccttcaatctccagagtatcaggtcaatgctatacctgcctgaaagaaaaactggtgaattctgaagtcttctaatagtatataaaacaaaggcgctgcttgcacaggggtctttctaacactgatttcgcgtttgacataatagaggatggctgaatttttgccctgcaaaaatcaagccttctcccaaactctctgaaatctggtggtttgcaaaggatgccacatatatatgtttttacaaaataagaaattcccattatcatgtgtaatacacatagttaatagaatatattcttgaaaatatgctttgtgagaatgtcaacagcagagattttcacttgtctgctctgtgatttacttgatcaattaaacagttaggcaatgaggagatttgcatggtaatcgtgtgaagattaacatttttaagtgtaacaaatttaatattttatcttacattttctgttcctcatcattctttaatggcagtgccatttcactttattgtgtagttataacaagcttgtctttagacagagagatgagaccaccagattcaacaactgcatttctagttcctgtcattccttcttttcacaaaaacaagccctaagcatctagtacacaggagggaggcactgtgctcaacgtagtcactgccctcttaggcttacaacctaccctccaaagcgctcatctacctgcctgtgctcagcaataccacaaacagctaaaattagaattccatagttggaaagggtcttagagatctcttccttcagtcttaaccaacatgtagactgcctcagaagagtgcaataaagccgtggaatttgcccaagttcgatacctctgggtatgagctaaaaggtgactttaacccggggatatttttcttctgcatcatgatcccagtgtaaaatggcattcttctatttttaaaacatatatatcaatatattctttgtttatacttgctattactattccaactatttttgggggactgggggcagagatcaaccctgagacactgagaaagctgcatgaagccaggaactatgtttgtctttttcactgttatacccccaaccctgaaaacagtgcatgacatataatagaggcttaataaatatttgtggaaacaaaacaatgaatgagtctttatctaaggagacttagctaccatgattaacttcagtaaggtaattgtgctcaaaggaagtcccatggcaatgatcacattaagaatgaaaatccacatggaatatacgatgctcaaattgcaagagctacctgattttaagcacctgttatgtgccaagcccagtgctaggtgtttcaatcctcacaacgcttcaaaatagaagtgacttttcccattttgaagatgagaaaactgagccccctgaggctcagctactaataagtagctgtggaggaactggatcccttagccaatgcactccaaaatctatgcctttgccatcatactgtgccttctcccagatttctgtatggattactgatgtttttttcaagcaaatacacaatcaaattaaatgaggacataagaactcaaacattgctccagcaatgagtacaataaacagtgtcacatatgtatatatgcatatatgtgtgtgtatatatatgtgtttatatatatgtgtgtgtatatatacatataaaatcctgaaagttaattgtgacatcaactaagaaagctggcttggtaaataggtttagagtaatacatgaaaatgtgctgtggatagcaagaaaaatgaaataaaagagacattatgaaatactgaaaacagtgtttttagctgagcaattgagaaaagggaaaaaaatcagtctgggagataggagatgtggagtttctaatcacttgctttgtcaccaataaagtggatagttccttaggctgtgtgcctcagtttacagatctgtcaaatggagtcaatttgtgcaaagagaattttctgagatggtataccccgacgtgctctaaaacgctggaagtgccatttaggtgtaagctactattaaactcacagtgatcaggggttttgcttgctttgttttaaggtgctcatagaccaggattcagatgctggtcttcacgagccagatcagggcactcccatttctacagctacaggaagaacaactcagtgtttaaaaccatattctgagacatatcccatatatctaacattagaatctggctttaggaaaacaacaagactgtgtagagaaacatgggttttcaactgttggtaacagcttcaaagataaccaggtgaacccttaaccaactttcttttctaaagaactttttaaaaaatgaaaaagagactgctctcttttcatctttttttttttttttttttttttttggtctctgtagagtatgtgcgtgtgtgtatgtgcgtatgtgtgtggtgtgtgtagctaaacctgatgcaggtccatagttcttcaaattaactttccattctgtgagggggcttcagccaatagtgcacccaagagtgttaaaagtgatattttcagatattactaacagatcagaatacttatgaacgagaagcacattaaaaacaggtggggaaaatctcagtagtttacctctggaaaacaataaataaattgcaagcagcatgactgtctgatattcaggtggagtaataaagagctttagtcaaatcatggttgcttcaggaaggtggaggagggaacaaccttttgaccattagaaaagttacccagctgggctcctgactcctcggcatgcaccagcagagtctaagtcgcgtgcaccacccggcaaaggcggagaattcacggcactggcggggagcagcaccacatcaaaaagcagcagctgatgtcatgaaacaaaataccctatcattttactttgataattttcaattcatcaattaaaaaagaaaagaaaaaaagttatttcagccttgaagatgtcatgtcctgagccccagtgttcacaccctacagaagggctcttcctacccacacatggtatcaatattaagttaattgagcagcaaatgagcaaaaaagttcttgagggattcttgatattgattaaaaggacattaaaaaaaaaacccaccacaacctttacatgaaccaaaatttgagaatgtcgccaaagccccataaaatatgtataatagtgacagtgtccagattaaaaatgtacatgggcagcttgattactattttctggttttttccctgccctggctctgaaagtgttaaagaaaacaataaaagaacaagtgagtgtacagggtaggatttactggcatttacttttaatctatggcccttcactctgtagcttatcgggcctctgtcagtcctttttccccctttatatttcatgaggagccccccatgctgctactgagagacagagcccaagtgtctatgagctttttgtcaggtaaaaagagaagaaaaaggaaaggaacaagaggaaaagcaaagctaagaggcatctattagatgtcactaggcttttgtattcatgtcaatgattcaggattagagtatttgaaataatcttattgagaggaatcaaaaggcccaccgagtgagaggctgctctgtagcatatggcaaaggcacgaacaatatcttattaaagatgtgttggctaacaccattactttatattatattacaaaactattgtgcctcaaacagttagcaggatggtatagttaccaagtgccattttggaggttattgtgtaggatcaatctatataatttgccagcatgtctagctcagtcatgacaagtagggtttagggcatgtttgcaactggaaccaagcacttcactttcaaaaatagaaattcccaaagcacacagaagaccactctgttcccaccgaaagtggagtacacatttcatagatggaacgccaatggcctgtccttccccagaatcagtttaattaagtttgcatcatttaacatatgtgacaccccctgccccacccatgaaaaatgtaacaaagattttttttttttgcatgactcccctccctattaggaatacatgcacagacacacacacacacacacacacactcagcttcacactttagcaggattagggcaattaaaattctattagaataagtactgtaacgttaaaaccttcttttgcttctggacaaagacttgtaactggagaaatagtttgtaagggagatttttcttcctctacccacacctttcaaggcagggagcaatgaaagacaaacctgtactgttcaccatatttcattgattgcaataggagtattgaggtcacttttatattgtcctggatagtatgtagttacgcggtttgtaaagagaggaatgggatggggggctgtgagaaggaagaattagtggtcgatttcagataacatctcatgcaaattaaagtgaccaaaataccatctctttacgcaggaaccactaaatggagttttttaaatctggtcaatttttattagagagttaaccgggtgctggcaggagagggaaatgaggaaatgaggggaatttatcaatggagagttacacttggagagagtttttccccccattctaagcaacttcttttaggaaagtaaaagcatgtttaatatactcatatattctcattacaaaatgattgtgcatagttactaatgggacacacagaggacttcgtactgcttttctgtatttttccagaactgttacaaaagcaaagttatgatgacatgggattaaaaacctacaccacgggctgatacccgggccatgctacacatacacactactgattctctgaagctccgttaaatacatttcttggaagttgctgccattatttcctttacaggaaaaccactgttgttcattatacagtgtctgcaatagtattataccatgtaaaagtactttgcattatgatacattgtcagcgtattcgaaatgcattttaatgcatcctggttgtgtatttgggaatagctgatagcaaatggaatatagactgcgattagcttattgtattagttattttcttatcacggtagcaaactgcacacaaatgtacggggctcatctcatattcagaatggtattatctgatatgtgataaaatttagaatgatactcattcacataagtctcatcgctaataatcacatatgaattcccactgagaagacaaatgtttaaacacactaaggttaataaacagtcttaaattcatgctcagtgtcaatgctggcttttcacttttgaaaaaatgcaaacctctcaaaccaaccaaaaacacaataattatcctgcctagggcaattttagagagtgaattcctcctccttttattttaaccaagcagtcaaggttacaaatcaggtggtataaaaggtttatcggaacgctgagaaatgcatttacacctctggttcttcataccccacacagccatttgtgtatagtgcagaatgattatgcattggtggtggttggtccttctaaaaactggatgaagaccaaaataagaagagttgaaagggcattgaaatgaaatcatgaaactaactaaaagcctcatttgcaactttaataaaattatatatttatgttcatgttaattgaggactttatgtggatgacaaaaaataaataaatattggaatttacctctgattataaaagacagaggaaagccattgattgttgaaaggcccagatgcctttacaatccttggcaaatacataccacacccgacccaatggtaaaaagtatgtgggtgggtggatggatggatggatggatggatggatggatggatggttagatagatagatctctcctaactctaaagtttttatattgttttcctattatacatatgggcatatatgttatataaatacattggtgtcaatttaatgaagaaaattagcttggtgataaggcaacactgcacttttctgaaaagtcttaccacagaatttacacctcttagaaaaagaatgagtcttcaataaacttgtttatctgagcaaccataacatggttaagcttttccgttcatatgatgtacatcatataaaatcaacaggcaaatgggcattctaatattttcattactgaacattctatttcagataatcataaaacaaacccaattcgtgttacctaaatggaagtgatctagatgtggaagatctttagacaaatctggaaaaaagaaatacaggcatttttttcctttataggagacccttgcgtaagtgtgacccgaagtaattccaaacagactaggtttttcattttacaaaatttgtgtattttttttatgtcacatgtcaaggcctacatcccatagccatacacatagatacaggaattcttaaaaatgggggaaaaaggcatggtaattctgttaatattacaataaacaaactcaaaattcttacaggtacataagttgacaagcttttaacatccaagttttaaatatcggctttgaggaacccaaaacttttaggttactggagctacattatatccttaaaaaactaggtctaaattcacaccaataggagaacataatttgagatggaatttcatcctttagtatttctatctactaaaaaaaaaatccacttgttaacagataaggattcattgcacaaggaatgatgctcacattgtcacccttacttaatggttcatttcatcaattgcactaattctaaattcaaacaaacaaacaaacaaacaaacattaagctgccccctatcccaccccactgcaaataagcaacagaaatctagccagaaacttcaggagtctgtgtgaaaagaagcctccagcatactttggagaaagaaatgtttttataagaccatctgtattcatccatgtcattgctcaaagatagtttaggaaaataaagagtttggggaagcaaattaagaatgaatggtcatcctaaccagatatggaataacagtctgcatacttaatatattcagttccgacatttattaaaaagtttccatatagaaagattttttaatagatgcagaaaaactgggttcccaattcagactaccctatgtgacttttgtcattatcatcttttctgattcttacaaagtaaacctaattaagaacctccctcattagtcttccagaaaaattagcacagcttatgctaattactcctgcaaaatttaataaactcgttgaaatgggaatagtctaatgaggttttatttattgaactaagataactccaaggaaaaaggttaggacacaaggatatccaatgtggtaataaaactcctatttattcaatttctaaacatgaagtttattgcaaaccttttaaattcaaatattagttactgtgtcaatatgtaaaatcaatctccaccttaattcaataactggaagtcattttttgctttttactttaacaataattaccacacatagccctttacctcaaaaataatgaaatctgctgttatcagttcctggttatttgctattaaacataacacatttgacttttcccatgtctatgcagctcaaatatctggatcactgagtgcaggctgggttatgtgcttcttaatcaagctatttggcaccacacagaaatgtaacctggcattcaactccagatgtgcacttcctgcatttacagcaatttttctataaacttttttgaagtgacttgacaaattgtcatgattgtaaaaagaattggggtcatatgtttctcagtctgtgcatgccataaggatgaagtataatagaagccccttttctaaatcacagtttgcaactgctgattttgttaattctacttttttgatagaatatgccaggctgatgtcccaaagtcagtggcagcaaataatacagccaaaatttaacacagaaatagcttgccctgcacgattgcactatgaccagaaagtctcttctctctaccctataaatagttttcctgaataaaccactgctaaaagtcttttgactgataaaaatagtagtgttctcccaaattccgaaggacaagcaaagagagctaaaaattattggtgctcaaaagttgactgcgtgttaaaactatgctaaatcctaacgcaaggatggcctgtaccctcagctctgtaattgcatattgtatgcatcttttgaaaacagttactattgctactgaatgcaggcctcatagcctattttcacaaaatattcagggatttgcatccataaatctgaaagcaaatcaaaccctaagcacgtaacacagatattatgcaatcagtaatatagaatcaaattggaaactatgaaattcaaacacggttgccatcattttttcccctttgcagcaattttatggaattgaaaaatcttttctattttgccctttcttgcataagttcttctcttgttgttattctcttctctcgctgttaagaatgggagtttcacatatcagcacagacaggactggagcttttaaaacctttggcagcctgaaggacaaataaattctgaaaactcaggtgcaaataaaaatagctaaatggggttttgcatatcaactggcatcactgcatgaaaagatagttcatcagaaacaatggcaacagccagcgaataaacatatgctgtggggcttgtgcacatacactgagtttcagctgtttttaaagtactcctatctgaagagaccaagattggctacacactgttttctactttgtcaaaccaaaagggaaaaaaaatgaaaaggataaatgtcatgagtaatatccccaaagccaccaacagcataaagtgcatacttattttgcctaaattgtttgaactaccccagccaagaaaaggttttaagtacccttctgggacagatgcaaagcggcaacaatagaagccacactaatgcaatccaggtaacacaatcctgtttcaaaaacaggggccgggctaattacagtgctgctgagtcaagtttcttatgccatcgcaacccacaggaacaggtcaaaatcaaatgttattcaaaccacagtcatatcaaccttctatatcagagtcacagcttcaaaccaaacgaagaacttaaaagcttaacccattcacaagcgaaaaaaaaaaaaaagtcttttcattgagggtggcaaggtaaggttcttgtcatcatctaaaccaaaaggaactacatggcagaacaaaatgcttatagtttcaaagttttggggactatttgggctggtcctttgatccgtacactttcttttcaacagaggaggaagaaaaatgcttaaaataacaaatgatattttggagaggtaaatttaaataaaacaaaccagcataaaggttaaatttacttgtgaccttattcatttggagacttatgttcaatcacagaaaaagcaactatatgaacagtatatctgcttttgtagataaacatgttatcctaattctataggtagcacacacatcaccatatgtcaaactttctcatcttttaactttgaatcaaatatactaatactcttatatggagcaaaaatatatatattttagtgaatactagtgaggaatatttagttaaaatatctgattgaaatgtaacctttataaagcttcttggcaatcaattgggtttatgcctgaagactcacataagtcaaaatcaacaatcgatcttttggcataaattatgttgaagcgaagtaaacatcttgttttttgttgttgtcattgttaactgaaaaatgataaaacaagcccaaaaaaggtagaaagaaagatgggtttttttttcttttgttgttgttgtcaaaaatcaatattgctgaaacccaaaaagggacttgtgttcaaccattggtttcctcaatgagggatcggtcagtcttattggcaagactctttttccagctagtacaagatgctagctcttttcctagctgacaattgacagtatctataaaccttccaggccatttaactctcaatgagtaatgctatgtaacaaatggtttatcatacatgtttccatacaatgaatttcaataattaaaatgtaaaatgaatatttggaatgcgactttgcataatgcgtgcacactgactcaaaattacaccgaacaactaaaacagatttattgttctacggtgatttacttggtcatgtcagattagtaatatggatctgtttaaaaacacaaaaattaagacaagcaggataaattaatcaacttacaatatggtctcatactgcaatcaaatccggcaaataacagtagaaaatcttggttcacagatctctttaaactgcttttatgcataaataaaaccttaaagtgtagatggattacgtccaacagaactactgtagctaaaagtgataatgattcaaacatttttcaaataaaagttaaatatttataagcacccaaccacatttcataaatcacaaactattattattttatttctgaagcttcctggcacagcatgaggattgagccacagaaagtcaggaaagaaaaaatatattcctttaggagcatgaatcagacaaaaaccggagcaatccaaggaacaggcctctaaaagaacattccatatggctttcccaggaatcaaaatcgctcagcacagcgtaagtcatgaccaacaggcaaatttcagccacatgcattcctaaccctcgcccatgagcaacacaagggcaggtgtttcattataatgaggaataagaatccagtgaaagaagagtggtccctacctgtcaattatcactggatctgagggagtctcatttcggttgccacagcttttcttgtcacaacagcggctatggagcaaaagcgaaaggatttagtacaaccattacaatgtaaaatcatcatttaggcagacagaaggctcaaattgctgggttgcaaatgctagaattaccacaaagccatacctggcaatcaacggatccctgggacagataattctatttgggtcacctatgggttaatggccaggcttaacctctccctgctcaaagaaggaggtgggggagaggggctctcccagagccaagactcagaaccccaagatggggtctccccatgactgcccgcggtgctggcagagttcactgtgaagtgcactgttattgcatctacccaatgagaatattcaaggttgtgggtggctcaaacgttcttccctcaagatcacactaattgtgtggaacgcatcaataatgaggtatgagtgatttctccccctccagtcattttgtattaaatggattcctttttcttctcttttctcctttatgggtagcatttccttcaaccacagcctttccaaaaatcctacagctaggtttgcttttgaaccattttcatgagaataaaggtaaaacacaataattaagacaaggaaggggcaagataaaagaaagtggagattcacattcctctggctataaaagcctgttctgaccctcacttaagttttctgggggcattatggacattggaagtaaaggttagcacagctctgtgagaggacgctctttatgttagagaaggaagagcctatgggctcgaaaagtacctattactaaaatctcccctgccagttgtggctgccagttttttaaaaactgagatgccttctaaagggtgaacattttatgtttttgaaaagtacaatggtcaacagaaaacgatccatctgaaacttgtttgcaaataaaaacaagatctgcaccaggggcatacttataaaagcagtgaagtagatggggagggaggtcctccaaaacttacatttcaccaagcaccacaagcaaatatgcacttcttgctcttacacacacacgtgtacacagagagagatacacacatacgcgcacacttacaacttagtgaatcatacagcctaaatttagagggctgctggagagaaccaaatattgaacttcatcttcaggacccagaaatatactcctgcgtagggagtccttcaccaaaattggaaagtctcttttcttgccataactatgcctctgagaagagaattagtctccactcttaagtgtcttctgtttttctttcatgtcttcggagagtaagagtaagaactgtatctcctttgtcaaagcctcggctaaaaccactctgtctaccttatagcctttcaccttctgattcagagggaactatttcctccaggcctgagttctgctatatactgctacttttgggatggaaaaaccaaagtatcatgatatctaagagacagataaagtaacaagtagttgaagcagtggaaagtacaagcagttgaaatgcatgccagaaaatacataaaaatataactccttcatccctgaactctgatcccctatacctacatttcatgggcttctcagaatagtatagtggttaagaacactggttctgaaatctgacagagctgcctatctcaacttgagcaaggtaatccacctcacaggatctcagtttcctcatctgtaaaatggagcaattgcagtatctacctctaaatgccagggaacaggcttgaggcaataagggtataaagacttggcttcatgactagcctcactaaagccacaatgaagcatcattatcaccccctgcacctaccctcttcagtcccttcctccttcaagtccaggcaaatctgccctgtgctctgcagaagcagcaggtctccaaaagcagcccatcgacagagcccacgtctcctttacccatggaggaaaactgccggttgagaaaacctatttctccttcattttccttttcaaaacagcaagtaggcaatgcaagctgcccacagacctgcctgggagaaatgtcctccaggaactcctccaacctgcttgctgataaccatgcacaagggtctgtttttaaagcctatctgattttctcctcccccactacaccatctccatccaagtccttggactctgcagtggctgcctacttttctgtctccactctgaccccctgcaatagccagagtgagcttttccaaatgtcagtggtactgtgccatctcactgcccaagactttttaatggcttcccactgcacttagaacaaatccatgacatgacatgataccagaccacctcccaaccttctgcccccttcctccaacttgccaagctcctaccgcactggcccatttcaatccctctcagttgtgccctgttcaatctgacctcaggcccagaccctggccgactcttgcctggcgggcctctcctccaacccttccctagttagccaatcttttctcaccctcagagctcagcctatagctccttccccagagaggtttggcctgacaccccacctttaatctaaattaggtttttcctgtttttttttttccttttaaggcacttaactcaatgcaaattatatttttacatatatgtgtgtgtattttttgttactgtctttctccctcttcttattcttctcttcctttaactcatagacttcgtagaggaagaaactatcaattttacttacctaatgagtggcataaggcctggggtagaatagaaaagctcaaatattaattgattgaataaatgaataattttatgaatgaatgttatgtattggggggcaaatacaatccggaagaataaaagggtgacagataaatccaaggcattgttgatggaaggaaggtgcacctcatcccaacccgtagaacaaaccacctcccccaagcatgccacaccaggcctgagatttttccttttcacttaagcacggtcgtcatctaaaaataaaaatgtccctgagagcagccagatgaattgaagcattcctttctaagggacccagggaaataggcagatgcaaagagcagaagtgtagaaggaaatatagaaatgaaatggggagaatgaagaaaagtagagaaaaaagaataaagggctggagttcactcaccacttacaaaaaaaactttaggccaagtatgaaaaataagcccaacatgtctcctgtttcttgggtcatatcactgcatcacatagtcattattcctgaaatgagctactccggcttctgttctgcacctcaaaataatgtctgctacaaaataatgtctacagtatgattctgttaaatatatatatacacacacacatacatatgtgtgtacatacatacatatgagtgtacatatatggatgtgtgtgtacacatacatgtgtatatggaattctgtgcagcattaaaaagaatgaaggtagagttagaagcactggaatggaaagaaatgtacagcatattgtgacttgagaaaaccaagttgcagaatactattcaaagtatggccccatttctgggagaaaaatgaaagcatgaaagagtgaaagggagagagggaggggaagagacagtttttacaagtatggttcactccctcacttcattcaagtctctgcataatgtcaacggctttagaaatgccttcccctctgggcatggtggattacacctataatcccagcactttgggaggccaaggtgggtagatcacctgaggtcaggagttcgggactagcctggccaacacggtgaaaccccatctctaataaaaatttttaaaaaaattatctgggtgtggtggtgggtgcctgtgatcccagctactcaggaggctgaggcaggagaatcggttgaacccgggaaacggaggttacagtgacctgatatcgtgccattccagcctgggtgacaagagcaaaactccgtctcaaaaagaaaaaagaaagaaatgactgccctagagcactctagctccttattctgcttaacttttcttcatagtactcaccatgttgtattttatattcatttgtcttttattgtctctctcacctgaatataagccccacaaagacagtcatagaccccagcaactagaactgagcctggcacacagtatgccatcaggaaatattttttaaatgtaggaacttcaaagagttaacctatagagagtggaacaggcagtggggaagaatggaagacgtgcattttatttttatatttttgcagtggtttgcttttttttttttttttttttttgcactcccaggctggagtgcagtggtgtgatctcagctcagctcacagctgcctcgacctcctggggctcaagcgatcctcccacctcaggcccttaagtagttgggactacaggcagatgccaacacgcccggctaattttgtgtattttttgtggagactgagtctcaccatgttgcccaggctggtctcaaattccctggctcaagcaatccacccagctcgacctcccaaagtgctgggattacaggtgcaagccaccacgcccaggctagtgttctgctttatatggcaatatgcttttacattaaaaattaaaaatcaaccacaagcagtggaaggaaagacttcttgtagactgagctgatatcaagccccctgtggcttcctagagccgagcagagtgaggacctctcctttgttgccacaatgctctttcctgcccatgtgagttctcccttttcaggtagaactgcccatagttctttctgctaagctcagaaggaccaagagtgagcaccaacctccactatacacaggaggaaaccaggaaggaaaagctgaaaggagaatgaattcacttatgtttaaggcagaagagggctcatactgaaacaattccgtagatgaaacagatgcaaaagcacttaacggaaaaagtgacagtgttaataaaagaaatcacaatgataattaggtcctcattactgtgtgactgatggaccttcatccgttcaaagcactattttttaggctcctacgatgtgtgttgggcactgtaccaggcacagacttgggatttgctctctcatgctggcatcttgcaaggcttggagtttcctaatttgctttgctgccagggtaagattttaaaagcaggccactgtttacatcccttccgaacctgcaaccccagtgacatgagaacaatgtggccagtctcaggcgttggtagccagcacctggtgtggtacctacactacggaccgaaatcagcagccctttcctcagcaggattgtgtgtctcccaaacaattctgcacatccagagaaaagcgaacttatgagtctctttcttaccagcctaacacaggtggcgtatttctagagcttcataaactagagcaagaaacacctaaatattcccagtcatggaatcggcagatcctcatcttagggacatggaactttttcctatgaatagtgtctttctcaacaggaggaaagcatcatttcaaacttgtaaaaaacaagatgccttacctatttccctaaagtggctagagactgagatctatgatttatctgaatagtcttattaatagttataaagatgacttgattttaaagaatccattacataataggctcttctatcctctctcttcctcccatgtcttaaagtaagtgatccatcctcgtcacactaactcaagtacctgagctcacaggtccgtctcattctgccttacctgggaccagccccaccaaggactcctcttctgttttgcatttgccattcttccctccctggttaattctttccttcagtttgcaaacattatcaagttttcccattgtctaaaattttaaaaggatgctccttcttttctctgagttagtttcttcactgccgacatccttcttataagagtccctgtcactacttgccatttcaaccacataatacgggcatccaggccctcagcatgtacttgaatctcctcttaaagtttaccagtgactgtctggtgctttctcagccttcatgtccatctggatctctctagcacttattatatgactccccctctttgaaacaccctccttttatcttttttttttttttttttttttgagatggtgtggagtctcgctctgtcacccaggctggagtgcagtggcgcaatctctgctcactgcaacctccacctcctgggttcaagtgattctcgtgcctcagcctcccgagtagcttggaccacaggttcacacaccaccacacccagctgatttttgtattttttggtagagatggggtttcaccatgttggccagactggtcttgaactcttggcctcaagtgatctgcccacctcggcctcccataatgctgggattacagacatgagccaccgtacctgacctcctccttttatttctatgctctgtatgctcaagcttctttttctgaactctctaacacaccctgccttcttgctaagcgtgattattccccccaagaatatagccatgccttctctttctattctccctcccttgtcaatcccatctaagcccatagcttcaactctcacccttgggaaacgacctctgaagtcagttatctttgaccataactttatttccagatccagaactcaggaccatccacctgcaggactctccacagagaaattttggctggactgaaacagacgtgcccaaacacttcatgcaccctctaaaatccccctccctattcctgctacccaactacaagtatttcctcccttctctgaatagacatagccctttgcctcaacctctcatcacattcaaccctttctagagtgcagtctcgttatctgccaaccaatatcatctcccaggccacaccataagctcccctactacagaacaaagtcttccctggctctccgtttttgagtgttttgcacatagtaggtgctaaaagaataaatgaaaacatccttaactcccacaactagaatgaacaaagtgcatgaatgttttggtagacatttcactttgattcaaagttcttttatcctcattcacaccaaacaactgcgcaccaagtacttagccccacactgcaaatattgctgttactgcttctattaatacaaatactcttactattaataataacagtagatattcagtacttactgtgtgtaaaggcactgtgataagcatttgtggtgattattgcatttaatcttaatcaccaacttctgagataagtaatattatcctctatttcagaaatacgaaaactgaagacagaggaacacccagtaacttccttgccttcaaaaagcaatcagtccagcaaaggaagacagattgtgggcaaaaagttacaaatgtgctgagtgctatgaaagaaaagcacagcagacagtagtcccccttatccatggttttgctttccatggtttcagttacctgtggtccagtacatttttttgttgttgttgttttgagatggggtctcgttctgccacccaagctggagtgcagtggtgcaatcagggctcactgcagcctggatctcctgggctcaagcgatcctcccacctcagccccctgagtagctgggaatacaggcatgcaccatgcctggctaatttttctttcagtttttatagagatggggggtctcactatgttgcccagggcagtcttgaactcctgggctcaaacaatcctcccaccctggcctcccaaagggctggtattctgtacaatatttggagagagagatcacatccacatagcttttaatacagtttgttttcatggttgttctattttattactaattgttgttcatctcttattatgtctaatttataaattaaacattatcataggcatgcatgtataggaaaaatatagcgtatgtaaggttcaggactatctgcagtttcaggcatccactgtgggtcacgcaacacatccttcatggataaaagaggaccactgtttacaggacaacgtaacaataggacttgactcaggctgagagccagggatgcttccctgaagaagccatgcttaagtgggaatctgaaggatggaatcagaataagccagtaacagagaaaggaagaaaagggaactcaagggagccctgagaactcatggtcctataagaaaccatacactgatgagggaaagaggtctttcttaaacagagctctgggaactaggttcactgaccaagcatagttcttattttccatccacatttaaacacaggatgtcaggatgccctttaatcaaatctcttctagaatcgtgctttagaaaatcatgtgtggggccgtattattttaagagcgtagccaacaggtatagcaaaatgtaatgatgattgatatgatagattccaatttaccaaacaggcagagactctctcagaatttcacagaaagagctccatgtccagtcaaagaggctttgtctctgagtggtaataataattataatatgatccaatggtggccagtcccttatccagcccaggcagtggggtcacctttcagacagaacacaatggattttaaaaatttgcaaccacctgagacacaattctctggtgtttctcattttttctttttttttccccctttgcctgcaacaaaacagaatcataccaagccttgtcttgtcgatctaaattctctgtgtctccttcaccatagccaacatactataaatatacagctttcatgacatcaacacaaagttttattgtgccgttagctttgatagaaagcactgcagaaagttgtttagaaattaaatatctgaaacaagctattttaaaatccagggccctcactatttcatgtctgcaatgaagaaatttcatcttggggagagcaagctgtctttcacaccatatggctaatggtggtgcatagcaattagccagcctgattaatggggaacagactctaattttatgcttataattgagcctgcatttgcacccctggtgcaaattcagcacatcccaacttccacttaaaacaggcaagaaatcaagagaaataggatggtgtggaaagtgagaatttttttcctaaagccccctaaagagcatcagatttgcaatttaaaagactgttagccacacaatagatgacaggtttgtgtaatagggtcatggcagcctggtaaacaaacagtaccccttatacatctataggcagccaggaaaacccgtaatctgtaacattagcaggatgacattttgaatacggcttttccctcttagccacgcagtacaaacatcatcatttgccttcagtggcttcagaattttatttttgctatttttatgtttctgaaaaatagaaagaacatcagcagtaaagcacaccaaccagcataataaagtactttggaccagtgaattttaaaaacaagaaaaatataaactgcattaatagagggtaggcctgtgtgtgaaaggcataatatatctttaaatgtttcaagaatagaatgatttctagcatagtctaaacatgtgcagatatgagatgcaaatctatgatatatagatgttatttggcctattggttgagatccatcttcctgtctgtttcctattttgctagaatcacatgtagtacaacatggaaaattcattctaatgacatgctaattgtaagaagccagaacagagatatggtcaaaaagatagtaagaagaaagaggtcatgttttaacattttctaaaatgaattttactcacaattctgaaaggtgcaactcagctttattgtagaattgttatgtacaatataacattaatttttgcctaataatatcttataaagaaatctattgccatattttgggggttctgctactgttttaaaattagagaaaaacaacctattttcataatagttaacaagttttacaaatcactgaaatgaaaacttgtgaaactcctatatattttagaataatatgttagaaatatttttaaaagggaaaaaatgaaaattgtatatccatacgtaactgtagacatacaagaagttggtatttgggatttcactcagaaagcacattaagccctttttctttccacctgtagagttttaaggttgctttcccccacaagtccacaagcagcaaataaagcccatccatgctgaggcagcagctgaagccctaaacggattggtcagtaatagtcagcagccaggccagcattgtgccaggaagagcctgcatggttaacaaagcaattagtagcctttctctgatgcacagtggcatcttcatgctttatccaattattcagaatatattgggagcaaactgctggtgttactttatgcagaataagaatgcaagttaaagggctgttccctggcctactccctcacatgtggaaagcctggctgaggccatggaagttaatttggtctacttgcctgttttcaaatgtagcttcagtctgattacaggcaaaaataaagacactcatctatgggtcacatgaattttatgccttttagggactcatctttgccttccttccaaaagctcactacctctgcgaagtattggctacattgtcagagttatatatagggtaaataagaggtgagatgcaagaggaagaaaaaaaaaacccacatgcaatttaagaagaaatgatgcctaagtgtggacgtcatattttcaagtgggagaattagaaaggggaactataactttcaagtcttacccaaacagaagactctgctgacatcaatagaactcttactcattttactagcaatgcagttgagcgcatatattaacactaaaagggttatattgttttatttgattttaagagagtaggggaaggcagtgctttgtgcccattaacagtgtgatatcaaaatggaaatgtatgtctttcgggatgaaatctaataaataattaagaactactgtgatgcctgacactttactaccaaatactcacatctaacagttctttttagattgtctatagaagcaagacaaatgtgtaccaaaaaaaaaaaaaaagaccaaagttcaccaagatttgaaatgcaaattcatcttctctttgctaattaacgggagagaccaagatatttcttacctgcacatgatctcatgtgtgagcaagactcggcacatttctgggttcttgtcttggccttcatacactatggcctaaaagcaaaagcacagttttagctaagaatggaaaggagtagcagaaaaaaaaaaaaaatcacaattgagttcttaaccacttcaccactactgaaggccaaattagctttgaggagccaaagacatcactgggttgatcgtctgaaggtatgatattcgggattaacctgaaaggcatgttcctctctgccccttcaaccaccttgccatgatgcacatctctggatcagagtatgagatgggcaagacagccacaattctccttttaatatagaatacaaataaatctcatcaataaggagggaaaccccagaaggcttagcagattgagatactatttagcgaaaatacagaaaagcatttggatttgatttttaaatgatatgtatttgcctcctcactttactacttccaggctcaacatttagtcttccagggatgggtagtagaaaacaagtgtaggtgaactaaggagtccattcactaactgtgtcatgtttgcaatgatttatcaatcagggaaaatccctcttcccatcaacaggctgagaacatgtgctctcacagggtgcacacccacccaaacaggaatactcgctggcatatgctctgtgtgtggatttaagccataaagttatctccctaaactaagaagagttacaactgactctcaaaatctggagtcccaaatcacctcaccagcccaaatagttttttctattttttgtaatgtgtttgtaaaacgaacattttactcaaggacaccaagaagattccctgggacctcagctttcatggatctacatgttaatacctggaccaaagcaatgcacacagctattagcagagcagggctctgcagtgggctacatttagctaatttaacactgtatcacggcataatactaatatcacacggcttcaaattgttaacaaaattactttcacacattcctatagccctcaatttcttgatgacaaaactacttaaattagccagagactatctttatatagtacatatatcttaatatagtatatatatctttatatagtacatacagatgctacaagactaacttgtagttgactctaacgtgctttgtttttgaacctgggactttcagaacctgtaaatgatgaatataacttgcgacccagtgtgtatagatcctcagagagaactgtggttatggtatctgatcccgttacaaaatgaacattgcagtaaaataaaaaatgagaaaatgtacttgcatgaggaaaaaatacttctccaccattggcccatcgaaaccactttttatggctaacctataataccttgtattttaaaaatttttttactttgacatacatgtacacctacaaaaagctttcaagaatatgtaaaaaattccaagatactcttcatccagattttaccagatgactaaaatgtttatattttattaaatttgctttattcttttctctgtagttttttctgaatcatttattaagtaaattgcagacatgccctaaatacttcagcctgtatgtcttcaaaataaggaattctcttacataaccacagtacagttatctaaatcagaaaattaacattgatacaataatttaatctacagaccctactgagattcaccagttacccaataatgtcctttacagcaaaagaaaatccaatgctgcatccagttatcacgtctcctttaatatggaacatttctgagtctttatatttcatgacattgatatttttgaagaacacaagccagttattttgtagaacatctctcaatttgggtttgcctgcgtttcctcaggcttggattaaagttacatacttcagggcagggataacacagaggtgattttgagttcttctcagtgtatcaaatcatgttgttgactagttccactattggcaacataaattctgaccatttggttaaggtagtgcttgctatcagagatcatgagccaggtttccccagggtaaagttattactttaccctatgcaattcataactatcttctgtagacgtaatccagattgtgttaatatcttactatgtgtcaaattttcatccactagtttcagcaagcattgattattctttgctgtattcttaaaagaccttttcaaaatcctaagcagttgcattactcaagaaaatgcattaactaaaaatgttttgaaaaccaaaaattacatctgcctgctttatttcctgcaatcactcctgaaaacattttaaaaaacacagtaaattacttattagatctcatacatgatgctaaaaaactctaatgaagcatttcttctaaatcctattagtactacatggtttgtatgttctctaaatactcgtaataatctctgtttcagctttaatatttgtgatgttttggttccaccactctttaaaaaataatatatttgtcatgctaagctaaaagaagtaagctggtaaataaattcacagatactgatggggctttccctaatatatatatatatacacacacacatatatatatatacacatatatatatacacacacacatatatatacacatatatatatacacacacatatatatatacacatatatatatacacacatatatatacacatatatatacatatatatacacacacatatatacatatatacacacatatatatacatatatatatacacacacacacatatatacacacacacatatatatagaaaagcttggtttttggaggcagggggaattatcagttacatcagatctttttatttcaattctttctagatgacgcaaatattagtttcactaagactgctggttccattgaaattagtgggcccatgatgatattcaatggatgcaatgctgcaatacaaatacattcatggttttcccaaacagcagatgatacagacttccagaaatcctgtgtcacttctttggtgactgaatatcacttgtttaaggccctttgcctccatgatacatctcttcaccaaataccacactgccactatgcttccagcagcagagtcaaaacagaatctttctccaaatcaagcacagaaaaatgaaaccatcagtttggatttgctcagaaatagttaggaactctagggaggagtgcaagcatgaagtttcttctctccctctccttggggcctctatagaacaatatttttcagcacataaaggcagagaaagaagtgctgcctccatgacttctgaaataaaagcaagtgaaactccaccatggagtaggactaaaatcctgtaactaaagtaaactaaaaactcagtgtaatgaggttagctctagagtggaattcagtcaaagacagatccacctctaacctcatcaaagcagtttttgttactgaaaagtattgttaaacacacatacacacatgtacccctatcatacagaaggtatgggcacggaaatcaacatcctgattggatccagcataggaatatataataaattcattttgatgaatgtctctgatgcagagtggcaacaataagaattttcaaaatgccctaaagttctccctgcagcttgcacacccaactgatagccctacatcaattttaccatctacatttagcatacacatcaacactggtccacagttcagcaaacccagactttaagccccaaaggacagggatcctgctaacaccaacttcgggagaagtttctgcgtttcttcctaatttaaatatgtgcctctgtggtgtatgagtaaagctggttggggttggatcagctgggagatcacagaagcatataaacagcattggctattttaagtgaaaccattttaatagacagctggtttagggcccagacaatgaaacaccaagaagaaggcttattttcatcctccatagtaaatcatgagtctgctcactatgaggaaggttgtctgttgtgagagggacaaagacaacactggtttaaataaatcaatgtgtttatctgaagtgaagatgggatgcctgctatatagatgggtgggagggggagaaaaatcatataaaatatattatttaagtaaatcaattgatagtgaatcaagttgaggtttgtaacctaagaatcaaaaatgcaatatcaagtagaaaacaatgtttaaattaatcctgccaatggcaaataaatcccttaaggtgacaggaatgcttgtataagaggaagagttaaatagtaaacaacattaacctcatctcaactttaaaaacctggtgaaattgacaaacaagctgtcaaaagtggatatatttggaacagatttatttttgtgatatactagcctaccttttctgctgtcatactctaatgagtagaaagaaaatatctcatattattttttgatactctcttcacttcagattaaggggcttttaaaggatatttaaaataattaactaaaagaagaagaaaacatcgaaattgttaaacttgcatattcttatgcaaaaacatctctggaaatttcactgttatgaataaaatatcatcaattctaaacgctcaattataaagtaacctgtaatatctttgaaaatcaaccaatcaatcaatatacaaaaacctgcctgagttgccactgttttgaaagacatactgtgaagcgtagttcattctagcttttcttaaatactgctaggtcttaaaagttaattgaaacttactatgggtaaagaccacacagtaaaatgaaaaaatacacagtgaatgtacaccgggatcacacttcaataggatgccaaaggaaatacagagaattgaacatggtttttctgtgtttacttttctaatagttttaactctttgtgttccacgacaaaataaaggcggtgaagagaatacttttgactttggttcagcaaaatccaaaggatttttagaaacaaaatattttcattaggaacctttcttgatttataagcaaacaaaaggaaacttatcatcattagttgaagaagaggaagaggaaaaagaaaaaagaaaagaagaaagaaagaaagaaggaaagaaagaaagaagaaaagaaaagaaaaaggaagaaaggaaaggaaggaaaagaaattaagaaaaagagaggaaggtaggaagaaaggattggagggagggaaaagaaaggttatcagtaactaacaaagacttctaattttctatttaaatcaaaactgtaccttgaaaatatgttactcctttttccccttacaaaataaaaagccaaacctactttgtcacctaagagaataagttcatgaatgcacaaagtacctgctgtaaccaaaagtgaaatgtcttctgaatgcaaactgtcaacaagcctttggcagcaaattaccaagaattgagctaatcaaaaaatgatatgcacacctacaatatcaacacactataataataatcattacattcaaccaccaatttctactgtttgtcattaaaaaaaaaagaaagaaaaaaaaaaaggtgctagctaatctggtcttagaaatttccagtaggtgaaggcacactagttaaaaattaaaccatgccaaaggaaacactacaaatctgacatttcataaacaacgtgtcaaacagcaatccaacattagtagtggaataaaataaaaaaataattttgcttcaattagcagcttggctactggtgaacaaattacaaagatgtaatttcagctcagcagctaagcaggcccgttttcagaagtgaattaggaaagttgcgaaggaatgatatcagattcagtgtgctgttcagttacatcacagccctgaataaaaagagaatgtgtaccaaaagcagttagctttagaatgcatcttttatgtctcaaagagctaaaaccccttatattattcaaacaccataaaaaactaaatcactctaacaatcccatattgtatttctttttctagcacaaataaaagatatttcactcctatggtaactacatttacacctacattagtaaatacaattggctttgtcaacccaatggggtaataataataataataataataataaaagcatctaatttattaagcacttaatttgtaccagtcgctgttctaagttcttaacatgtatgaagttatttaattctcacaacggagcttcaaggtaggtgctaacattatttccattagtctgattccaaacattgatgtattttaattgctcactaaaaccagatcattcttgctcaacaactatgtagacaattcaccaatgtccaaacactccttcatcgctctcagcaatataagacagagagaacagactatctgtacagtcatatgagttcaataaatgcatctctactaatatgttcgtttttaatgctgttcaaacattcacatggaaacagctctagcgtaaatatccccgaacaaatggctgtatattatccaggagggagcagttggcccgccagactggggaagtactaggccatctggctccggcaatctctccaaaaccatcagctttgttttcacccccagactccaaacaacacattttccactgtgatgagtttacattttcccaaacacaggtcctgatcatgcataaaaattccaaacttcttcattcctctatgtgcaaggaaatttaaatcacctgcatttttgacatgttaccaaaggagagagaaagctgctgaaatatggcctctgactataaacttgctgtgtccttttttgtttgtttatttccccaaatatatgaaagaaactctctgctggcctagtgaattccttgggaacttattgatatactgaaaatgtgtttatctaccaatgaagaaccatgaactgaaagggttgttaatcaaatctatgtagccatggcaggatataatgaaacaatcaataggaaaaaaatacacttgcatcaataccttaaagtacggggaagatcaaaacaaatatatcaagaagtctagctgggaagagaaacctgatagcatttctgatgattgtaccttggaccccccactgtcctgggaaccttttcacggtctcctcactacatcatctactttcaaatccatacatacaaggattatgtgactacgatttcctgcttctcaagcaggcttttgtttaggggaagagtgttttgttttgataacttaatacaatttggtatcttttctttgaattataaaatatcactcttttaaagcaagatggtaagaggggagataagctaaacttaaaaaaaactatttaaagatatataactcactatagcaatcacagaatgtaatcatatttcaaatactacatgaaaatctgaaaggatgcccactaaacctcagacctcccccactggattcatttgagcttctgcagtagatattgtttctggatgcagcagccataaacttctgggtcctacagggcattctgcatgctcactaatggaataccaaaaacagtaatgacacgaaaacaaactatttttagtccagctaaacttggttttgaacaacccttcccaaaagcaagcctcttattttctagttggtgggtgaatttttaaaatattatatcctgtgtgctttacaatgaaggcatagggataagggatctcagattcttatatattcatttctaatgaagcttcatctttcctggtagagtccaaaaattaagagtcattacccaaaatagtctaatgagacactttgaaaaggtgtgaaatactgtgtcataccaacacatcttggttgattgagtacatttcttttctatctcaatgctgctaatcccacccaagatcaagaacagtttatggaaatgtagaatgcaaaaatagttttaaattttgcttgtccaaaattccttttgagttttaaccccactttctagtcaagaatatgacatcactcacataaagctgcatctctgataggaaaaatgttataataaacaggcagctaagaaaagacacttgaacagtggctaggtattccttccacaattgatgatgttatcagaacttatcagaccagaagtgtttcattctgtactctaaataattatcaaaatccataatgtatgaggaagaatttcacaggaaaaaaaaatgtaatcatttaatccatcagtttatatcaagacttacatctgatttaaggagccactgtatattaaactaaaatcaaagattcaagaaattttaaatcagacttggtatttaattatgatagaataatttcaagctagaggaaaattaactgttttactcattaaggctaaatatcaattatttttatgtcacacctagggaaagttaagcttcttcacgctcatctatctgctttttggaggccattgtattaaccctgtagacaagaagctaacctacttccaaaactcttgcagcacataatcaaagaacaagcaattggataatgagtaggaactgcctttcaaagtgaaagctacagagaggtggttaaacaattattatgaaagcacacaggtaagctttgaaatattccttttcctgatattttttagacttagataattattcaaccttttctcaggccactccccaccaaaatatatcattgcatgcatttataattttgacttttactgagatgtcatattatggcaaatgactttctcataagtgctattatcgaaaataaaactaatcttgttcttattcctctctctctctttctctctctcttcctccctctttcctgatagaatttatgacaccaagtggtcaaagaatgccttaagctgcagtttttcttaagctctatgaccttgttagtaaaatgatatttgatgtattgctttaaaaatatcaaaagatgattctcccccatttttatatgagtataaggtaagttcatcccataatgggaaaatcaattagtagtggcactttttgactagagagacttaaaataaaattttgaggaggtttaattcatagagcgattaatcacttcaaacatgtcttaattctgtgcttcttacaattgttcatttcatagtgctacctataatttaatatttcattggtcaatgttgcacaagcagacaggccttatgtactgatttgtgtatgtgtgccttttatcttttagaaagtaaatcctaataaatacacatagagtatgtcttagagttcctactttccccctctccctcccaacttttttttttttttttttcctgtaatgagaatggcaggaaaggatatccagggtatcaaaggcaatttttgaaaacaaaactccacttaagacatttttattttgacatcgcaaaagaaaaaaagttattaaaaatcaggcttttgtgtttctgccttggaaggcaaaaaaaaaaaaaaaaaaaaaaaaaaaaacacagtgtccaaatgaaagtgaattatcctatgcaattattaaatccattaaagaaaataaaaccaagaccaaaaattataaatggtgatttactctgagcaatcaactgagaaataaacagatttttaagaaagccaaatattttaggcaaataacatgaaatatatttcaatctttatttttattttaaaaaatagatttcatactcttgctttctacttgtgtcatatcgaaatatgaaagtgatcatcaaaaatagctgttaataaattggttcttgaagattagatttttaaaatgcccaacagcttattaatgtgacatttctaccacatatttaagccgtggtgtatctaaaaataatttttaaatatgcatatataccctaatttgaaactttctcagccaatatctatgaaagaaaatcatttctcttattttaaaggaaacattctaaaatcacaatcaagtaaataaattttaatcctcttgctaaattgctggttagtacacaatggataacttttttctttgttctaatttctttcccccacccaataaagctgtcttcttttttctgctactaactcctccaactacctaaccagctacttaattctgaaactaaactttttcttaaaattaagaagaaggggaaaaagctcctgtgcctcattaaaacgtcaggcctcttttctgactcggctcataattgtatcttttaaaccataactcaaccttaatgtatactgcttgacacccgcgtgttgggagcttaagaaaatgccgtctatgtacctttaagaccacaagctcactcatgctgcctggcttcctgccaaacttggaggcaaaagcaggagggtttttgcaaaatatcctctaacaattgtcgctccctctttcaacactaccttcaccatcattccctttgaaaacaaatctgcagaatggtcatctgcgctctcagcccatctcatcattcctggggaagccgcctctgccacccctcctccgccccctcagcccctcgcccctctgcttcccggggaggcctggcttgcttgggtttcaaaggttcagcccactccgcaccagggtccctgggcacctttgagcccttcggggctccctggccgggtcagaggaaattcagccctttttctcgccactcagcaccctgcagtcttaattcacaaggcccgagttcccttggagggacgcgcgcgcgtcgagccctcatccccacgcggcggtgcaagcgcatgaatggacactggaaggccgtgcaagtttggtctgagccgcccccgctggcttttagagttagagtcccagcccacctgcggtggagcaactagcttcttgactgccctgaattttgtgacatagagccccccgtggcccaaaatcaagaaacttacttgttttgtcatggagtcaatgaggcgcacgtagaaatcctgctccgtccttatccctagggttggaaatgggggaagggaggagaattaagtgagaggttacggagggtgggtggacaataattaacaacaacaaaaaataacaacaaaacccccacacacatatcacgaaaggggctccaaggctgattggaactcccactgtcctggaaaatacagccacgatctcccttccccagtgtccagagaggtgctgctggccttgccttagcgctcctggaagccagacgccaagttctgcagctgggactgggatgggggtaccccgacttgtctgttctcacggcaagagtccctctgctctcgcacacagccttcaaggccatgacccttcagcccctaagcccaaggggccatgggcctgcagcctgggccaagccaaaggaacaggcctcaggaaggggaggaagaatgaaagtggctcagggagggatgaggcactacacctggccccaggtaaacgcgagaccgataaggctcttgggccactaggagcctcctcaggtgaaacctcctggggcgaaatttaggagaggctggttcacctcaaataaagcggatgactgaccttcgctggaggatttcgtccacctggagctccctgcgccccctgcccagacccggagccccagggtgaggccatagacccgacccgggcctcaccattgctgtagagaagctgaagccggtagtgaattccgttattggtcttttcgctgttggcttcctgggttgcatcaggacgcaaagacacaagagatgcaggagagaggtctgcgtgagcgagtggaccaactttcgaggcaactttccccaagccgggacccccgctggcgagccaggcagccacggtagcagcagaaattgtggccaattgtgatccctcctccgccccctgttcctgactgctccctctctcccaaaagaaaattccgtcgggcgcacacaggctatcctctttccagggcctaggggctcgtgccccggccaccagaggcaggcggtgcgtaatctggtagtggagggcgggttcattccgggtgcccatggctgtggattgtagagccaggcttgcctctctctagctctgggggctccgtgcgaacttttctggagaaggagccagtggaccaggaccctgggttcgtctgggatgggaagtggcttgggggacccccacatagaagtgtgttatggatgctttgcactcaaggaagggcgcgctgcccaaggctcccgggcctgctcccgagccgagccggggacgaggggcgacagcgctgcgcccacttactttttccttctccacgaaccccacaaacgctgtcctctcgatctccacgggctggccctgtctgtcgtagagggccaggacgaagtggaagaagttggatttccgcagattggaaggcggctgcttctcaaagtgagcccgggccagacccaccccgctgcggccaaagacgcagagttagatggctaaaccggacgccgacccgcgccccttgtcaccctgtacacacactcgaaccctcaaacacccacctcctcttcccccaaaacatccagtgggcgctcttcacgccccttcaggcgacatagacccagctgacaacgggacacacatgtcccctcatgtcctcgtcctctccgccaaggacgggtgcgtcctcagaactcgctgaagaggtgtgaaagttttgtttgggttttgcgcgcgagatgaaactctataagcatttactcctacctgacacgcactgcgtggggaggaagaaaagtggcggtggatgaagtgaacccaccttcgcggagtagaacccacagttatattccggcacccctcgaatctcacgtctcagctagcagggcaggtgggaatggatggaaaacatgctcggcgtctcgccgcagcagccaccctccaggaacccctcaagctctggccaactgcgagtgcccggccttgggaagccacatccccccaccaccaaaaagcatgtggagaagggtccgagggcggggctcagaactgtcgcgggtggtcgctgtgaaaaagggaagaggggtgttttcttaaagacctgtcctaacaaagtttcgctgttccgcagaaatcctcacactcattccagaaatcctaaaggccagggctgctggctcagtgcgccggccggcgatgggaggctggagcgcctggggcgccaggcggccactgacagccggacctgcccaacacaagcgcgcacaggcacacacacacacatagaagaacacacacgagcgccccgcgcacacactttcacttccagcccagttacccaattcactctcactaccacccacccccatcctaatactcagtggggatgggaacagtgttggggacacttgtccccagcccagggaagctggagatgatgtaattagtcatcttccttcttccccttccgcactctgagtccgatagggcctggggccaccagatctcccactgtcccaagctcagctggtggcttaatggggggaaaaaggccatttctcacttgggaccaggagcctgggaaagagccttgggtgtgcccaggaaagttccctcaggtcaacctccaagggcaatgcctccaggccacacagtctagtgtctagggagctgcgagtgagagaagggctggaaggggccatggtgacaggggctggagaagacttttgggagatatcagaattaaagttgggagttgctattctaccggtagactaagaaaaaactgaaagacagagagggagggaaggagaacgagatagcagaaataagagaagactcaggggagaaatgggacgaaaaaacaggaaagccagagaggtaaggaaaggagaaagaggagaaaggagggaagctgaagaaagaagagaaagaaaatggagagaggaagggaggaaggaaaagagtgagggagaaattaagggaaggtgggggaaagaaatgagagaaggaaatgaaagaaagaagaaagaaaagaaggcaggaagagagacaggaaagaacgaagaacgaaagaaatggaaggagggaagaggggaagaaaggaagaggaaggagaagagaagaaaataaaggggggagaaaggaaagaaggaagaaagaaaaaagaaaggcaggaagaggaaagagaaagaaaaaggaaaaagaaaaggaggaaagaaaaaaagaaagaaaaagaaaaaagaaagaaaaaggaaggaaggaagagaaagaaagaaagaaaaaagaaaagagggaaaggaagagcgaagggaaagaagaaaagagagccggccggaaaagaaagagcaatcacataaaaacataaaacacagatctccaacatgctgtgttgagacgcctcttctgggttaaaacaaaatgaaaacagtcacagacgaggcaggggaaagtgctggcaaagcgtgggctcctcgcagacagctccaggtcctccggccgcaggcgacgaaggcagagcggctggagagcgcggagccccggcggagagcggagcgcagcggctgcggactcaccccgccgcccggccccgcggcagcagctgccgctgccgctgccgcctccgcctcccggctctcccgctcgcggctcacctcggccgcggtccccgcgcagtacccacctctgcgccgccgtgttggcgtccagcaccccggcgccctgcatccacgtccgcaccgcgttcatgccgctgcccagcggctcttccttcatgctgcttccactccgttggatgctttcctgaatcccaaacatgaaaacaaccttttcttgtggaaaatctcctcccccttgaaaaaaattaaaaaaaaaaaaaaaggaaagaaaagaaagaaaagaaaagaaacaaaaacgccaaccagagatttttttttttctcagacgatgaactcgcacttagaagatcaaggcgggctggaaagcaaatttttaaaaaatgtaaacctctgctcaaaactgagcgataacccgaaaaaaagaagaaagggaaaatccaacgaaaagaccaaaataataaaattagagatgtatgcttggctgttgggggttgtttggtt

SEQ ID NO: 2481 - DNA, 100079 bp, Homo sapiens
  source 1..100079: mol_type = genomic DNA
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttggcaggctgcattcagaaggtctctcagttgaagaaagagcttggaggacaacagcacaacaggagagtaaaagatgccccagggctgaggcctccgctcaggcagccgcatctggggtcaatcatactcaccttgcccgggccatgctccagcaaaatcaagctgttttcttttgaaagttcaaactcatcaagattatgctgctcactcttatcattctgttgccagtagtttcaaaatttagttttgttagtctctcagcaccgcagcactggagctgtcctgaaggtactctcgcaggaaatgggaattctacttgtgtgggtaagtactccaatgaaaaggtgctccaggtctccgggaaactgcccccacatccctgttggttcaatctggtatacttgggcatttaacaaagtttgtctttgggtatgtatagttgcttaatttttgttttctgatgcatgtttattttcttactggccattagagctaatctgctaccaactataaaacttcataactctcaaactgtacttctgtgtataagtgaatgaatatgcctcattttaaactagcagaacatttcatggaagcttcagcttttactctgacaagaggagtaattaacacctggctaattgcttggaaattagggaaacagatggttgattttttgtttgtctgtttgaaactcttaagccacaaagaaaaaaatccttccttctgataacttgtaagaattcagaagttctaaaaattagtgaaaaatggaaagggaactgtgaacaaaggtagttgtgaaaattaacctaaatttcaatttcaacctccttcactttctccccactcttactgtttctgaggctctgacacaactccggagttttagtaacaggtgcattgcaactttaagaactgccaaatatgataatgggtaaataagccacactgtcctctcatattaaatgaattttttgccaaggggaaatgggagcttgactgaatgcgaattacaatcctgccaaaggatattgcctgaaaaacattctctctctaactgttaattcatttatttaatccttgggtgagcctccaacctgctgcttagacacggcagccgcctttgttgatgagaggttatagctgccccgacattccatttttatcagcttgcccttttgagatggcgtctggcttttaaaaagaggtagattgagggggaaaacacagtacagtttccagaagagacacctatggaagacagtacacaataggcaatagtttgaataaagagagcagaatggagccaaactgccaaagctaggctgctgtcctggctctcccattaaggaagttcccgatgaggaaatcaggtgcttttgctcagaatctctggactctgttctcaggtagcactccttgtaacaggtgagcagaactctagggtatttgaaataaagacttaatcctagtgatctctatgttcccagcacctaggacattcctgcttccacagtgtgtactcagcaaattcttgtgtatgaatgaggcgtctttctctgatctgctaatgacatagtcctagagaacagcaacaaaaagagggtgacaaatgacaaaaatggccccatgaacctcagactcagctgttggagacagaagtaaaacttctgtatacagttatgtcaaatggactggactctctttggggtgggagaattttccgtggagtagttggcaaatatctagagttgggcactgtcatttgcatgggatgtgaggggtgatggttgggccgatctatcaggcagccagaagctaggaaagaagaacccaggttgctgaagcagaacccaagaaattacaaaaatgagcttttatggatggctctaggatctcagaatagtctgattcctgctggcaagcaagtctatgccttgttttccttgccacctctggtggctcagaagtgccttcattgaggtaggttgtacccaataaacatgaaacccaggatagaaacaataagttggggagactgtgtcacagagtggaaggaaccacaggttttagaaacaaacaagcctcatttcatatccatgctaccaacttaatagctgagttactttagagtatctctgggaaataataccctcgcccactgcttttaggatttttttgtggggaatcacatgagataacctagcatgtaccaaagcatggtgcttagcagagtatgctcaataaatgtcctcctgggctccacgtcttggctaaatctctgatcaagtcatacgatgagatgccgtatttgaacagtgcagtgacacggcacagatccatggagtgtggaatgtgtggatggcactttgggattccctgcctctctgctacctcatttcttgcaagtcactggtttaaatcccgtactttacgctcctggtctcatgttagctgataactgcctgggtcaccctttgtcagtcactgtgtgcatttcagaggatagtatttctttctcctctctaaatagatatggtgccatcatctatttttccctcatttaaattctacttgccttatttcttgcccttggcattgagacagatcacctctgcagccacctgacccagcaggaagaatgctttatggtctaacagtattcaggtaaacttatgcaagattgttactcatgtgactgctagccggataaaccaagtgatagcaacacaattaggtttctttctattcccctccctctccctccttttaactgagtattctgttagcgtctacttgagctacagcaggtgaggacagcaggaaagaaaactgctggcaagtggtttctgaaccttcaagtctatttaccctggaggacaaataacagttgaaaaagaaattgttcctgtttggcttctgtacctgcattatttatatgaacttttttggtaataaagggtaaggaagaagtacagcctcccagctgcgggagggatcctggggtggcactaagttatcacttttagtagtaaacagtgaaatcagtgatttcagtaccggctaaggcgtggtcagcatcccagtcatgtgcaaaccagagtaattctgagaccagaagcttgtctgttttttcagccagggttatgcgattttttttctttttttctaacagcagtgaaactaacctccaaatattcagtggtgtttggtcattgagcttagtggtaaagaagcataaattttggagacagatttcttgcctggattcaaatcccatttctgctgcttgtgaactgtttgtctcattttccttaccctaaaatgaagataattgtaccctcttccgaggactcttgtcagtattgcgttaatgtattcattttcagtgctggctgtgcattagaatcactaatgtctgggtggccaccccgggcagtctggatcagagtctcttctgggagtggaatctaggccttatttttttttaatgtggtgattctaaccaacagcctgggttagaaccactgagttaatatatgtaaagtgcacaaaacagagcttggcatacaataaacactcgataagcccgagattctattaatgttttgttgttttaaaaattatttttatgaatgtaatggtattttctaaatgtggcttggtttcgcctataatcatcgaacattttttatacatgacaaaatgccatagtgaaaaacccaataatagttctacaacattaaaaattatagtcaaaataatttaaaaatacataactcatatttttgtaatcagaagaaatgtttattaaaaatacaagaacatgtcaacttgatttgagtaagtacctttgtgaaactgtggctctggtgtttgtctttttcttataccaactgataaaaaatttcattcattgcaaattaactctgttcgtcgggtttcttaccggtaataatcttattttaacagcagcaaaaacaagccacttgaaagtgatagcgattatttcagttttttgcatatttttgcccatgtgtggaacccttcccttgtggatttttaaagctattaaaagcatataaaaatggtaaattagttttctcagttaatttacattttggggctaatttgagcttgtcaaaatatttgacattcaatttagaagttgcttgtgttcatggtagagcaagtaattgattgtttctatcaaaagtaaacagactaataatttggctcaagcaaattaaaaaccttactttataatttacaaatctgcctttatgaaaatccatttcaaattattccttgggtagtatggttggttggaggttttttagcttttagtttttgtcttttttttttaatttcaatttttactttacattcaggtgtacatgtggaggtttgttacaaggggatattgtgtgatggtgaggtttgggcttctattgatcccatgtgatcagttggttttttatttttatttttattttttgagacaggttttgctctgtcgcccaggctggagtacagtggcatgatcttggctcactgcaacctccgcctcccaggttcaagcaattctcctgtctcagcctcctgagtagttgggattacaggcatatgccaccacacctgctaatttttgtatttttagtagagatggggtttcatcatgttggccaggctggtctcgaactcctgacctcaagtgatcagcccacctcagcctcccaaagtgctgggattacaggcatgagccaccacgactggcctcagttggtttattaaatcagtactctccagactccgttccatcagtaaaataattaaaatgtaagcatatgcttctaataaacacatttacttatcaattacatacatgtaatatgtacactgtacacatgaacatgtgtatgtaatgaacattacacaacaaataacgtatctaatattttctttctacacaatagcaaaccatcttacatagcctctatgtgatatacaccctccttggaagatagttttagaaaataagtgaaatggtagaataaacgtttaccttttcttcactataagctctgttcctttctcttgattgctaggtgtggttttttttttttttttaaatttcaagtaaaggtgggttattcatagcgaatgacttttctcagagtgtgtaatggtagaaacagaaatgcgtgtggttgtgctgagattcttccggaaggagtggaaggccagatgatgttcctgagggggacctggagtttgagaaatgcccaagtcctgtggcttgctgggctcagcatctatttaaattaaagtgacctgcacctctatcatatgttccaggaaacccaatgtctctctcctctgtcttggaagatgctggaggtgggggctgtgatgaggaaggcaaggctatgtgtcccttctgggcctcctactgaatgattcatctactgtgtgtctcactgccctcatgtactgtccctttcccatacttcaccacctcacaccagccaccaccctgtctcacttacttcttgaaagaacgaggaaacaattgttatgagctgtgaggggacagactttacctgaaggtttgctgttgggagggttggggcaagggcaggggctgcttacatcccagcgcttccaacaacaaagtaaaacatttttcattcctgttcctaaaagtgacacaaggtcatctgtggaagggacttgccagacatctctttttcttgggccttagtcttccaccacatgagcgaaaccctctttctcccacagtgatactgacctgcaccttggccgctttcctgggcctccttaatctacttcagaccatccatatccttctgcagaacattttagatttcttcttcctccaattttgcttttctgatcatatccgagacttgcctttttaaatgaaaataacttcaaaaactattaaatagtgagctgatgtgttttgctaaacaaaaacagttgtgtactcctttgagaatttctggctcctgatttcaaagtaatcatttttcttttccttctacaatgggagatgttaattttgagacagaagtgaagattcttgtaggcagtcccaggtattaggaatgcatgcttctctgtctctctctctctctctctctctctctctctctctctctctctctctctctctcatctctctctctctctcatctctctctccctctgtctgtatctctctctgtcctgtattctgagtctgggaagggactactgcactttggggctggggagtgcctttactttggcttgatggacataagtcataagtaaggcagggcactgacttgaaaagagactttaacaggtctggtcatggccagtgattgtgagttatactataggttgtcctcctcccctctccacaattcttaaagaggacttcagtaaaagttagacattgatctcacttgtgctcaggtgaaatggtacatgagtgacaggtaggggggaactacttccaggagcactgtggcctcacattggtgtggccagagatcaaggagatcagaggagagctcttgatggggtaaggatgagagaggtaggccccggaatctctcagaaaggtctaggatggaaagattttaaagaaggctaatttccagcaatttgcttgtggtggcatggtccaaaaaatttcactataaaaaagaaatgtgcccttatttagtagttactgactggacaggtcaagtgtaaacgatacacatctgtaaatagagaagtatgctcagaatattccctagtcagtcagtggtctgctattgggagcatcaaatagtttggcttgtgaatcagtacaatgtcttttatttttatcgttgatgcataggtttcatttaacaaattcatatagatgaatttataagttgttttttaatccatacagagttaaaaagtcaaacattgaacctcagatgaaaggtaacaaagatttcttacctggaaaataagtcttctaaaatctgttcgaagtccttaaactttttgtcactttgattacaatagaggaaactcggagaacctagcaactttccaatgtaaattgcctgatctaagctattttagcaattattgtacagaagtagtttttataaacttattgcaaacaaaacaattaaagactcaataactatcctcaatagctggaaatgactgcattggagagcgttttcaaaatagtcagtttttaagaaacaaatcactttatctcactggtgtggccagaggtcgaggagaacaggggagagcacttgatggggcgaggagaagagaggcaggccctggaatctctcagaaaggtctaggtcagttttaaagaaagaaatcacgttcttttaaaggattcctaaatctttttcaagaaattttaaattccaggaagcagtttagtgcttagtttaattattactccaaatttgggccatcctagagctagtaaacaaaatattagtcttattatgttatagtttctcatgtgagaattagaattaactttaagaaagaaccagaaacaacaacagcaactacagagatcctgaccattggaatgtaattgtccccattgtctatttacttcttgcctacaggccagcgctttcctccagaatgctaatattgttcaccatgaaggaagtattgcctagatattaggtgaactaagaactagattcactttgtagagattctttattaccactgaggtggttgtgcacacggccatcccaggcccttcccagatgtcctgtttgctggggctcatgacaagatgactgagagtcaggtctggaaggatgaatactattattgccaggtgtagacgaagaaaaaatttcactgaacagaagggatctttacacttcttgaaagatcttactatctctgaaaatgttttactctcttgttttatatggccaaagttaataacttccaaaggcaattgtggaataatgcttgtcaatatgtctttctttaggagatgttctatttcttaagagcatcttccagagctttcttctcaattctgggaattagcaaatgtatagaaacttcagttgttttagccaaatacaaggcagaaacttctactctcatcacctgttgacctccttgctaagtctggaatctgaattggtgtgagcatctgtttttttttttattctgacttgattttctgattctcccaagttgaccaaacatactaatgcctctcactgtctgggtttcccaagtatttcccaggacattcagtacactggaatttgtgtgtgtgtgtgaaggtatttgagagccagccaactgctgtgacagtgattcatggtaggcactaatttatttgcaaagcttcttcccagtgatgtaagagtccttttggagaaaagcactgcctccttcctccattcagactaacttcccagggtgctatggaccagctttgtgtgcagtaagggaattacatccatgaggtggttctttctgtgggtaggtggttgctaggatacagatagtcacaacagcatcacggcagctgccttgttcttcagcacatggtgtatcagttgagaaatagtgttttatttcattcactccaacacttttctggttaaaattttaaaagcttgaaggaggatctttctttttcacacacaccattcttgtataaacaggtcaaaaacagattagtcaaactgaacattgtcataatacatgccggttgacaccaatcctctgctcttccagcccaggccttcccttacgaggtttaaaaacatgctgaagggttgaagctaccaagggtcttctggtgtttttctcccttcctctgaagtgcataattattctgtttactggaagattttcaacacaaaggaaattaacttctccttggtgtgcaaggaaattgcaaaggttattgtcattaatgttaatttacccactatatcttttagattcaagcaacattgtttagaatggtcaatgctctaagtggatcaaaaggcttattattttttggaagacaaatttgaaaaacctgctggaacttttatctctcctggttactctaatgaatcatggcaaagatttcatgtaagtgggaaaaaatgaggtatttgaagaaaaatgttcatctaggatttcaatccattaaaaagcacacaatcatggacacctacctacaagaggataagtgactgtctttcaatactgacatgttgtcttctgagacaggagctaatagaaatatatagcgcatgacatcctctttaacatgagctatgttgacacatatgaagttactgggtttattacttccaagagaggcagtgccattttcaaacaaaggatacattttaagcagagtgaattctggttggttctttatacagtgggttgatcttgtcacacaggcaaaaatggagcagttttgggcagatggttctagtgttacgcttgcttgttgccttactttgcaagaagaagttctctcatctttggtcaacgccctatgtctggcatgtcatgttaggcctcagcttttgaaattgatagggtctaattctggagctgatataagctgttaatacctacctcttagattgctatgagtactaaatggattaattcttgtaaaatgcttagaatcttagctgacgcagtgagttatcagcaaatattggctattactctctaccaaaaaccataaatgagacatattagaaacattttctataatttttataatacctgtttcttcaaattttcaacaatgcttagagaagtcggtttcctgggatgagctaagtcctaaaaactatcttaaccagcaggttctttgtgatttttaaaaattatcctttttattatcctaacatgtgacaaaactccccattaattattttttttaaatagttaatcttgctatttgttacatatgtcttcaagagaattatataaaatattttttatgtatatttatatagctgtacctataggtatatatgtatataggtaaggcccagaacttaatgaccagtgtaggattaatgagaacagtgaaactgggctcaggaaatagcaatacgccaacacttcttaattttacctcatttttgtctatttgtctagaacactcaggatatagtatctataggcaaatatttatgtgtttatccttgcaatttgagaaactaaatttaaagctggttaaaaaagagagaagataattgtattcagtataaatgagacttacaccaaattttgtacctccaataaatttgttatagatttaatcagtagattaatttttagaattcctttagaaagttgagtgtttagtgtcacttagggggaagttatttaagttattgttttacttcatttagtaggactcatgatgacatattttaaaattatttttattattttttgagacagggtctcactcttgtcacccaggctggagggcaatggcacaatcaaagcacactgcagccttgacttcctgagctcaggtgatgcttccacatcagcttcctaagtagctggaactacaggtgtacgccagcacacccaactagtttctgtatttttagtagagacaggatttcgccatgttgcccaggctggtcttgaactcctgggcccaagagagccacccaccttggcctcccaaagtgctgggattataggtgtgagccaccacgcctggcctatgacactttattgatttcatatttgaagttccaagaaacaaagaaggaaacaattcacagaaagtagaggttaaggtgaataatatttatgtaggaatttactacaagtttaagcctccttgccaaagtgccacaaaaaagaaagttattgaattttttagtgcatatagaatatgaattaaattgataaatgtcagattacgaaggaccttcaagatcatttagcccaactgcttcttattatggatgagaggctgagatctagacagatgaagtagcttctcaggtcctatgagaatatagctcaggaccctagactcttattctgtgaaatttacaatgcacatgacacctcccaagactgattgttgaaagtccatcaatgtaatgattttattagttctttctaccaaaaaaaattaatagttttaagtcggtttaggaaaacttccttaatatatctagttctctatgttgaaagcactttgaaagtaggattgaataaatgaaatttccttttatataaattacatccatgaattaactcaaatcaagtcagcaagtatttattggatgctaggtgcttgggctgacagtggagacatcactgatccacatacacagggattcctgacagggcaatggggctccagagctcagtcagcagtttacctgatgacttacagatcctcttatttggttttatcaaaactaacccttacaaaattcaacaagtggctcagacgccttcctacaaagaaactaaagattgcagacaacactaatattgcaaacctaagagaataatgaggaaagggcagtcttgacacctttcttattcctaggatgagctttttgttggctacgtaagagctgaaagcaacgtaaatctccatagatctgaccaaaaaaagttaaaaagagaaattaacaagaagacagcctgaaaaatggatttacaattgttattattagcgacgaacctcacaaaaactgtaaagtgtacctgggaagatgttagctagtggtaacatgaagccatcaggacaagcaagatatttgtaaatgagtatccaggatctgaaaatgattttttataatttttacagttgtgttcaaagttatgatagttaagaagactctatttactaagcttaatgaaaaaagtcagaagcctctcttgaggtttcttacattacggcaaaagaggaaaagcctgatattattggtgaaacacttgttcttcctgcttcctgttgtggtaaaatattgctaaaataatacatgaaaaaccacatgacaacaaattaaaatgtgttcctttgtaaacaaatactgctgaaaactgtacagaaagaatcaatgaaaatgtgatgaagtaagtactaagcaattatactgttgaatggaagtaaaggtgtttctaatatatcacagcgtatggttgttttctagaaagtaatagccaaaatttactgggaactcactatgtgtcagacaagattctaagcactttacatgaattactttacttattctttttaacaatctctgaggtaagtattactattattcccattttatttttgcagatgaagaaaccaagacacggagaggttaagtcatgtgctgaaggccacactgtcaatagtattggagccaataaagagtcaacatgagtactccgtctccaatgccagtaatcttagccactatcataattacctcaacaatgaaatgctcagagaactgtaattcttttctatgagagagtaagggaaaaatgcaacagaaaagaaattttctcagtgaaagttctcagaagtcagaaatgacttttttatatatcagaaaatgttctatgaaaaaaatggtataagtgtattcagcagtggtacacccactgcatttactaggacatcaaccaaaaagcattcttggtgagatcacagagaacaccacagccttcacagcaagacgtgtggcaaagaagttgaaactggaattgcatcaagcattatggaacatcattgatgtagttattcctataaaacaagactagtctctttataatactttgtactggatggggagtaatcataaaaatctttgtcttacatacttcccacaaagtatcttgaagcaaagcacttaatagaacagtcaaatgtcacatgtcacaaaacgtcaaatgtcacaagcaggaggattgcttgaggccagagtttgtgaccagcctaggcaacataggagaccctatctctacaaataacttaaaaacttagctgggcatggtggtatgtgactgtagtcttggcttttcggaaggctgaggcgggaggatctcttgagcccaggagttcaaggctgcagtgagctaggattgtgctactgcactccagcctgggcaacagagtgagacactgtcttttttttttttttttttttccgagacggagtctctctctgtcgcccaagctggagtgcagtggcgcgatctcgtctcactgcaagctccacctctcgggttcacgccattctcctgcctcagcctcccgagtagctgggactacaggcgcccgccaccacacccggctaatttttttttgtatttttagtagagacggggtttcaccgagttagccaggatggtctcgatctcctgacctcgtggtccgcctgcctcggactcccaaagtgctgggattactggcgtgagccactgcactcggccgtgacaccgtctttaaaagaagaaaaagaaaaggacaagtgtttaacaatttttggctttttaaaaatttttgtgattacagatagatgtcagtagtatgctacccaaaaagtaactaaaacaacaaaactttatccaagttataggtgatgttttaacaagtgagaaagtgaccactaattataagaaatttgtgtaggaagagagcagtttgaagatagatgttggagatgtttccattgttatgtgattttattgttgaatcaatgccaatatgtcacctgttaaaaattcttgtgtctgcgcttttaaaacatttacaaacagctttctaagctattttaaaaaaatcttccaaatacagagtttttgtctttttaaatccacttgttaaaaacgtaaaatgcaataccttctggttagttttcatttactgtttaaaatctagaaagatagaaatttgctggtctaattcaacaaaatttgtgaataatcgagggatgtaattaaaaagtaaattttgtgattttgtaaatacagccaatgatgcatttatttcatctgatgtagacataattgtgaaaaattatttttgtttaaaaaagctgtcaaaaaccaaatatcaaaacatgttgatctttaaactagattttttatcaaattcaagcttttcagtaaatgcaaactaatcagaaggtgttatgtaatctcaatttttaacatgcggggggacttttgggactgtggggcattcctaactggagatgtccaccaaagacatgtccaggccgggcgcagtggctcatgcctgtaatcctagcactttgagaggccgaggcaggcggatcacgaggtcaggagattgagaccatcctggctaacacagtgaaaccccgtctctactaaaaacacaaaaaattagttgggcgtggtggcgggcgcttgtggtcccagctactcgggaggctgaggcaggagaatagcgcgaacccgggaggcagagtttgcagtgagaggagattgtgccactgcactccagcctgggcgacagagagagacaccgtctcaaaaaaaaaaaaaaaaaagacatgtccaaaagtagatgcaaaactcagtagacagatcaggatagtgatttctgaattttgccgtgtgtgtgtgtgtgtgtgtgtgtgtgtgtgtgtgtgtgtgtgaaacatttggaaaaacttttctaatgctttaatgttggtaaattcattttagtctagtaatggtagactttaaataaaattgagcataatttgtgttgaaaagctgaggggtgtttaaacttacttaaggtgaaggattacctatagcataggaacattataacggttcactgttctgcaaaactgaattattatgagttttaaaagttataatgagctgtagtattggataagggatagacacataaattaatagaacagaagagaaagttcagaaacggactcacacaagtacactcatttgatatttaacaaagatgttaaagcaatttaatggtgaaaggccagtctttttcaacaaagggtgttggaccaattagacatctataagcaaaataataaacatcaatcaatacatgcaagatatacattagtttgatcaggaaacgagggacaactcaaagagtagggtaaggtggggttaggttccaggtcacagaaagtttttcaaagattttctgattggcaattaattaaaagacttatcatctaaggacctggaatcagtagaaaggaatgtctgggttaagataaggggttgtggagaccaaggttttattatgcagatgaaacctccagacagcaggcttcagagctcttataagatctaaaaaggtgccagactcttagttaattctctcctgggtcgggggaaaggcctagaaatgaatggggattacctgcagaatgtagattttcccaacgagagacagctttgcaggaccatttcaaaacatgtcaaagaaatatattttgggataaaatattttgatttctttcagggtctgctatttgtcgtgtgatgctatactagagtcagtctggaatttggttgtcctattgctacaaaaagtctgttttgtcaatcttaagatctttcttttaatgttaatgctggtcagctgtgcctgaattccaacgggaggagggtgtaataaggcatgtcccaccctcacttcccatcatggcctgaactagtttttcaggttgactttgaaatgcccttggctgagaggaggggtctattcagttggttgggaggcttagaattttattttttgtttacaaatgcaatatattatagaagtagatataaaattattcaggtgatgtaattataggaatctatttaaagggacctgctttataattaattatggaagatggatgtagggaatccagccttatggtgaatatgcctagaacagtgtttcctggtgtgggttccttgacacaactgaactaaaacacactgaacaatttctagtacattcagataagcagtatagcttggtctttaaaagctagggtctgtgttgagaaaggcatagctttgtacccctaccccgctatttattggccttgtgacttgtggcaagttaactgcttgaaactttcctttcttcttctgtaaaatagagatgttgagagcatttacctcctagtgttctccaattgaatgaaataatgcattcaatatgctcccccagagataacacacaatatgttgactgtaattattctgatgaaattcaccacccaccctgttagagtgttagagtgtggaatagcacattaaagactgagaagtcctgttgaaaacaaaacgaaacaagtttcatgttgcagaacttgctagtctcaattaatatcctgaggacctggaaagtaagcctcttcagtttacatgtaaatgtggctgggggtaggtaggggctgttttctgctctggatgacacatttctatcactactctaggcaatcttcattcacaattttggtgaagcaaaatgagttccagagcatttttttaatggaattaagacttaaattcaaatctcctggctcttctttctgggtgcattatttttaaatcatctggcttctctctctcacttgacctgaattttgacatagatgaataaactgagaagaaagctgtgaaaagaaatttgtgcttgatatggttggctgtgtgtccccactcaaattccatcttgaattgtaatccccaggtgttgagggagagacctggtgggaagtgattggatcatgggggcggtttccccagtggtgttctcctaatagtgagtgagttctcacgagatctgatggttttataaggggcttcaccgctttgctgtctcttctcgctcctgccgcatgtggagaaggtgcttgcttccactttgccttccgccatgattgtaattttcctgaggcctcaccagctgtgtggagctgtcagtcaattaaacctctttcctttgtaagttacccagtcttgggtatttctttatagcagtgtgaaaatggactaatacagtgctcttttaagtaccgtaactgaagaggagatgagatagttttttggagtgaataaaacgttctgtacttcataaaacccaagctgtcatttaagtcagcacctggggagtagtaataaatgactcttcttaggggctttctgtgggagcagtgtgaggaggcctcagccttccttatgtaggtccattagtttagagccacattcttttctcatggtgtcactgaagtttttgaggtccagaagctccctttgcactctcttcatcttgtgagctttcagtctgtctctagatttagggcaagaaacctgtggtggtgagggcaggtggcaatgttcacctgatagacagctaggatttcttgttaatctggttgtggttatcatttatgtgttaactagctctcatgagtgtttgcccccaaggcctgcagaagacaggtaatgtctcttctcacttacctgtgtggggcactccctcagactcacagaggatgaaggggtgtgtgttataaaatgttctgtttctgcttcctacttcaagcaaagcttgcttttcatcactgacctctgtgttatgtagtcatagttctttgtagtcactgatgaacatcttcaatgtgctccaaacattctgaactcctttctaattcctgaagatcccctactaatccctaggttgagaagtcagaggttctaattgatttgctgtttgctgccttaaggtttgtgttccctagaaatgatgtttcattttgtatgtacttccccccttactgaactgcacccaaaacaaatgttgtaggttttgacatgggaaagctttagctgttcaaacatgcacaccttgctgacattcaaatccacagactgtaccacacatcagtgtttacagagttcttgacaggtctgaaaaaacattaccatatttatcatttccattggtagaacagaataatggcaaatgatatacatgtagtcctccataattaataaaatactttcacatctgtaattattattcacaaagcctaattctcaaagtgtttcattttctttaaaattatattttattacattcttacaaatatagcctgggctctggtttacataaaatgatgttgacagtgtaggaaaaataaacggtgctttgagggaatggaattacaattggctacgcaaagaaaatgaagattgtaatatcttgacatgtgacaacccagaccaaggcagggtggagttggaagtgtactagattgcgagtgcactagattgcgattgcagtacctggattctaattccaagtctaccacctactagtggtgggactttgggaaacatcattgaatttcctcttaattagatccatgttttcctggttcaccaagacctgagaatcacctggagtgcctggtcaaaaaaaagaaaaaagaaaaaagcatagccctcagcccagccctgctggattaactggaatctcaagagtagagtagggatctgcaaaaaataggaacattcactcacagagaggcaccctgggtgattattttaaacaaacaattttgggaaacaatttgaaaatgtcaagagtcttcctagttgctaggatctgtatgctatgattagcccttagatgggcaaaatctgaagataaaatgtattaattatttatactttgattttgtagttttataactactctatttttttgaaaagttacagaagttagtgctataatttgtgctttatgaatttacaaattcttgagatttctcttttccctttgacttattggtttattggttcatggtgttatgttgaggataaatgaggtcaggatgtaaaaatttgttattattattgctgttagtaagataactaccattgactagacccatcttttattaatttgatatatctgtttctatggctttgttctattagtaaaagcgcaaataaacagaacacaattatttcttcattagtttattgatttattcaaaatttttgagtgcctattatgtacagaggattgtactgcattatgtggtaaggaatattaaaatgtttaaagagccttttctttctctttttttttttttacatgaaaacctcccatttagtcatatatatatatatataaatttttttttttttttttgagacggagtctcgctctgttgcccaggctggagtgtagtggcatgatcttggctcactgcaagctccaccacccgggttcacaccattctcctgcctcagcctcccgagtatctgggactacaggcgctcgccaccatgcctggctaattttttgtatttttagtagagacggggtttcaccgtgttagccaggaaggtctcgatctcctgacctcatgatccgcctgcctgcctcggcctcccaaagtgctgggattacaggcatgagccaccgcgcctggcccaatattttttaataaataaaatattttattgatctcaccaatatgtcaatgcattaggaaattaacaatatatattggatacatttattcagcatagactatagagcatgcatgatacacatagcagagaactcttagaaataaatctagatgtccatggtaatctttgccccacgaattagtagctatgagtttaaggtgtctcttcctagtgtcttctttttctccatgatgaattgctgtattagagacaagttattagagacaagttataccaatgttccagtccctgggttcaaatccaagcagttgcacaacctatgtagtgaaaacttgtttctggcaaaaagcaatggcaaacgatatacatgtagtcctccacaattaataaaatactttcacatctataatttcatttttttcccataataatcctctgatacaggcaggggagatcctgtgagatgtccagagaagcgaagctggtggggtcaggactggaaaccaggcctctggctttctgtctagtgccctttccctttttcccaagatgtctacgtgattctacaactgcagtggagcatgggccctcgctatgtgtctgcatagcggggcttgtattgtagcaaagatctgggaataataatttgagtgaattctcttagacatttatgctggcacctatttcaaactctcataatcttacagttctcccagcctcttgtagcatttcttttttttcttttttttttttttatactttaagttctacagtacatgtgcacaacgtgcaggtttgttacataggtatatatgtgccatgtttgtttgctgcacccatcaactcgtcgtttacattaggtatttctcccaacgctatccctccaccagccccccacctcccaacaggccccggtgtgtgatgttcccttccatgtgtccatgtgttctcattgttcaacacccacttatgagtgagaacatgcggtgtttggttttctgtccttatgatagtttgctgagaatgatggtttccagcttcaaccatgtccctgcaaaggacatgaactcatccttttttatggcggcatagtattccatggtgtatatgtgccacattttctttatgcagtctattatcgatagacatttgggttggttccaagtctttgctattgtgaatagtgccacaataaacatatgtgtgcatatgtctgtatagtagcatgatttgtaatcctttgggtatatatccagtaatgggattgctgggtcaaatggtatttgtagttctagatccttgaggaattgccccactgtcttccacaatggttgaactaatttacactcccaccaacagtgtaaaagtgttcctatttctccacatcctctccaacatctgttgtttcctgactttttaatgatcgccattctaactggcgtaagatggtatctcactgtggttttgatttgcatttctctgatgaccagtgatgatgagcattttttcatgtgtctgttggcttgtgatttttgcacattgattttgtatcctgagagtttgctgaagttgcctatcagcttaaggagattttgggctaagacgatggggttttctaaatatgcagttatgtcatctgcaaacagagacaatttgacacatacataaatgtggtctcttaggaagtgtctgttcatatccttcgtccacttttttatggggttgtttggttttttcttgtaaatttgtttaagttctttgtatattctagatattagtcctttgtcagatgggtagattgcaaatattttctcccattctgtaggttgcccgttcactctgatgatagtttcttttgctgtgcagaagctctttagtttaattagatcccatttgtctattttggcttttgttgccattgcttttggtattttagtcatgaagtctttgcccatgcctatgtcctgaatggtattgcctaggttttcttctagggtttttatggttttaggtcttacatttaagtctttaatcaatcttgagtaaatttttgtgtaaggtgtaaggaagggatccagtttcagctttctccatatgtctagccagttttcccagcaccgtttattaaaaagggaatcctttccctattgctcgtttttgtcaagcttgtcaaagatcagatggttgtagatgtgtggtgttatttctgaggcctctgttctgttccatgggtctatatatttgttttggtaccggtaccatgctgttttggttactgtagccttgtagtgtattttgaagtaaggtagtgtgatgcctccagctttgttctttttgcttaggattttcttgggtataggggctcttttttggttagatatgaactttaaagtagttttttccaattctgtgaagaaagtcaggggtagcttgatggggatagcattgaatttataaattactttggcagtatggccattttcacgatattgattcttcctatccatgagcatggaatgttcttccatttgtttgtgtcctcttttacttccttgagcagtggtttgtagttctccttgaagaggttcttcacatcccttataagttggattcctaggtattttattatctttgtagtaattgtgaatgggagttcactcatgatttggctgtctgttattggtatataggaatgcttgtgatttttgcacattgattttgtatcctgagagtttgctgaagttgcctatcagcttaaggagattttgggctgagacgatggggttttctaggtatacaatcatgtcatctgcaaacagagacaatttgacgtccctttttcctaattgaataccctttatttcttcctcttgcctgattgccctggccagaacttccaatactatgttgaataggagtggtgagagagggcatccttgtcttataccagtgttcaaagggaatgcttcctgttttcgcccattcagtatgatattgattgtgggtttgtcataagtagcttttattattttgagatacgttccatcaataccaagagtttttagcatgtaagggtgttgaattttatcgaaggcgttttctgcatctattgagataatcgtgtggtttttgtcgttggttctgtttatgtgatggattatgtttattgatttgcgtatgttgaaccagtcttgcatcccaggggtgaagccaactcggtcgtggtggataagctttttgatgtgttgctggatccggtttgccagtgttttattgaggattttcatgtcaatgttcatcagggatattggcctaaaattctcttttttttgttgtgtctctgccaggctttgatatcaggatgatgctggcctcataaaatgagttagggaagattctctctttttctattgattggaatagtttcagaaggaatgataccagctcctctttgtacctctggtagaattcgactgtgaatccgtctggtcctggaatttttatggttggtaagctattaattattgcctcaatttcagagcctgttattggtctattcagagattcaacttcttcctggtttagtcttgggagggggtatgtgtccaggaatttatccctttcttccagattttgtagtttatttgcatagaggtgtttatagtattctctaacggtagtttgtatttctgtgggatcggtggtgatatcccctttattattttttattgtgtctatttgattcttctctcttttcttccttattagtctggctagcagtctattttgttaatcttttcaaaaaaacgagttcctggattcattaattttttgaagagtttttcatatctctatctccttcagttctgctctgatcttagttatttcttgtcttctaacttttgaatttgtttgctcttgcttcactagttcttttaattgttatgttaaggtgtcgattttggatatttcttgctttctcctgtgggcatttagtgtatacatttccgtataaacactgctttagctgtgtctcagagattctggtacattgtgtctttgttctcattggtttccaataacttatttatttctcccttaatttcgttatttacccagtagtcattcaggagaaggttgctcagtttccatgtagttgtggggttttgagtgagtttcttaatcctgagttccaatttgattggactgtggtctgagagactgttacaatttctgttcttttgcatttgctgaggagtgttttacttccaattacgtgttcaattttagaataagtgtgatgtgatgctgagaagaatgtgtattctgttgatttggggtggagagttctgtagatgtctattaggtctgcttggtccagagctgagttcaagtcttgaatatccttgttaattttctttctcgttggtctaatattgacagtggggtgttattgtctcccacttttattgtgtgggagtctaagtctctttgtaggtctctaagaacttgctttatgaatctgggtgctcctgtattgggtgtacatataattaggctacttagttcttcttgctgcattgatccctttaccattatgtaatggtcttctttgtctcttttgatctttgtttctctaaagtctgtttatcaaagaccaggattgcaatccctgctttttttttttttttgctttccattagcttggtagatcttcctccatccctttattttgagcctatgtgagtctttgcacatgagatgggcctcctgaaaccagcacactgatggtcttgactctttatccaatttgccagtctgtgtcttttaattggggcatttagcccatttacatttaaggttaatattgttatatgtgaatttgatcctgtcattatggtgctagctggtttcttcatagcgtccatggtctttaccatttgacatgtttttgcagtggctggtaccggttcttcctttccatatttagtgcttctttcgggagctcttgtaaggcaggcctggtggtgacaaaatctctcagcatttgcttgtctttaaaggattttatttctccttcacttatgaagcttagtttgtctggatatgaaattttgggttgaaaattcttttctttaagaatgttgaatattggcccccactctcttctggctgtaggatttctgcagagagatctgctgttagtctgatgggcttccctttgtgggtaactcgacctttctctctggctgcccttaacattttttccttcatttcaaccttggtgaatctgaaaattatgtgtcttggggttgctcttctcgaggagtatctttgggggtgttctctgtatttcctgaatttgaatgttggcctgccttgctaggttggagatattctcctggataatatgccgaagagtgttttctaacttggttccattctccccgtcactttcaggtacaccaatcaaatgtagatttggtcttttcacatagttccatatttctttgaggctttgtttgtttcttttcactcttttttctctaatcttgtcttcttgctttatttcattaatttgatcttcaattgctgacatcctttcttccgctcgattgaattgactattgaagcttgtgcatgtgtcacgaagttcctgtgctgtggttttcagctacatcaggtcatttaagctcttctctacactgttgattctagttatccatttgtctcaccttttttcaaggtttttagcttccttgcgatgggttagaacatgctcctttagctcggagaagtttgttattactgatcttctgaagcctacttctgtcaccttgtcaaactcattctttgtccagttttgttcccttgctggcaaggaattgtgttcctttggaaaagaagaggcaatctggtttttggaattttcagcctttttgctctggtttcttcccatcttagcggttttatctacctttggtctttgatgctggtgacctacggatggggttttgatgtggatgtcttttctgttgatgttgatgctattcatttctgtttgttagttttccttctaacagacaggccactcagctgcagatctgttggagtttgctggaggtccactttagaccttgtttgcctgggtatcaccagtggaggctacagaagagcaaatattgctgcctgattcttcctctggaagctttgtcccagaggggcacttgcctgtatgaggtgtctgttggcccctactaggaggtgtctcccagtgaggctacacaggctcagggacccacttgaggaggcagtgtgtctgttaatggatctcaaacgctgtgctgggagaaccactgctctcttcagagttgtcaggcagggatgtttaagtctgtagaagctgtctgctgccttttgttcagatatgccctgcctccagaggtggaatctaaaggggcagtaggccttgttgagctgcgttgggctctgcccagttcgagcttccctgcctctttgtttacactgtgagcatagcactacctactcaagcctcagcaatggtggcatccctccctccaccaagctttagcatcccagatcgatctcagactgctgcgctagcagtgagcaaggctccatgggtatgggaccagctgagccaggcaggggagggaacatccgggcctgctggttgcaaagaccgtgggaaaagcgcagtatttggacaaaagtgtacagttcctccagttacaggcactcacaacttcccttggctaggaaagggaaatcccctgaccccttgcacttcccacatgaggcaacaccccaccctgcttcggctggccctccgtgggctgcacccactgtccaaccagtcccagtgggatgaaccaggtacctcagttggaaatgcagaaatcacccatcttctgtgtcaatcttgctgggagctgtagacctgagttgttcctattcggccatcttggaagcgccaaccctcttgtagctttaattcaacgtactctccaaagtggagttagtgttttctgactctagaacatagtccctgagtaaaaggatgttaacccatcattttgttcaatgcttacaataaacacatttattaagtcatattaaagtattacttttgatgataaaacagaatggagtaagcccagcacagaagcaagaatatgttagaattcccctccattccccacttaccccagtgattctgtcattttctaaaggcagagtggcccaagcctcctcacacttggtcaagagagagagaccaagaaaactaacttgacttgatgtaactaatttcatcctctggtgtcatctcagagcatcacaggcaagctgtgtgtggagtctgtcagtaattagtggtgaggtttcccaagaagggatcaggttcccaagtagatattgaatattggggcatcagagttggtaggtggccatcacctagaacaggagaggaccccaggtacaggattagggtaccaagcaaggccctacaggcaccaagaaatctagtgaggtttgccacccagatttagcaaataaaaatgcaaagtgcccagtcaaatttgaatttcaggtaaatagagaacaaatttttagtgtatgtcccatgcaatatatgtggaattcaaatttatttgggcatcctgtatttatgtggtaaagataacagggtcaaaatatttcagaacctttacaggattctgaaattgaaacagcatttcaatttttcctgcttccgtctaagaccttttagttttcaccgtcgtcttctaggtcattatgctgaaggctctggtcataggtaagacccaaggagtccatttccaaaatgataatatctgtaattttagttctaatttacataattaaaatttacacttatataaatcctttccacaatagaatatgatgggtggttcctttttgaacataaaaaggtattttatggataaagagtaaaaagtgtctttctcttcagagagttcatttttcataatttaccaatgttcatgtcttataatcagtttgtggagaagacaatttacaaagtggagtgtgaatatctacaggaactctttattgtctataaatagactttattttaaacagaaaaccagtaattaaaaattatttctgcttgtgttggttgtcattgggaagtattttgtttaaatgagataaaatattaaaagtatacagtttggtctctttcttcccacccaggtcctgcacccttcttaattttctcccatggaaatagtatctttaggattgacacagaaggaaccaattatgagcaattggtggtggatgctggtgtctcagtgatcatggattttcattataatgagaaaagaatctattgggtggatttagaaagacaacttttgcaaagagtttttctgaatgggtcaaggcaagaggtaaaatacccttacctacagtgtttgagctgtttttgtacaggctgacaaatataatatactgaattcttaatgtatagataaatgaaaattatataacagttcaaatgcgtgtctgccaaatataggcatttatttaatctacatctgtggtgtatattcttgaataaattcacacattgatatttagaagccccaaaatgagaaagtgaggatatgaatgtaattttgaaaatatctgagtttattaagtcagatcaccattttatgattaagatagattatttgcatgattatttcttgctatttgtaaggtaccccagtagctctcaggtggggggcaatttttccctgagggaacaattggcagtgtctggaaacatttttggttgtcacaagtaggtgaggtaggaaggtggagacgatacaggcatctagtgggtagaggcctgggatgctgcaaaacatcttacactgtgcagaacagccccagaataaagaattgtccagccccaaatgtcaatagtgctgaagttgagagaccctgttttatctgtataaaatctccgtcatgggttttggcacctgacacgtagaaagaaaaattttcttctttttattctcacagagcttgcactccgcaaaaaaaataatatagcagatgacagataagtactttacttcatgtacatacaaaagatccttaatctttctttttagctggtagaacccttacatgagtcccaggaggaatgtttctctcaatttggtgatggattacaaagagcacatgactagagaaactttaagagttgattctcaatgcaaagtccacactattttttgttttttagccaaatatttctctttccagttattcttaaaagcttcaattaggtgctaatctgttttatcacatctccaatacttgctaatctcacttttaacaaggatggctactcattatcctccagacatctggtagtatagtttcaaactcttgagtctaagaatctgaagggtttcctatcaagaacatggaaaaacttaaaatagttgtgaatttatatcaagccattaggaaaggatcagcctgttgcctaaaattccatccttatattccttcctttgggttaaaaccttgtttataaaggacaactgttaaaattcaaacaatttacctgggtgagctaatttatgaatggattgggttggtgcaaaggtaattgcagttttggccattattttcaatggtaaaataagttggctagatttctttgtatgaaatgtagaaatagcacaggcttatgagattatgcaatttcagcccaactctgatttcagtgatgtcacctgggtagctggacgtctgccatggttgaatatttacaccatgaaaatctttaacagtacaaattggggcttctgcccaccttgcaacctccattccccaagaagaccagcttacctgcccgtggctgaaattaagatatgaaaagttctggttgggcatttttatcatgaaagagttgggaatacagccaaaggtgcctaaaaagacactctgctactctggtcacagtgtgacggcatgaaggactatagaaaggaaggggcctattggaggaggagggccagaagaataaaggccacaatgagaaattcatcgagttcatgtctgtaagctcagactccaaggaaatcttgcatagcttggaattgagttcagttgaagatctggaaatttccattagcaaatggaactgaataagctgtctgtatggttgcatcaaaatttcaccattactatagttgaaatgatcaatacattatggttggcttcctaatttaaatagtgtgtaggataatttttagtttcaaagctataaatactatttccagaaatatttacttaagggtcagaggaggtaaatgctgcatcaaaacaaaggcaccgtatctgtgactattttattatttaaacaattttggaactgcataaagatgacaaatacttaaaagaatagactttttatatataacaattaaaataattttgttgtgaatgggggaagtattaataacaattttaaaatttgattttgcagagagtatgtaatatagagaaaaatgtttctggaatggcaataaattggataaatgaagaagttatttggtcaaatcaacaggaaggaatcattacagtaacagatatgaaaggaaataattcccacattcttttaagtgctttaaaatatcctgcaaatgtagcagttgatccagtagaaaggtaaattctgctgtattcagacattgaaatatatttacaaatctagtgaagattgatagaattataacattgtaaattcaaagggatcctctcactgagaccaaagccctcttttgcagcacacaggcaccgttttctataggacagttgcctgcatttcaactgagacaggatccccccataaatattcctaactatcatggttttctgctatagaggcataattccctttctaacttgaaatcacttgtaatgtctacaatagggcagtgtttacttgttgaataaattttcattcaaaatagtcaaacttgccctgtgaaggagctgctgaaacattgagagagttggccatttaaggcactatacattcatttttgggtctatgtaatgtgtttgccctcaggtttatattttggtcttcagaggtggctggaagcctttatagagcagatctcgatggtgtgggagtgaaggctctgttggagacatcagagaaaataacagctgtgtcattggatgtgcttgataagcggctgttttggattcagtacaacagagaaggaagcaattctcttatttgctcctgtgattatgatggaggttctgtccacattagtaaacatccaacacagtaagttttactcttggtataaaataaaacaattgtcatttgaagtccacaagataaattaattttacttttgtcaatggaactggtatagtggtttaggccatagattttgaatccaaaagacttgagtttggccgggcgcggcggatcacgaggtcaggagatcgagaccatcctggctaacacggtgaaaccccgtctctactaaaaatacaaaaaattagccgggcgtggtggcgagcacctgtagtcccagctattcgggaggctgaggcaggagaatggcgagaacccgggaggcggagcttgcagtgagccgatatcgtgccactgcactccagcctgggcgacagagcgagactccgtctcaagaaaaagacttgagttcaagctccagatttaccgtctgttagatgagtgactttgagtaggttctataacttctcttatcctcagtttcctttaacgtgaggataatcataatatcagtctcttgggattattgtgaagggaaagtaaatgaatacaaacaaaaataattaacagagtatttggcacataataagttctcacatgttgaccataattattctttttggaattatgatgttacatatttttatctttcattgatttgctatcatgccagcaactgactttccagctttgtggcaagaagcagaaattcgtcatgtgaaattgatgtcactagaaacccactcttactctgttcctattttcttccccattttcatcacacttattggatgactaaaagaagaatgagacaatggatctggagctagaaattatatcttattagctcagagtatgaggagataaataaaattttaaacttaatatacttttctaaacataaatgagaaacaattgaaaacgtaggtggttaaaacttagacaataaattgaaatgaagtgaaattctaataagacaaggaacaaatgttctgttgttcttttttcttttgtggttgctttttaggcataatttgtttgcaatgtccctttttggtgaccgtatcttctattcaacatggaaaatgaagacaatttggatagccaacaaacacactggaaaggacatggttagaattaacctccattcatcatttgtaccacttggtgaactgaaagtagtgcatccacttgcacaacccaaggcagaagatgacacttgggagcctggtgagtcatcgttgaccttgcgcagggcctgacacatagttcccacccattcacctgcttgagccagacaatgaggcgttgtaggggaaaaaaaatttttttcttcaaccctcatatattcttagtcataatagacccctgtaagaaaagacagattaacaagaaaaaaacaaatagaaggccaggcatggtggctcacacttgtaatctccacattttggaaggctgaggtgggaggattgcttgaggccaggagtttgagaccagcctggacaacataacaaggctcggtctctacaaaaacgaaagaaagaaagaaagaaaaacaaatagaaatggattaacatgtacattttatatatacatgggagaaatccggggaatgaatagctctcaaagaggtggctttaaatgccagtttatatagtatctttaataaagaacagtaaatttttagagaagtgacaagacagaggaaaaggactttgagtttctatgagtagcaacttgggggaaggcaaataaatggcagataaatgctagttaataaagtttgttaatgtaggtacctctgcagccattgccaggccgtaaggatctaaagttgtcttcagtggttaacttttgttattcttggtagagagggggtacctattgtctttgtaaatctatgtcttgcgtttaggcaaatagagcttttctgcatctctttctttttaattgtttgaagctcaacaatccttcccattttggagtggcatattctgggatcttacagggccatcttcaatttttcccactgtctcacccccagtttctaatccaacaccgaatccattccattctaccttctaaatacatttcaaatgtccacttctcttctctattgccactgacatagtctaagcagacaggtacgttttgtttggcctactatagtagccactcaactgatccttctgttttctgaatctgatccattcactcccctacataaaatccttcaaaagcttttctttgcacttaggttgaagttcagcattttaccagtctcatcaatatttgaccaacctgctctagtgatctctgccctcactaaaatttagtgcaagtcttgctataactcctcaaacatgctaatctccttcattcctttagggttttgcagtctctcttccttggcttagacttctcttcagttctgagcttaaatgtcatgtgctcagataggtcttctgtgataagccaatcaaaataggccccttcacctcttacttttttcacagtacacctttcattgagctcatcacgaggtgtaactacatactcatttgctttctttttggattctctctcccatttgattgtaagtgccatacaggtagaaaccatgtctattttgtttgtttttttagccaccatatatacagtagatatttataaataaattaattttagatggtaaatgttagtaaaaagaatgagtgattgactgaatctagtcacagtcccaaatttccacttctaaatgtagtcttctctgaattctttagcatgtaattgtttttaaaaagttgtcaggcctgtaatcccagcactttgggaggccgaggtagatagatcccttgaggtcaggagttcgagaccagtctggccaacatggcaaaaccctgtctctactaaaaatacaaaaattagccgggcatggtggcgcatgtctgtagtcccagctattcgggaggctgaggcaggaggatcacttgaacccaggaggcagaggccacagtgagccaagatcgttccactgcactccagactgggtgacagattgagactctgtctcaaattaaaattaaaaaaaaaaagttgttaggtttttatgaaataccacaaggggcctacagaaaaaaagttgtcaggtttttaaaaatttgttataatcgttaggctgctcaatgtacctcataaatgatgtgacactaacatctcacctttatgtaaaagttttatttcaagaaggttttaaaatatatttaatgttagccttaaatagccctctgaagtgcagaaacagagatagaattgtttatatcttctactttcttttttttttttttaagatggagtcttgctctgtcacccaggctggagtgccgtggcacaatctcacttgaattcacaaagcaaaagttgtgggaaacagttcaactctgggttctagcaccacattaaatagcaacaacctagtggtaatgctataaagtagatgggtgaacccataatggtagtgtagatagtctacatataaaggtagtgaatctgatacactgccacataccttccatgggaaatttcaactcaagctgtcttcacatacaactcattgtctgagtggtgatgactcacaacaaaatcataaccaagggccattatgaataagtatttactgagtcccattcataataattagagatatgtctgccatcatcataaccctctcttacatttatatgtaacctcagaattttcaaagtgttttcatgggctttagtttatcggtttgtcacagcaatgttgtgagacaggaagggtaggaataattgtacttaattcatcattgagaaacctgaagaaatagagcaccttttccatgatcacatagctagttaatgatgaatgtgggggaaaatttcctatcatcaatctctcagtttagtattcttcctaccataaatgtattgtctcttcagagcccctcactactcagcttctgtgacaggaagttcaaataggataactgaaagcatgaatttcggaagaaaatctacaatgattcactaaagtgcagccccaaacaatgtggcaagtaatagaattggctggaaagcctctgccagctgcagagccacagacaaatctggaacctggaagacagttggcattggagattggctccagttactgaccaaaggatgcacttcacacatactccacaggcaaaggacttttgatttcaggggcactgctactttgcccattattgattaggtttaaattgttttagtgtcttagaaagcaggagctctttacctgtgatgtagggcctgtggatctcttgattttatgggttagatgaaaatatgcactgttccacctagggagatggtatataaattttattgggttttcaatgtgtttgacatccttcggatttttttttgggggggtggatgaagtctggctctgttgcccaggctggagtgcaatgtgcgatctcggctcactgcaacctccatttcctgacatcaagcaatcctcctgcctcagcctcccaagtagctgggattacaggtgtgcatcatcacacctggctaattttgttgtgtttttggtagaggtggggtttcaccatattacccaggctggtctcaaactcctgagctcaagcgatctgcctgcctcagcctcccaaagtgctgggattacaggcatgagccactgtgcccagcccatccttcagatgtaaagacatacttctctagaggctggttagttcctcatggatattatgcctaaattgcagctcctctggtgatctggaaagtggtactttgctttacaaagcatttagtagtgaaactacttcaatgaagaaataacagaaaaatcatataatctggttgatattatttttgttataaaatataaatatttatacaaatatgagtatcaataaacttacttcttgcaaaatgcctaagctatcatttatcaaagcatgctctacaaaactctagttctttttttttgagatggagtctcgctctatcgccgaggctggagtgcagtggcgtaatctcagctcactgcaacctccgcctcctgggttttaagcaattctctctgcctcagcctcctgagtcactgggattacaggcacccaccaccatgcccagctaatttgtatttttagtagagacagggtttcccgatattggccaggctggtcttaaactcttgacctcaggtgatccacctgcctcagcctcccaaagtgctgggattacaggcttgagccgccgtgcctggcctcaaaactctagttctatgggatttaatgaggttacttaggggaaaaaacctttcggggccaagtgatttagagatgatgtgttcaataaagttgaatgagttttttcttgagtggaatttctcagaactattcatatggttgtgtgcatcattactctctaaaggtgacacaacccatgtcatttttctgttttatttcctatgcagcagcccacaggactcttgaatctattatttgtagttcagacctcttttttttttttttgagctctagacaaatttttttaaaaaaaggactcaggcataatgagcgtcaagctgcaaagatctgctatagagttaaactacagagataattgacttaaaacatgggaatttattcataatatacaaaaaggagcagctctggtgaagactgtctggccaaggcaagggaggggcttacaaaggcaaagccccagagcttcacatggaagattgatttgttggtttgaacaagtccttgccttgtagattcaggttgtctggttctggaggagcttcatgctgcagatatgtctgcatgctgcgccccaagtcaaagtaatagagccacagtttcaccatcaggccattttctgatgatctgaccagtttcctgaagagcagttgccctggtccttcttctgggccttgcttgcttgctgtctgtaccttccaagctccgggtcctgtagtgggcacataaaatgcatgtgtttgggctcagtaaaaatatccttttcaaggcccttatagttatctgccttgtaagcatgtctacttggatttcttgcaagtgtttcaggctcaaagaaaataactaacctaccaactttcacctccctcttccccagctcctctccctctagtgtcatcagcccaatgaatggcatcactctctaccgcatctcccaaagcggaaaccgaggagttgcctgttccttcatcttcctcactctcatcccatgaaatcagtctctgcatcccaacaattctactccttatgatctaaccactctgcccttcctgcaggtttctctctccagcatcctcctgactagtatccctgtctccattttctctgctgcagggagcataatccctcaaaaaagaaggcccagtcatgtcactctttgattaaaatccactgagaattcctaatcatcagtaattaaagtgaagtctcttccttgggctcaccaaggcttctgctcatttctcagcttcttctctcacccttgtttatattacattctctgttgcaaccattctcaaagatgactttcctttcatgaggcacacttgctctctcctgcagcccagtctgcatgctcaggaacttgccacctccgtcccttcaccagctgtctctcctcatcctctgagaaacagctccaacatgacttccttcaggaacaccttccttgatctactgtgagcctaagttagctgttccagagaaggtattctcagggaatgtgttctcagagaatttccctaatcatatgacaccatgcttagctggagttgtctgtctttttatattccttagtccttagaggacagagaatacaactttccattgcattcccaatgcctaaacgactttaagaaacaagagttgaaaaaacaagcaagccaggcacggtggctcacacctgtaatcccagcaccttgggaggccaaggcgggtggatcacttgaggtcaggagttcaaggccagcctggccaacatggtgaaaccctgtctctactaaaaaataaaataaaataaaataaaataaaataaaataaaataaaataaaataaaatgcaaaaattaactgggtgtggtggtgtctgcctgtaatcccagctatttgggaggctgagacaggagaaccacttgaactcaaggggcagaggtttcagtgagccaagatcaggccactgcactgtagtctgggcaacagagcaagactccgtctcaaaccccaccccccacaaaaaaaccaagtgaaaaaaaattctttggcactctatctcctaaataatataataaggaataagttttaaagatacataatatctgagtacataggtttttttgttgttgtttgtttgtttcagttagaatttgaaataacccatctaagtacatgcagcttcttggctcacagagatgccataattattgcatgggtacaaaattatctgttcttgtgataatttaagggctttccttataatatctcacttaatctttacaacagctctattaattaagtgtgataattagtgtaatattataaattaaaagttctgaggtttagagatgtcacagtaccctgttgaaggtcacagggtggtagaattgggatttgaaaccagacagactggtaacatgctgcctctccaaatacactctattatctatcatttcatattttagatgtaccttatttgttttgagaagcctgtaattcagcatatcattatttatccatggccttctggtagttaagtgcttcagtttgcacagatcatggagtcaaaaccctatttctctctctctttttacatttttctttaatgttttttttcaatttcagaaacttaaaatctttctctttctctcttacttctccccggctgtccgaaaacaggcacagaatgaatctcacattttttgttggcatgattaaacttattagccagatatcctggctgccctgatacctacactattatacaaatctcagaaatagtgtgggaacatttttgtacacatcttaatgacaattatttcaagttcaacttctggggattttacaactactttattgctcatagatattatgttgtaaaaggtccaaatatttttgcttttttctgtattctttaaatgtagatttcagttttaagctataagagagcttcaaaagcatattctttgggaaatgaaggttatttattactaacactgtgtaaaatgctttacattcatttcatgcacaaaaagatggctgaatttaatcctgtgagttcatgaaggataattgtctccacctggaaatgtacttgcttctggaagcaattagtatagctaaaattgccaaggtgggagtctaattcattttgattattttgttgctggagtgtctactataaaatcttggttattttgaaaccactggaaaagaatcgtcctaaaaagataaatatttagttcatataattttaaattattagtttaaacacataaaattctgttattcttcacggaaatattagtaaaatatggattgctatctttcttagcatcatttatagttattgacattttcttagtgactagagtcacatttacaaggatacatgccattgcagcaagcataggattggtttggggcaaagctgggtttgccctgacaccaaatggctgccatttgaaatctcttttaaatacttgaaattgctctttatcatttttatgttttctttcttgctgctggctctcacatcttgcaggttttcacatgcctggctgtggcctctgtttattttctaacctgaggctttttcttgccacttgtttgttcaggaaaccagatcattagtcctatagaatttttcactttctggattttgcagattatatccccgtgtgtcatttaacatgtttctctaatttccttgttacctataaactggtagtttaggcttagaaatctgatcagaatcagattgttttcaagaatgctttatgggtggcactgcaggtggttctgtaagcttcccctttgtaccacattaaaaggcacatggggctagttcttattcttttttgtgatgttcaaaattaattagcatttcagaggtcaccagcctggtccagccactgcaagttccccatcagccttttgcttaattgttttagaagctattgattatcattgcctggagccattttttattagaggctcaaagcaatgacattctaattctgtcactgtttatgcatatattagctgggattcttatacaaagaggagcctttccaaatcagatatatgattgtcctgaggaggaggagcttttataggaaaggtaaattcagtgttcgatcctatttcttaatttacgtgttttcaaaataaagagttagtgtcctaaccttccagtatcctccaaaggtcacttttctttaatcatctctataaagtcatggatttttaaaaataattgacatttgtattcactgtaattattaccattttgatactcaaattgtactatctttctctggaaggaaccctgacctggagtttctagtctgtgtgggaaattaccaactgtcttgcagccgttgacactggcagtctggaatgcaaggttaaggctacatctgggattagtaagaaagaacactggactcacgcagccacttctaccattggtgaatgtgggtggggtgcggtggtgacaatggtagtggaggcatatacaccttgtctttttaaaatgtatttttaattatggatacataatagttgtacatatgtcataccttgtattttccatcttcctgctatgggcaaccaaactgccagaaatgaggatacaataagaaaagactcaatgggcctgaagggctcttctaagagttaaaagcattttatttatttatttatttattttgagacggagtctcgctctgtcacccatgctggagtgcagtggcatgatcttggctcactgcaacctccgcctcccaggttcaagcaattctcatgtttcagcctcccaagaagctgggactacaggcacatgccaccacacctggctaatttttgtatttttagtagagatggggtttcaccatgttggccaggctagtctccaactcctggcctcaggtgatctgcccgccttggcctcccaaagtgctgggattacaggtgtgagccactgcgcctggccaaaagcattatttttaaagtgctttaagtttgttgattcatttactttttaattcctaaaagggtacagatggatatgataccaagtggctaaattctggctaggtgatttttttctttttttactgtaattaggaattccaatagcacagaacggccattcttgtattttcttccttgtatttctattactgacaagagtaaacttctatactgttcagtttgagaagttttttgaggaagttgaggcagtcattattgagaactcattaatgatgaagacaataaacaaatgaagcaaaaatatagccacgtttttatagacatttcataaaactaacatatattttatgtgcatgtttatatttatgcaaatgcataaatataaacacacacacatagaattttacgtatctggtaaaaagagggggattacagtcaaagggcttggaatagcatcccagttctacactctattttctatgtgatccttaacaaggcactatttcctaatctgtaaaatggaagatgatacttgctctgcatagctcaagggcttgttatgaaaatgaaatgtgataatacaaatactttacaaagtgttattcaaaatttttgttatgtgctaaatattggggatgccaaatatttagttatgacttcagaatgaccaaagttaatgggtttgaatggaagagactagaaaggctttgttgatgaggtgagtcttacatggagtttgaggtagacaaagatgtgatcagtggaaaaaaacaggaaacggaatcccaagtgcattgtttcagaactgggccagggtaaaatctacagattcactgggctatagtaaagctcatgagtgcctgtgtgctagccaggcagttattgaaggggcagttggtggtggacattaaactccatgattaggagctttaattgatctcagaggtaattaagcctcattgctcagctctgagaaggagtgttctctgaggtcagcagcagcattctcagtgctggctttggcctattttgaagctaaagaacagcagaagattaaggagattaaagaaaatataaccctcaatcctctgtgttttgccaccacctaaaatgaccttttaaagtgtttagtgtctgaattcaggtcacgtcatcagcacaactaggcagaggagaatagtgatttctttcctgcctatgtccattattgaagagtgattgtgtattgttaataagcatcactaaaagccatcagcagcatggtatagtggaaaaagtactggctagcatcttgtgacaaactgttttgagttctagctctaaggttgattggaactttgaggaaaaaacaaatagggagttaggttgcaggtgacatgatcacagggtttttttgtggatgtattagatgtttactggatgcctatgttgtaaaaggcaccgtgctaggtgttactgggactataaatgtgaatagggcacatgccttatcctcagaagtttatcaatggaaaaaagatgcatatacataattgtggtggtgacaatggggatgatcatgataagaacagatacaaatccaggtgagaggtagtagaaaggtatgggaaaaaagaaaaatatatactggatctagaagaacaaagcattttctacacctgagacaatagttgttttcttcattagacagtttgattctctgttaccatactataagcagtaattaaggtttgataatctttagaggtataaactcagaagaatttttcaccaacatttaattctgtttataactatagaatttttttaaaagagggatctcagtgaatatctatttcaacaagtttattttgtgaattaggaaacttaggtcaaagagataaagtgatgtgctgtaagaggaagaaccaagacaaaattcagtttccctgattggtaatccagtaatcatccagcatgctgagtttggaaagatttttatagggcaaaggaaagagtttttataagaagcatagtgtttcaattttttgttatctcaagaaagtgtagcatttcagtgctattaaaaggccaactcaaaccttcctggatttttgttgttgttaacttgtacagtttgtaaaaataaaagttaaacacaatactgctttttaaaaagaaatttaaagtggatgaattttgtctccaatatttacaagtttctaattttagtcatttacttttaaaatttaggccattttatttttaattttgcttaaaattttgatagtttaagtgaagcatatagaacaagaaaaataatgtaactatacatgtataattggcataaaaatcataggcaagaaataaaatttttggaatcaattatccataagaccattcaatgtaaatcttaactgatttagcaggtaatactgcaatggtgttgaaagttgacaagactgattttgcatttaattttgtaaagagatttgaaaaaacaggttcaaaataactaaggaaataacacagactagctaaaagtaattatttgtaactaagatgaaggtgtaacgtttcactagtacattaggccagtgtttctgaaagtgtggtgtgaagcagcctcctgacatcataatcactcctgattctgtaaaaatgcagattcctgagcctctgatttaccaaatcagaatctctagagggtggcatactctccggttatctcaatgtacactagggacattttcaagggggcaagaatatgtttctactgaatcttactgttattggtcatgtctagtgatgttaaataaaatttatgggaggcaactgatttagactgagctcctgcaataggccccaacagaccaaaccaaaatgaagtcactcatgctaaaattccacatcaacacaccaaaactaacttgtttatctgaccccctgacggatcaggagagagatgatagccaaatccccaaacaggtcagctttaactggtatcataaggaaatcccatctggtttaacctttacgaggaaagtaacctgaagtaaactgatgttaaccaatccactatatatatcatgctcaagcaatatcacaaaagtgaatgtgctgccacagccagtgtagcatctgtctatttttagacaagatgttgcccaattcatgaatcccaaataaaagccaatttgatcatttaattaaatgtgttgaaattttatcttttgagatttgaagtagaagcaaatgggtacagacaaaggagacttctttattagtagataaacagatcagagaaaccaagcctatttggagaacagtctcaggccctctgcctgctttgctcaggctcttgctgatttgtttcctgtgtccttcccagcaatggtggtgttctcagcagtcctttccttaggtcctcagcttttcccatgatacatcagctctagctgattttaacaatgccatggcttcagaatccatgaccccaatagttttccttggccttcacctcttgccaggcctctggcctctgtatctacctgcattctaggtatctgcccttacgctcaagcttgctactgtatttctcatagtattttacaatggtgctattgtttttaaaatgggcaaaaaataaggtgcaaaagagacaaaaatctcattaactttttggaaagagatatgcagttgtcccccagtatccgtgggggattggtatcccccaagatacccaaatctgcagatgcttaagttctaatataaaacggtgtatttgtatataacctagccacatcctcccatatactttaaatcatctccaaattacttataatacctaatacaatgcctacatcacttcattcctgtgaattcaacatagtgcttggcatgtggcaaattcatgttttgctttttggaactttgctttgtggaattttttttcccaaatattttcagtcctaagttggttgaatccacagatatggagggccaactgtaggtgttactagtttagcccttgattctggctctgaaaatcccaatggtacaaaattgaccacttattcaatatagctggctaattcaacccaaacacccaactcgctgagcagattttactgtttattatggaatatttggaacacgtgggacactggcagcaataactacagaaatttgaggagcagagatatggcaatggtatatattgagtctgaaagatgttcattaaataatgatgttaaaaacagctaaatagcttacatatctaacctataaatattacacttaaaaagtattcttggccaggcacagtggctcatgcctataatcccaacactttgggaggctgaggtgggcagatcacttgaggtaggagttcgagaccagcctggccaaccccgtctctactaaaaatacaaaaattagccaggtgtggtggtgtgcacctgtaatcccagctacttaggaggccaaggcaggagaatcgcttgaacacagaaggctgaggttgcagtgagccaagattgtgccactgcactccagcctgggtgacagggggagaccctgtctcaaaaaaaaaaaaaaaaaaaaagtattcttaggtttgaatctgttttcatttcctaagcagattatttcatttgcagaatgtgtgcttttttgtgataaaagtacattagaatgaaaaagctaataagtagtgtttagtattcgcaacctaagaaatgacatctccagctaatcaggatgcccaatcctgagaggttttggagaagtaatacaattggagaaaaaagtgggcttcgggatgctggggaatctgggctctggctaagtttgcctccgtgagagatgcagctgtagacgttgtagggaggtaagacctcttaagaatcaggaaaagatttagcagtgtcctctgtcaaaacacggccccactccaaataaagcatcttctcttttagagcagaaactttgcaaattgaggaaaggaaactgcagcagcactgtgtgtgggcaagacctccagtcacacttgtgcatgtgtgcagagggatacgccctaagtcgagaccggaagtactgtgaaggtaatgactggaagtactgtgaaggtaatggaagagtcgctgcttgaggggaggaatgctcaactgagccagcggcttgtcttcagtgggccagccagagactcagtggaaaaccaacttcaagtccattctccccgtcccccacacaacccctgaagactattttttatttattttttcttgtttgtaaaacctttataatactttcctatcttcatatcttgtgtttctagatcaaacactgagaggatgcttaggggttgatataaggcagggattctctaagtggattctaccaacctctgcgtttgtgtgcaaaatttcagtatgtgtacatttttaggggagtggtttcatagggatcgtaagagtctcaaagagtctgtgactcctatcttatcccaagaagatctagtaggaagcctgggaaactgagccaggctggtttgtctaagaatcctcctgttttgagattctggaccaagtgcaacgaactcaggagaaatactatgtcctttttcctggaaggtgcagtagtttagtgatgaaaagaatccaatggctgcagcacacatacagtggaattagctggggtgagacctcaggtaaatctagcatctgcctgttaattataaccccctgcttacatgggaccaatgggtgaaagccatggcatagagatagtgagctggaaggctggggcttcagccagaataaaactgctggagaaggtttccacatttagggaaagggctctggtcagtcttgaaggttgaagagcacaataggaaatgtcctaagcttgtaaagagctttcaagagtccctaactgaaatggcatgctatatcttttcaagggaaataatactacctttttcccaagggttattctaatatgaaaatctgtatttgaaagtataagctgggccaggcgtggtgactcacacttgtaatctcggcactttgggaagccaaggcgggcagatcacttgagtcccagagttcaagatcagcctgagcaatgtagcaaaaccccatgtctacaaaatatacaaaaattagctgagtgttgtggtgtgcacctgtagtcccagctactcaggaggctgaggtgggaggatcacttgagcttgggaagcagaggttgcagtgagctgagatcgtggcattgcactccagcctgggtgacagagccagactctatctcggggaaaacaaaagcataaaatgtgacagaatagaaatggcttttatcatcatttaattgacttattttaccctttgctagagtatggaaaacagactttccatgatcaattacagcatatacaagtgtgagataccctgcgttgtgatgacttattagtgatagcacaatttattttcaaaaatagccatttgaatgtattgtgctgttgtcattgtgcagatgttaatgaatgtgctttttggaatcatggctgtactcttgggtgtaaaaacacccctggatcctattactgcacgtgccctgtaggatttgttctgcttcctgatgggaaacgatgtcatcgtaagttatagcaacaagtatttattgcattagttttcttcattttcaatatgtttctaaggtggctatgatctgggttggtgatcttcaatcagcagtgtgcatcataattacctttgagttttattttgtttggctttttaaaacatggatgactgccagcctgggcaacatggtgagaccctatctctactaaaaatacaaaaaaaaaaaaaacttagccaggcatgttggcccatgccagtggtcccagctactgaggaggctgaggcagaaggatcacttgaaccaggaggaggaggctgcagtgagccgaaatcaagccactgcccttcctgggtgatggagtgagaccctgtctcaaaaagcaaaacaaaacaaaaaccatggatgactggactctaccccagacctatcaaatcagaacctctcaggttgggaaacaaatcatctataatctatgtattataggtattttcctgtttctttgtctgtattaccttatatttcattgtctatctcttttttattttaattttttaatttttaaaaataactattgggtactacatttcattgtatatctctaaaggataggcatgtaaaaaacataatcatgatacattattgtatctaaaaaacttaactataattccttcctatcatttaatatccagttaattttcaggcataaccacaataccattgttatgcattaaaaaattaaggctaggcacagtggctcacacctgtaatcccaacactttgggaggtcaaggcaggaggatcacctggcaatattagcaactgattgcaataaatttttgcaaacccgatttaacactaatcttgaccttgttctttattaattagaacttgtttcctgtccacgcaatgtgtctgaatgcagccatgactgtgttctgacatcagaaggtcccttatgtttctgtcctgaaggctcagtgcttgagagagatgggaaaacatgtagcggtgagtttatttgctttatttaccttttgtttgtttgaaaacatacatttgctcagtgacatctaaaaattgatcttgttgtcaaggaagaattgattttccaatattgtatactgaaagatattgttacaacagattaacatagatttaaatttagtatttttgggtttttggcttttttgtttttgtttagacagcatagcgtctaacttatgagcaagggctttgaggcttgacagccctgaggtagcattaccagttactagcagttttgattttggtctagatacttgccctctcttggtctttgtttcttcaactgcagagatactgatacttgccaccttgattaaatgagacttcagatgcagagtgcttagtctgtttcttgcacctaataaacacctctctacttttatcttcatagagacttaagtatatagataactggatgtaactcagaattagcagaagaattgtgtgtgtgtttttgattttctaataaaacaaagccaagcagctaaaaatgtgtgagagaaaaaaattactaggaagagttagaccagctgccaaactcatcaaatggatttttcattctagacagctgccagtgcacttgctcctgaactcattggtagaataagaggacaagggccactggaatgtgaaggattaacatccaagatgttgggttatagggaaggagggtagtgtgacattttgatttttatctctgaaaaataaccttgattgcagccatatgaatgattgtggaaatgttttaaaaaatcaacatatgggctgagtgcagtggctcatgcctggaatcctagcattttgggaggctgaggcagatagatctcctgaggtcaggagtttgagaccagcctggccaacatggtgaaaccccgtctctactaaaaatacaaaaatcaaccaggcatggtggcgggtgcctgtaatcccagctacttgggaagctgaggcaggagaattgcttgaacttgggaggcggaggttgcaatgagccgagagtgccattgcactccagcctgggtgaaagagtgaaactccatctcaaaaaaaaaaaaaaaaattaacaaatggttgactcgcccccatcctttgatgaaaaataattatattttggatgacgtagcatcattactaagcaattgtttttgtaggttgttcctcacccgataatggtggatgtagccagctctgcgttcctcttagcccagtatcctgggaatgtgattgctttcctgggtatgacctacaactggatgaaaaaagctgtgcagcttcaggttagtgctgtggttgtctggaactgtgtccctgaaaaaaaattcatgaaaatcttttgtttagaaagatggaaagttaactgcttatggttttgtatttttgaaatggaaaaaaagcaaatcacattgtaaatatgaataatatgagtaataacaatataactagtaaccaggcttttaaagactatttctattcttaattagcatccggcaaagatttgccataatatcagatagaatatttttagtatatgagaaagtcatgacaagaatagtcttaaaacactttatagttaagaggcatttaataagtatttgttgattgatttgatttttatctctctactgaatataattataacactgacaaattctgtccttttaatgtcaaaattcaatataaagttgtacgcttcagctattttttttgtcttctgatattacctctcttgcatccttcaacagccatggaaattctagatttataccaaattgatttaatatctcctgaaggttcattatgttttaaacatataatgctcataatgctatcatgtaatgatgatcctgtataccttgccctagtgagaccccaatactgttaacttctcagggccttcattaatatagtgtaatctaaatccttaaaattatcaagggtcttgctattaactcaaatcattgtgcctccctttaagaagtgcccaggccagggaaagttacttattcggacatgaaagtatacaatctactaatattagtgtttcagtatgtgtgaatcaagaagatgtataaccctaagacttgcatcatttagctatggtgttggttatttaacgctgtctctttctgtaagtaagcagcttttaaaagcaaatacctggagagggaagaaaccagagatgaaattctggcaatatgtcacctcctggaagaggacatcctcttgcctgtcttcacctataccacactagagggaaattaagaaaacaagtactgtagaaattgggtaaaaaggtacagtgaaagggaagagtcagagatgcctcttagtttctaaggcacgttttaaattcagccatatttgaaatttggttaacaggaccacaaccatttttgctgtttgccaattctcaagatattcgacacatgcattttgatggaacagactatggaactctgctcagccagcagatgggaatggtttatgccctagatcatgaccctgtggaaaataaggtatggttttgttacttgaacagatgtggacatgctttaaggacagagtagaggattttatcctaacaaatgacctggcctacttgaaaatcctctgctaagttctgaatgattaggcacagaacaagttaaatatagatattggagtaacacttgagaaattttaaggacttttttgccatcataatgctaccctagtccttgctacgattagccgttttattggaaatgatcacacagtttagttttagattttcagtttagtttcctctttggagatgaggatgggagactagcacagtgtcatgcatatagaaggagcttcataaccaggttttttattacttgctggtagtgagaggagtgggaggttgagtttggggcataggaagtatggattagtaatttgtgttttacatatgtcttttgagggaggagattcaatgacctcttaaccatgaaaatcagggaacgtaagttttatagctcatgtgagaatggcaatctaactaataacattatttacataaacattttatataagttttgtgtgtaacttagaatttctgtatcagctggccatttgatctctaatttcttagttgtatctgtgctaggttagaatgtgcttgaaatgatgttacagtgtgttttggagattaatcacccaataatgatacatttatatagttattaattaccctgcataattatttagttattactatgtggtacattaattcctagactttcaaactttgggcttttgtttcttcctgatttgaagcagtctggtaaatggccaaaagaaacaaagtgaagccaattgattctatatttaataggtatggattggtagccaaatagaagtatttttgcaaattaaagttttgcaattgaacactagcaaacaattcttttccctgacctgaatctatatggttccatagaacagttacaataacagaaaaaaataattaatagaaaaaaggcagttcaagattcatttattaccaaactagttttattcctgcagaatcagtattcttacaacaagtgaatgtggagacctagaatgaattttaagtcaggtggctggtttttgtttcttgggttaattttcttattttcttgctactcaaattgtgatctttgagccagcagtgtcaacaacacctggagattattagaactgcagtcctccaggttccacccctgaccactaaatcagtatctgcattttaacaatattatcaggtgattcttatgcacattagagtttgagaagcacagtgccagtggagtgaagtacccctatttgtatttatgaaacataaccttttctatttcatttagaaagaagagtaacccattatttaacgacttaccattttctgaatagtctcattattgattgtaagtttatgtacacatgtgtactcacagttaaaattctacaatgctttcattaaattatcaactgacccatatctttaaaaaaatatatatatatatacattttaaatttttataggtttaggggtacaagtacagttgtcttacatggatagattgtgtagtggtgaagtctgggcttttaatttacctatcacctgaatagtgaacattgttcccataggtagtatttcacctgttacccccctgcaccctcccacccttgcagtctccaatgtctgttattccactctgtatgtccatgtgtacccattgttcagctctcacatataggtgagaacatgcaatttttgattttctatttgagtcatttcacttagtataatgccttccaattccatccatgttgctgctcacaatgatttcattcttttttatgagcagtattccattgtatatatatgacacattttaaaaatccactcatccattgatggacacttagattgattccatgactttgctatatgaatagtgctgtgataaacatacaagtgcaggtgtctttttgatataatactttcttttccattgggtagatagccagtagtgggattgctggattaaaaagtcattctatttttagctcttgagaaatcaccatactttttccctagaggattgcaaatttacattcccaccagcaatgtataagagttgtttttttcttcacatccatgccaacatctgctgttttttaactttttaataatagtcattctgatgggtgtaagaagatatctcattgtgattttgattttcatttctctgatgactagtgatgttaagcattttttcatatgtttgtaggctgcttgtgtgtcttcttttgaaaaatgtctgtttatgtcctttgcccactttttaatggggttatttgtttttatcttctcgggttgtttgagttccttatagattctggatattagccctttgtgaactgcattgtttgcaagtattttctcccatactgtaggttatctgtttactctgttgattttatcttttgctgtgcagaagctttttagtttaattaattcccatttgtatatctttgtttttgttgcatttccttttgagggcttagtcatgatttctttgcctaggcaaatgtccagaagagtttcttttagttcttcttctaggatttttatagtttcaggcttacacctaagtgtttgatccatcttgagttaattttttatatggtgagagataagagtccagtttcattctactgtttatggcactccaatttccccagcacaatttattgaataagatatccttttcccaacgtatatttttgtggactttgtcaaagatcagttggttgtaggcatatgactttaaatctgggttctctattccattccattggtttatgtgtctgtttttatactagtaccatactgtttgggttactacagccttatagtataaagtcaggtactatggtgccttcagctttatttctttttgcttagtatcgtctgtgctcttcaggcttatttttggtttcatgtgaattttaggattgttttttctaattctgtgaagaatgatgttggcaatttgataagaattgcattgtatctgtatattgctttgggtcatttttaaacagtcttatggaaattcttgtacctgtgtgataggctgcatactagactgtaaaagaacttcgcattggcaagaaatcttctgttgaacaagatggatgaattaaaatgaaattacagtcatgcatcactaatggtctagcttcttgctcctaggctacaaacctgtgcggatgttactatgctgaatactgtaagcagtattgtaacacagtagtaaaaatttgtgtatctaaacatagaaaaggtacagtaaaaaatatggcataagagatattttaaaatgatacacctttatagggcacttaccatgaatgaaacttgcagaactggaagttgcactggatgagtcagtaagtgagtggtgaattaatgtgaaggcttaggacatgactgtacattgctgtagacaaacactgaacatttaggctacactaaacttataagaaaagtaatttcactatgacattttgaatgctacaatgtcactaggtgatagaaatttttcagttccattatcatcttacggaatcaccatcgtatatgcagttcatcatcaaccgaaatgtcattatgtggcatctgattgaatataagattagagactaaaggaactttagcaaatacctagtctaacttcctcatttttacagttgagaaaattgaggttaaagaatttatccaaagcaatcaagcaaataagtgacaaaactgggaaccagttttgacctgcagtgactaagtatctcttgacttgcagtgaagtggggtgctacagactgagcccagcttgtagccctcattaattgcaaatcattgccccctttcagaagccacagtagttcaagcatgatggctacgtcattgaccaatgatcaagggttaataaattaccaatagcagtagcaatatgtgccagatacatggctaaggagatctatctatctatctctctatctatctatagcaataacaatagcaatagcaatatgtgccagatacatggctaaggatatatgtatatttatatctatatacatctatctatctatctatctatctatctatctatctacctacctacctacctacctaataagattgatattattatccttattttaccgatgaggaaactaagattctgagacattaaataacttgcttaaggttacacgtatctgggaagcagcctagttcgaatttagttgcaggtgtgcctatctccaaagtcaagctcttaacaccctgtacaacctaaagactagtgccatttgtatatattccacattagttttaaaaaaaaatcagaaatgcctgtgttctcttttgtagatatactttgcccatacagccctgaagtggatagagagagctaatatggatggttcccagcgagaaaggcttattgaggaaggagtagatgtgccagaaggtcttgctgtggactggattggccgtagattctattggacagacagagggtatgttttctgcttcagttttaagctgtgtgagatgggagtgatgggataggtaatactattggcttcatcttccactttgaacacagaaaaatgttgctgggcatttggttgggattggagaaaagaggccaccattgcggtccacactccctccacttcctcctttcatcaagattgcatctgtgtgcgtgggaggattttgaaggccaagaaagtagcctgtgttaggaaaagaaaaccaaacactgcatgttctcactcataagtgggagttgaacaatgagaacacatggacagagggaggggaacatcacacactggggccttttggagggtgggtggcaaggggagggatagctttaggagaaatacctaatgtagatgacgggttgatgggtgtagcaaaccaccatggcacatgtatatctatgtaataaacctgcacgttctgcacatgtatcccagaacttaaaatataataataaaaaaaaaagtagcctgtgttttggtagttcaggcttttgttatcagggaaactcaaaacctgtctgaatataagcaataagcattctcggagcatctgctatggaaataagactttctccgaagtcacatgggagatacagaggagcctaagatgtgctccatcttttcagtcggttcttagtttagctggggagataaggtatatttccccagcaaaataattaatgcaaattcttggtctaaatagcagttcaagaaatgtcatagggccacacataaataattgccaaatgacaggtgtacactcccaaagggagctgccatggaatgagcttcggcatgcaagtgacaaatcttggactagaatgttgactccctgttaaaacaagcatgaaggagggaggagaacttcagctggagttgtgaggaaagtgcatgagataagagagatgctctttgtttccctacggtgggaaaaaacagaaccagagtgcagttgtgaaaccccactctcagagctgcaggaagggctactgtacttggtgtgtatgcagcctgcgtgaacctcagaactgaatggcaggaagcaggaaggaaatggctgtatcccttctgcgtgcgaatgagatcccacttccttacagaactataagagaagctgctaacgatagacccctcacaaaataatactagagatgcaatgtgctctgagatatattctcagagtaacggaaagccagaaagtgaaatggtggccatcctgaacatctggtaccaaagcaaccaagtaaaagtaaaagaagggagaatgagggtttaacctctgtgaaatcagcagtttcaacacagagggagaagtcccagggaatgaatgggtttctatgcttgggggtaggcattttgtgtcctagaaatatctctttttatcaggataatccatgggaaacaggtttttaaaaatctgttgatgtgctttgggaggccaaggtgggcagatcacaaggtcaggagatcgagaccatcctggctaacatggtgaaaccccgtctctactaaaaatacaaaaaattagccgggcgggtggtgggcgcctgtagtcccagctactcaggaggctgaggcaggagaatggcgtgaacctggaaggcggagcttgcagtgagcggagatcgcaccactgcactccagcctgggtggcagagcgagactccgtctcaaaaaaaaaaaaaaaaaaaaaatctgttgatttgtttatctgtatgatatggttatcagttatcaatagtatggccattttacatccaaggtgagcatattttctttcattcattcatttgttcatctaatcataccttcatttctttattatttgagtatttatttactgaatagttgcaatgcaccagatactgtgctttatatccatgacactattaaatccccaaaggtaagttttgttatctccaatttaaagattaagaaaattgataattggagaggtaaaataactttcccaaggtcaagcagtcaacaagtaccatgtggaactgtaattggaactcaaagatggccatttgcaaagcatattctcttaatagtcataaagatgtaccaccgccccaagccagtgtggatttaacatatggttgactcagagtcatgtgacaaattaaaatcaacttcagttgtaataattataaaaatcataataatgacctcctctgtgttgaacctacttaaaagaatattttaaatgtcggctgtgtataataacagagctgtacatggttgttctcaggagggtaaacgatgatcaaaatggcagatgtcaaccactctcgggtccactaaggatgccaagtcttctcatatttccccacattcacaagggacctctaattttaacagtgtttgattaatagcaccatggtaccgactgcagaggcaaggcgttcaggagatagacaggcaccactgtttcctggagaatcagaccctaaattccccagttcattggcttcagtaataacaagcccttcttaagtcctcctggctctaaaggcagctgctaaaagaaaacctttaatttatctggaaatgagaggtttatggtttggaaaccttgatattacctagaaattggatgtaaataactgagattccaatctcataatattagatcacatggtaactcttagccaatcaaaaggggcaaagtgggatgcttgcagttcctttttggcctaggaaaagacagattcaaattaacatctaaatgtaggaaggaagcacattgaaaattccaatggtaatgctgttatttagtatcaaggaatactgattcctaaagtcaattgcctagtaaagaatcaagaaggtaaaaatataagctatctatttattcattcttttgaggtaacaaaaactaatatgaggtaaaaaaaaaaatcactcttctagggttgttgatggacacctcttaccctagaaggagggtgagtttttctcttggaggatctcagtgacactgggacaattagataatggttagagagagaaggacacacctctagattaaaggtgatgcttgaactcccatgaactcaaatatccctgctggtctttggtttctcactaccaacactggagtttgagatttgctctctagctgaatcaaatagaagtatattaggtgaacaccttgggggagctttaaaagtaaattccagcgatcttgccttgagacagctgcacagtcaggagcttatgtcgttctcgtctcatcacttaattcctgcccgaaacagaatttagagatgatgtctctcatctctaagatgattagagatcatcatgagatcagaagtgacagtttcatctcccctggtcacaagcaagtggcctcagaatttcttccctcccaccaagggaagaggcacagtgacagttgtgtctgagaacagaacttgacacattaagttcaaaaatatcttccacccagcagtatccttcttatgaccacttcatccgggagtaaaattatctttttaaagtggcactggagtagaaatggtttcaaattctccactgcctttagttggtagtttgcaaagtgtttccaacccagcatagtcactgagccagttttaccttcacctctcttctgcatactgcctgtgaataaggccctgtgcatagagcactgtgcatgtagtcctgttccctacacagcacctagaaaatagttggtgaaccagccaccagagaaggtctccttagcattctgtaaaaccgggaggagggaatggccctaccttgtgtttctaggcaggcttgtttcatgcagacattgccctcaagagcaaggtgagaggcctttaacagatgtttattgaatgaattaaaggtggttatatattctggtttgcagcagggaaacagggaaagcaggcagtacattgggaaagggaggctcttcttagccctatttatatcctgtctgcctgtggtcccacctgctgcaagaagctgctgatcgtcccttgtttgctcctgaagggggcagggatgctatagagtcatgtttagcatttaaattcatccagttttctccatttcttctgctactgttttatctcctcaccgtcatctcctgcctgcctcgccctttcacactaaagccacagcaaactttctaaagtgcaagtataactgccccacattctttaggtcctgtactttagaacttgtatatgtacattcccttgcttagggtactctttccatccccacccacctttgcctggctgcctgcttctcatcttcgtttgttattatcttcaggaatccttctctgatccctgcttggctgggctacccactctgtcaccctccctgagtcttccaattacattctttacatccttcttttcagcatgtgctttcatttgctgtgttataatcccctctccctctttcccctcttacttcccccgacctctcctccttccctttccctccaccttttcttcccctccccgtccagtccacctaaccctttctcttcccctcccacctctgcctctctctccctctgttcctgttgaactatgagctctataaggacagagacagggctttatttactattgtatctccaatgcttagaccaatccctgacacacagttggtgctcagtaaatatttgtttgacaaataaatagaaaaatcaggaaataagaattttctaccctgccagattccattgggttatttaatgtaaagattagcaagtaatatttcagtaccattggccctgtttatctacagcttccacatctgaggattcgaccaaccttggatcaaaaatattcaaaaattaaattaaattaaaaataagaatacagtcataaaaaataatacaaataaaaaccaataacttataactgtatttacatagcatttacattacatgaggtataagtaatctagagatgatttaaagtgtacaggagaatgtacatagattgtatccaaatactgtgccattttatatcagggaattgagcatccttggagagttctggtaccaatcccccacagatgccaagggacaattttactcccatttgtcttagaattaaatggaagaaaattaaagccaatgtaaatctccacctactgtctctgtgctggcttgtctccctcgtcttcatgatcccatgaggataacagtctctttgcttctggcttccattggtttcagcaggagattggaagttataaagagaatgtcctcacccagccactgacacgatccttttaccttgtcctgtcattgtgtattttcattacctggaataaatattgggatgctaattaaaagtgtttacaaatataaaatttgtgggcttattgctgctactttgtttgtgggtgggggagagagaaagagtaagagatagggagagagaaacagaaataggagctggtttagaatgcctatctttgcatttcagaaagaggagaaaggagtatttttgtttgaaaagtaaaggtgttataacaaactcccttattttgcacatattttaggaaatctctgattggaaggagtgatttaaatgggaaacgttccaaaataatcactaaggagaacatctctcaaccacgaggaattgctgttcatccaatggccaagtaggtatttgtaaaaataaggcactgctctgcagaggtcatgtgacagttcatggttgatatgctagtgtccaaaaccagaaaccaagaaaatccatgcaatttgttcaaatcttcagcatgaattcctcatgcttttaatgtcttgattttctattcttgtataataattttattgttaatatgctcttttaaataaattcagtttgtttttgaaagaaaaatgcactgtaattcattaaccaactagactcaagctcattcatctactttctttaaaaatttgcattgttgtttactgagcagaaaaggatatttggattatatgacttatagattctgtttagaaaaatcacaagatataggtcattcctagattttagatgacagaaaacagaaactgtgaaaggttagaagactgtgctgttaattgtgagttagtgacacattttcatttacagattagagatttaaggacaataaagaatttcttcctagttgttaaaaaacaaagataaaaaccaaccctattttatttacactggaaatttcacaatgatttatgggagataatatattgatagtagttgataattgatttggagccagccaaatgattaaaactgtgagaacgtaaccatttctaaataggccaataaaaattatgaaccatattgacttcaaaaaaaatgtgcccagcacctgatttatggaagttgaaattaactgagttaatagagtacattgcataaaactgggtaacagataaatatgatctttcctttatgttgtagttttacaaatgcagtgaattttacatatgcataacagaagaacaggcgagcaagatttcattgcctttttgcagtacaaaatgctaattcaagaatattttactcaagcctatttactcatgactattttattagtcatatattgcaatttttaaaccaatttcttttttaatctaatgatctgagctttaattcaacatttcttttcgaagatgctttacatagacaagttaattgctctgcatttcaaaattatttgccgaacatacagcgctatctcttcttctgtattccttagtgtaccactttagtatatcatgaggtaatttacattgatattttcaatgatgaaagaacagaataatttatttcatgcagatattatttgttgtgtgctttcttgattaaaggagattattctggactgatacagggattaatccacgaattgaaagttcttccctccaaggccttggccgtctggttatagccagctctgatctaatctggcccagtggaataacgattgacttcttaactgacaagttgtactggtgcgatgccaagcagtctgtgattgaaatggccaatctggatggttcaaaacgccgaagacttacccagaatgatgtaggtgaggctttgggatgggcgattttttcatcttgactgagtgtttatgagtgttaaatacaaaatatgtttacacacacacacataccacttagccgtatgggtgaatatggaatagagacagacttctccagggaatcatgagctgcaaagcttaccttaacattggaatacggggtaaaaaatagtgttgcgtaatcatttctctttctgagaagtcccaaaatcagaatgaaaatattaaaattttctaaactcctttaggaataagaacttggttcagctgttttcatttcttatgttttagaaaagttgtttcacaacagtgatattataggcaattttaggcatgaatgaatgtcagttgataacttgtgcaaagattaatatagtttcctcccctattattttcagattttacatggggtgtcatatattttcataaatatctttaaaacattgtagctcatgccagctgttaaaagaagtacaaaatggcaatgaaataagcagtgggaaatttattttgactccaggaatgtacaaagacagtatttaaactgggccatgtggtaaatagatgatgacaaaagattataagcctgcaaaaattggcctttgtatgttagtactaccaggatatgttgactaaacttaaattctgaatttagtagaggggcattgaatgttcttgcacataaaatgtatatgttaagattggcatctctggatagctgcttaggtaaagtataggagttcgattggaatttggagagaaggaaatctgttagaagcctatagtggttgtccaggcaacaactggtgatggtctgagtttgaacattgtcatttaaaaatggaatgaaggattatgatattaaaaattattgtgcataaaaaattaagaggattttgtaacagattgcatatagaaaatgagagccagggaagtgttgaagatgctttggagagttagaaattggttgggaagatgaaaaaacatggtttctctcatttaggaagaagctaaccaactaataatctgtataagatacctattttgcccattctctttggcttaagataagtataatttaaaattttatgtatttataagattctctaaaaattaaagatatacttcacaataagtgatatgcttatgcacaaccttagactttatcatccttttacttcaggggtatttattgacacattacaggaactgaagatacagtggagggtaaaacaaatatgatatctgcaaagccaaggaatctagtgcagaacacatacattactaaaaaaaaaaaaatcatccaggctgggcatggtggctcacacctgtaatcccagcactttgggaggccaaggtgggaggatcactagagcccaggagttcgagtccagcctggccaacatggcgaaactctgctccactaaaaatacaaaaattagctgggcatggtggtgagtgcctgtaatccctctgccactcaggaggctgaggtgaaaagatcacttgagcctgggatgttgaggctgtagtgagccgtgattgtgcaactgtactccagcctgggtgacggagtgaaaccgtctcaaaaaatacaaaaaccaaaaaatacatcacccaaataaatgtaaaattgtatctttgacataaaaaggtagaaaggaatttgaaaatttctaacccgaatgtgaggacactatattttaaactaaaaagcatagcagatactttgtgtatcatttatattgctactatattgtatgactaatacaactattgaaggccattatcaaataattttatattaaattatgtaagtaacattcccattattacagtgccatctactggtatatatgtggtggcttcccagctgccagttaagaatttcttctaagagtggatgttccatgctgttaccacaaaaatgataactgaggtaatgcatttgttaattggctagattcagccattccacaatgtatatatattttaaaacatcatgttgtatgcaataaaaacatataatattgtttgtacattaaaaatgtattttaaaaggttgaagatattcttaatttaaaatgcaattaattgtggttcttctgtaaacaaaaaataagaaagattatgtctagtgtgaggtatttgtttaaacactatagctaattctaacatgtgctttaacatggattaattcctgaggacattatgccaagtgaaataagctagtcacaaaaagacacgtactgtacaattccaattatttgaggtatctagagtagccaaattcataggaaaagaaaggagaatggtggtttccaggggatgtgggagaggaaatgagaagttgtttaatggacatagagtttcagttttgcaagatgaaaaaattctggagattggttgtacaacaatgtgtgaatgtacttaacactactgaacttagaaatggttgagctgttaagttttctgttatgctttttcaccatgataaaaaagaactatagctatgttaaaaattcccttgctgtacttaaggctttaatttgggacaaagggccagagactagaatgaatcttaatgaccctgatcaacaatgataagtggagactcattgtaaccagaacaagttatttgagtttgccaccagtaggggaagacattcattctaatctgtcaaatccattgttcgtttacaaaaagagtggtctgtgggaatgtgagtagccttgattaaaacatccaacttcagcctccttagctttagtctctaaccacctgagatagaacgttaaaacattcccttgcgtattcaatacttgcatgccttctcagagcagttccagtggcacagagaggtaggtttggtgaaggtgggctcagaaagatgcccacttactgttagtaggaggcatgaaaatggaggcagctgataataaatgactctttcaaaaatgtggctaaaaagggaaggaaagagacaaggaggagctagaggggtcacggggatgaggaaatgaagatgggagagaggttatagtagacagagggaacaaagctagtggaatgaagagagggaagatgtaagagaaagggggtggtcgttgatggatccaggccctagagaaggcaggaagggtgacatcaggggcacaggtcaatattaaataaggagagaggggaaagaaggtgggggactaatgcaggcaaatgtgttggtggagatgggaatgtggggagactcttatacaattacctcaaattttgaaaaatccttacaagaacttgtgaatttgatctaccccttattactgctgctcaaaagagtaggaacctaaggcaaagagtggtaagataagttactcgagtttagtctataagtagcgacagatgtactaaacaaggaaaattccacctttctccttcatggggctaggacgacaatcagcccacattctcccactctgcaactgctgggtgatagtgggccttgctgggacctcatgccactatgctcccattctaaggtgacgttccctcctcatgtgggctttccttgaggcaggtgtgtgagtcggtggctcactcataacttgctgagtagctaaagagctgatttagtgtaggaatgttgtgtaaatttcaagccttgtcctttcgtaaatagtcattgcaaagacaaagaaggtgtatttaacaaacttgaattgtttccaggtcacccatttgctgtagcagtgtttgaggattatgtgtggttctcagattgggctatgccatcagtaatgagagtaaacaagaggactggcaaagatagagtacgtctccaaggcagcatgctgaagccctcatcactggttgtggttcatccattggcaaaaccaggtacatactggagatgttacacagtctttccttggctggaatctgcaactgttttaattgtttgatgtcatgcagttggcgggggggtggaggggattttgtaactttcactaactgtgtagatgttaagattttctaagatttaagtttgtttaagacaatctggtagtttggtaattggggctttatccctccaatttcacctcttttcttgaacaacttttacttacctgctgcatttcgaagagccttgggttaaggcaggcaatttagacaccggcagtggaagcttctgtcgacacttggacctttccatacccctgaggagtgagcaaatggaaaaggcatttcacattttatagtagctcttctttctgaattgctctttgtcagtttgactagatgatgagtcaggaaataagaatcacatttgactaaagagcttcttgaaaaaagtgctggctatacccagtactaataaggtaataacattctgggcttatcttagaatcagtggctccttgggggaactcttctgaaatagctattgatataccctctatttagatacactgcatttctctccctaaaagctatagctccctaaaagcaagctgtagacttgcattaatggcatccttttcatcttcaaacccacttgtgaatttgtttcttttctctactaggagcagatccctgcttatatcaaaacggaggctgtgaacatatttgcaaaaagaggcttggaactgcttggtgttcgtgtcgtgaaggttttatgaaagcctcagatgggaaaacgtgtctggctctggatggtcatcagctgttggcaggtaatataataaattatgtggcaaattacctaacgttggctcagaaatacagctgtacatcaatctttatgcttttgctgattttgaatattttggatgttaaaagttctcctgtttttaggaatgctaagaatttgtttgtttatttgttctcttctgctgagttttgagttccttattacaggcaaaattcaattgacctctagtggtaacagtcttaagctccaagccctccacctccccatttatagtggagtgggtcccaggcttggaaataaatgccaaaatgctatcacctcacaaaaatgttcagcgatattttgtttagaagttttatgtcctcaattttagaggtagtagtatatgatctcttatcacatgacaggtcttaataagaaaatcaaagtcctttataaaaaataacttcaggatatcagacaaatgtgggaaatccagcctgagaaggcttgtgatgtacttttttacaaactagatatgactttgaggaagaggaagagtaaaccaagtgtgaggtataaccagtagtacttatttgcctcccttgaatgtgcacccaaacaatctgggcatctgtggattcatcccttgatatctttctagcagaaatataccaaagataatttacattttattaaattttttaaaaatttatatttatctggtaggcatggtgtaaatataagtaaagtaacagattgatgaaaaataaacaaaagttatgcaatgaaaaaaagaggctagtttcagctcacaattcaaaatttacttatgtttttcctctagctaaccatcataactttagtatgcactgaaagaatttatatgcatttcttattttattacatagagtgttaaaaagctgtgtagtcaatggtcaagagttttaaaaattaataattcttattgattcacaacaatcttcttgtgaaactgggttttatttttattttttgagacagggtctccctctgttgctcaggctggagtacagtggcatgttcatggctcactgcagccttggccccacccaggctcaaatagctgggaccctaccttagcctcctagtagctgggaccacaggcatgcaccaccatgcctggctaatttatttttatttttatttaatttatttaaattattaattattaatgtatttaaattattaatttattttattttatttttattttttgtagagacaaggtcatgctatgttgcctaggctggtcttgaacttctggcctcaagtggtcttcccacctcggcctcccaaagtgctgggattataggtgtaagctaccctgcccagccaatttttttttctttttctttttcttttaatttttttgagacagggtcttgctctgtcacccaggctggagtgcagtggcaagatctcagctcactgcaacctctgcctctagggttcaagagattctcctgcctcagcctcccgagtagctgggattacaggcgtgcaccatcatgcccagctgatttttgtatttttagtagagacagggtttcaccatgttggccaggctggtctcaaactcttggcctcatgtgatccacccgccttggcctcccaaagtgctgggattacagacatgagccaccgtgcccggccttttttcttttcttttcttttcttttttaatatgagtgtgtggcagtgaagagctcagctactggtagagtttgctgtcatttcctttttccatactaagacaccagctgttgcccacattccttttgccatatcagtacaaatgtgaacatggtggaaaaaggcagttaactttatagtattattatgaaaagaattatgactttagggacattctgaaggatgagcccagggttctgtggatcacagtttagaaaactgctgtcttacagaatccatttctcccctgttctgagagtgggcagtgcgagaatcttatgcctgtattaaatcatgactttttaatgtcctttcatattataagatgtaggtaaaatcaggctaaaataagcatgaaagcagcataaaggaggaagcatgtgtatggaagacaagttgggaagatcatctattttgtccttaataaccgtgggctgtgattatgagctgatcatgtccctgagggttttggtattttactcttgttttttgccagtacctgaaagagtcctatctttcttccgtactggttccttatcccccgaatcattaagtgctcagtgaaaatgagagggtgtgggatagcagggtgaggtttactaagttaccaagaccctgacagtttctctgaatcctcttactgtaagaatgagtctgaactcacaaccaatgaatagtcgtaaacataaatgaaatcaaactttttttttgaaacagaaaagctaaatttaattgcatctattgaccttcaataggtggtgaagttgatctaaagaaccaagtaacaccattggacatcttgtccaagactagagtgtcagaagataacattacagaatctcaacacatgctagtggctgaaatcatggtgtcaggtatgaataactagttctccaatatacctttggttccaacagtttccatcctaccaatgagaaattttgaattacctttctaacttaatattgcctaagttctacacaaggctaatgaaaccaaaccttggactcaagtctgtctcttctgaatgatgtgcctgagaaagatggctgcatattagtctggacataaacaggacaccttgagagtctttgggtgtgagtctttgttctgtgaagaaacaaagtaacttggaaacaaaagtaaaacacaggacaacatatttgaatgtatttccatccacccctgatatttttggtatttggtccaccttgctgtttttctattagcctgaaaagttgatagtaattgataaacaaatataggttgagcacttcaattgctgcagaaagtccacaaacagcaaatgttggaattcttttcttctgtgttgcacatttgtcactaaaatgccaaatcatgtgttcagtatgtaacaactttagggaacttaagtctttcttgttccatattcacctaggaggtcagtggtttttccagctgggttcagctcagccctagagcttctgcaaaccccatcctttcactttaggtcactgcccttcaagcagtgcaatttgactttgaaacattttatttgtttgtgttactaagtaacactttaacaagatgtatgtggcaaaaaaaaaaaaggaaaatatttcaaaactccacattaggacttttaaggagatgctttacccaacttttgtggtctgcaaactactttgttgatgtacgtggctctgggtacctcttacctcaccttatcagtgtgatttttttataagatataaataaggaggttcataattttagtaataacaataacatttgcagagaatgttagattatatatacagtcatccatctgtatccacaggggattgattccaggattcccaagtatatcaaaatctgcacatatgcaagtcccaaagtcaccccatggaacccaggtatacaaaacatcaggcatcggtgtaggcaggtttcacatcccaccaataatactgatctgtgttcagttgaaaaaaatccaggtataagtggacctgtgcagttcaaacccgtgttgttcaagggtcaaccataatctctaatttgatcctcattacaaatcagttcacagatatgaaagcagagagactgagatctattaagttagtgacttgaccaaaggtttttgaaaattatgaccaaataattaattaatgtgaaaataagacgttctggaaaacttcattaacattaggaatatagtgtgtttagcaatttatttggcatacactgtgctaagtgctggggataccaagatgagctaaataccatcccagtcctcaaggccacagttagttgtggagacaaacagcatgaaagaataaaatactttaaaccaatgttagggatgtagagaacctttgcaaagtcaccaggaatccctagagattcatagagcatattttgaaagactaatggttgagggactgaaagactaagataaatgacagataggtgggaatgggggagtgattaagtgaccaaagtatttgtgaatttggcttaatacctggagcctagtacagaatagagggagctgattgtcctggtgaaaaacccctcatctttccatacctggattgtgttctgtgttgtcctagcttgtgaagtcttacttccacctaagtcaggcttgggggtctaatttctgtttcagagtgagatttcacatcaacaaagtgtctatggctaaaagacaatgtgaaaactccacattaggattttagagtataatctaaaattcttaacgtggccttttgggccctgtatgaaacaacctttagacacctccccagcctcaacaagggctcaccagccctcttgccttcggctttctgtggcctgcttccctcatcctggccttgtttctaacagacatggacatgtgtgctagttgttttttcagcccatggtgtgtttcttagcccttcaacgtcctgtgtgtccttcgccctctggctcagaaagcctttcctagttcctgaccgggctagggctgcctattacagctctcttagaacctcacttctgccccttgatcacattcatcacactgtacttcaataactaattatgcaaaacagcagagcctttgtcaatagcagagccctattcttcaccactgtatttttgcctctcaggaaggcctaatatgtagtaggtactttcaaatgaattatattagtttcactaacaggaccttgggtctcttctagtgtgataaggttaattcttatttaaattatcacaatatctttctttgtcatccttatttaaatatgtatcaaagagagtttgatcaaatatttgactaaatatcttgatcaaaggggttttttttaaggtcactttttattctagtccttagaaccatcatgaaaaatagacctggcagaaattgtcactgctgttttagagaagaggaatgtgaacacaggcatttatttcttccagagcttctttgtggcagaaacaacaacaacaactttggctgtagcctgtccctcctacaactgcataactattgcttttcattacgcacagctgccttgggtttgcatgttaccaagtaaatcctgaatcatattctaatttaagataattctgcaagtgatttaaaacatcttgggtaatcggatactgtccactctacactctgagcagccttgtgatttgggagctagtcttccaaataaatgctgaattaaatggataattgatttggtctgatcttatccatctctaagagtcatgagtgacaggagataaccaagcaagcatgaaaggcatctgctcccacaagagaaatcttctcgctcaagtagctaagcaaatcaaatgcaattacccaatgtctgcattcacatgccacctgaatcctacttagatcatttaactttctttaatttatcggcaagtttggagggctttttaaaaaatctcttctgtactaagatgagcaagcttaccagtgaatagacagatgataaattatatcctactgtggtatgtcagattcccccaactccaaaaaggtagggcagagtggcatttggagaatgattacatacataagtaaagagaaaaaaaaaaaacctgctcatgtttatggctcaacatataactctgttccccagggcacttggatttcaatggagtatgaaatgaaatgatccatttactgcacttaacttgtatggttcatgattttgtaaaagtgccttgaggtgtgcaagtcactacataaatcttgataataaacacacattgtgacatacatattctattatatatgatattagtaaattgtcagtaaatctttttataattgaatttctttgccatgttggtgcacagatctacttgctaaatattagtctgtgtgtctttgggggataagaatagattgactccttttgttgtcaaaatggttgggaagtttcaaaacaagcaacagacctttcaaatttgagtctatttgcttctagcaattttataatttacatttgcaaatgcttttaaaaattataaataagttcatatagggttccttgaacacaccagatagtgctttaaaactaaagttctttgagggcacataaacagaaacatggctatgggactttgggactatgcatctctttttttttctttttttgacagtgtctcactttgtcacccaggctggagtgcagtggcaccatcttgtctcacggccgcatcaacctcctgattctcctacctcagccccccaagtagctgggactatacaccagttttcagtagagacagagtttcaccatgttgcccaggctggtctcgaactcctgggctcaagtaatccatcctcagcttcccaaagtgctgggattacaagcatgaaccactgcacccagccagctatggatcttttaatgcagtatagtttataggtcaactaagcgtttctatttggaggttaacctgtcccagaacttgggaaaggaagtggtggactgttctgtagaaccagaagattaaagtccgttttcttctctaaggtctagaaataactgcacgggattcttgctatttgtagatcaagatgactgtgctcctgtgggatgcagcatgtatgctcggtgtatttcagagggagaggatgccacatgtcagtgtttgaaaggatttgctggggatggaaaactatgttctggtaagagaaaagggcaaattcacatatttggacaatactgaaccagaaacattttttctgctctttctgactcaaaaactccagaaggatttatgtaatcagcagatttgaataagttatttgatgttagctaaaaaaaaaaattgaatgacatgcatagaaaatgagacatataaatatatttacacaaatacattgagtttatagtaaaatttatggttacacaatatatgcagttgtcattaaggggaagaatttataattagctttagaagcatgaatttgagttcaagtcaagtttatgacttcaccaattccaatgaaaacacaacttttttttttttttttttaccccagaagcttaggtcataagttttagtcaaatgaatagattaatggatgggttcctattttatattaatagcctcaaaattataatttaacgattgctggaaagatctcagtccttatggtctgaaactctggcagaaagtgatttatttacatatttgcctaatcggataggtgggaactctgtaaagactaattcagcagtaacttgtgaactttatgtccaagatgcagggcgtgcctgatgttggcaacagcacctgtaaaggactgaataagaattgaatatacgattatgcttattctttccaactagtcccatttatatcaggattgcctaaatattgcactagttcataattttgcccacagatatagatgaatgtgagatgggtgtcccagtgtgcccccctgcctcctccaagtgcatcaacaccgaaggtggttatgtctgccggtgctcagaaggctaccaaggagatgggattcactgtcttggtaagaggacacatgtgctggggaggagggcagaggcaggcctcagaaatcgggaaacaatgtgggtgcatgagcagagggaagacaggatataattggggtgacacacatgtcaagatttaaagagttgtgcgacctgctcaaactgacgtatttccattcttggtgaacagtcaagtttgtgcccttgtgttattactgccctagtcagcttcaagcccctttggaggctgtttactcctctgcctttctaattctttctggggtttgagtgacaccagtgtctcatcaatacttcccaccttgagccatcatggggggagttggacagcatttacttgtcagtgaatttggtaagagaaatgtggtgaactgcagagctgatgacagtttgttggaagtcactgctgtgtgtataaagaaaaggaggtgtggcttgtcaaagggctcctctcacatttcttgataagttcaataggtgggagagtcaagccactgacgttgaaatacaagtaaagaatgattcaaccctctttcgtaatccccgtcctctggcaaggtctgggtgtggcacgttggattgggagttcgcgtcgtggatgtctcatacgtttccaggtgtcagtagcatcgcatcacgtacaagtgaaaacctgcctgaagccgtctgaggcacggtgaagtgattatctgaagttttacagcgctttaaaacttctctttcagtattttctttccctccttctgaaaacctaagaaactgataagaagctcaaatgatactgctttctcccacttgctaaggttaaagatgaaatatcaatcataactatcaatcttttgaatctggttgatttaaatcagacctttattggattagttttgtggaatccacagacatctgtaaacactcttttaagcacatatttggctgtcagtcaggaaaatgtcactgctctaattaagcaggcccatagataatttagacaagctgatttcatatttaatttcctttgaagagaaaggaaggtatctcttcttggatgtttaaactcgttaggctctggtttctcacactgttactaactcatctccttccagtatcgagcacgcaatggggtgtgctcaccctgcctgcatggttggcacggagtcctcaaactccatgaaagcagtgggcttgctcctctattctctctcccccagctcactcttactctctctccccgccccatatatatatgtagttataatacttcgaaccttgtctggcacataaaaagtgctatgtaaaattttatccttattattattaagagtagttgagtttcttggtcaagcatacttctttgtctttgctttggaaaagctctctctttctctcaaggtgatagtttattgaaattatatcaggaactcataaaagagtcagtttgggccatctgggatagcaattcaatgtgttaaatatttaattggcccctattaagaataaggccacagtactggaaaccctgagaaatatcaggatgaggaaggtagtctttgattgcaaggaaaacgtgacctaaaagaaatataactgtgatcagtgatgaagaagagtgcacatcataagagaagtaaaaaccacaatgaaagttcagaactgggagaaatatttgtttgaggtattgggaaagatttcagggaggaagtgtcattttggaaggagcatgggggataagtaatttcatttgcagaaatgtgaagggatgggaggagtccaggcatgaacagatcacatgactgccattaagggtagagagtagcctagttgagcactaagtttaggttatatgaggggaagaacagaaactaaggctgataaggtagtgtatgccataacaaaatatcctagactggatggcctaagcaacagaaatatatcctctcatggttctggaggctcgaagtcctagatcaaggtgctggctgatttggttttgggtgaaggatctcttcctggcttgcagatggccacctgctcactgtgttctcatatggccttccctctttgatgtggagagagagagaaagggagacagagagcaagagaacgctctagtttctcttcctcttttgttttcttcttcctcttcttttaaggacaccgatgctattggattaggaccccacccttatgaccccatgtaaccttactttcctcttggtagatgctttcttcaaatacagtcactttgggagttagggctcaacatatgaattggaggggcagggacacatttcagcctgtaacagatgggttgggttacctctgcggaagactaaaatctgagggttagtcactgaggtttcacttctccagtgaaactggctgagggtcagacagtcagtgttgtcccaaagtttctactaaccacattacaactgtaaaatgaaacaggtgaaatgaattttagcaataatattttatgtattcaaatatatccaaaatattaacattttaatatcagtgtaaaaattattgagatatttaatattcttttttattttggtactaagtcttcaaactctaatgtgtgttttatactcacagcacttcttaatatgaactagatgcatttcaggtactcaatactctcaaatggcgaaggctaggaagttggacagcaaagttctaggcaacagggagccactggcagcatttgagtaaagtggtgcaatgatgggtttatcatcgttgtgctggagggagaataatgtggcactggtgtttaggcatggcgcggaggaaacatgggatccaggaatgagtaaggctgttcttgcagtaatgtaaaattgagaggaagagaggccctaaatgttagggtggcagtagctgagaaagaaaaaatggtgggtagttgggaaagaaaggatgacttttctgatatagtttattcttatataaaaagcaaaactgttgtatttgatataatatgtatgtcaatgacaggatgtctatacaaaagagttaagtatgaatctttaggatctgaacttttaaatgtttgcctagaggttgtttattaatctccaactttgggaagtctcctttccttcaaagcaggaagaaagcttccagcctctctcaggagcttagaacacctgcatggggctgggtgtggtggctcatgcctgtaatcccaacactctgggaggccaaggcaggaggatcacttgaggccaggagtttgagacagcctgggcaacatagcgaaacactgttctccacaaaaaaaaaattaaaaacaaacaagcaaacaagaactaaccaatcatagtgatgcaagcctgtggtccaagctacttggtgggttgagctggaagaattgcttgaccctaggaggtcaaggctacaatgagccatgatcacaccactgtacctcatccttagcaaccaagcaagattctttaaaaaaaaaaaaaaaaaaaaaaaaaaaaaagacagagagagaaagaacggaaacaaaaaaggaaaacaacacgtgcatgggcatgcgttgtaggacctagttcatctctccaacattcatgaaagtccccttaaacctaaaaatgtatagggctgtgctcgctttggcagcacatatactaaaattggaatgatacagagaagattagcatggcccctgcgcaaggaggacatgcaaattcgtgaagcgttccatatttttaaagtcaggaaacaacaggtgctggagaggatatggacaaataggaacacttttacactgttggtgggactgtaaactagttcaacccctgtggaagatagtgtggtgattccttcagggatctagaactagaaataccatttgacccagccatcccattactgggtatatacccaaaggaatataaatcatgcttctataaagacacatgcacacgtatgtttattgcagcactattcacaatagcaaagacttggaaccaacccaaatgtccaacaatgatagactggattaagaaaatgtggcacatatacaccatggaatactatgcaaccataaaaaatgatgagttcatgtcctttgtagggacatggatgaagctggaagccatcattctcagcaaactatcacaaggacaaaaaaccaaacactgcatgttcttactcataggtgggaattgaacaatgagaacacttggacacagggtggggaacatcacacacaggggcctgttgtggggtggggggaggggggagggatagcattaggagatacacctaaaataaatgacgagttaatgggtgcagcacaccaacatggcacatgtatacatatgtaacaaacctgcaccttgtgcatgtgaaccctagaactttaagtataataaaaaatatatattaaaaaaatatataggtctctgagaacatatagcatgacagaagctgatgaagctcctcttccaaaggctgtccaactataaaaccctctttttctgtaccccacttttctctcccgtactctgtcttttctgacagatattgatgagtgccaactgggggagcacagctgtggagagaatgccagctgcacaaatacagagggaggctatacctgcatgtgtgctggacgcctgtctgaaccaggactgatttgccctggtaggttggtgggtggtctacagtgaaggggagggacttggctcggggatattctataccctaatctctatttgcattagagattctaaaaatcattcagttcaggcaggctgcagagctggctttcctgattaggacgatgctgggcttgagaatttgaaatggtccaagttttcttaatttaatagcatctggaataaatccttttttattactcacaatccaataaagatgggaacatgggtatctctcttcaactgtgcaactaatctcactatttgtaatgtcaatttgtggggctgctggataagttttgcagggctaggcaggtcggtgagaatgtctggactcagcattttaaatcactttcaaggattttaaaatattactttaaaaaggcagtatttcttgttctgaattagaactccagctctcttctctttcttttctcaatattcataatggttgactcctgcttcctgaatcttcttcccataacagcagtaacatctcaccatcagcaccccagaaggggagctggcttcacctagaccctggagaccaggatgggggtctttcccatcactgcccactttttgcctgtcagccctataagcagaaaacatcctaagaagaaaaattctgtgcttacttggtctctgtttttttttttttagcatattatttttctcaaataatttgctcttcttaaaggtactgaaaaactgcttatatttatgtagtcagctgcacatgtttaccttttaaggagcagtgaaccattcaataaaagagactttactattatattttggcatgccctctgttacgggaacattttcttcctgccagagttgctacagtcttgtccttgagggctcctctgaaggttagtttttagaagaaagcactgtgagaaaaaattttcgagactccaggatattggaggtaacggactgcacattgatgggtaggttttaaaccatagagttaccagttgttcagtgagaccttgaagctaactgtcacttcacatggttagtgtatgtttgtgtgtgacaggtttgtttttatgagatcagtgactctgaattcacatggcgacttaggactgggtgttcttttacctgcctccaatatgctttatgtatcagataatactgagcccaaaggaagaacggctggtttcatagtgaatgactaaggtctagctaggaaagtgaaactattgtcccttctagtagttcttctgtcactaaaagatttatgtcacaaactattcacagaaactagttcctcatattgatacttgaaagacactaatccattcagaaagtaaaagtaatgtcttgggttcttttagactctactccaccccctcacctcagggaagatgaccaccactattccgtaagaaatagtgactctgaatgtcccctgtcccacgatgggtactgcctccatgatggtgtgtgcatgtatattgaagcattggacaagtatgcatgcaagtaagttaaactgtcttgctgatggcacagagagatgctattcagtccataacttgtagctaatttgtaaaatttacactcaggatgtttttctgcaattaggtgttcttttggaaaaatataaacatacacatatgaaccacgtgtgtgcacttcattgcatgctccttgtgtatcacgatgcccccttctagttaccggtgataagtataaatctaaggagttggtgatttccccttttactgaaataatttgatgttactactagtatagtctagggattaaatgtctcatcctggttgaaaaacttaggtttgtgagataattccttaaaactttttttttccatcaaatgtgctttatattatgtgtgagcatccgtgatctgtttctggatttacaaaagtttggtacatattcacactggacttcttgccagagtccaaaaatatttttcttcaaaactaatcatatgtatattttttcttcacttcctaacagttgacttttacattttgttgttcagtaacaattgctgatactgcagctgctgctttttgctccctttttgcccccataagggtttcacagtgggtaacgtgtcaacctggaaaggagatttgaggaagccctaaaactatgagacattcccactgtgctcactccgaaaacctttcctgtggaccctttaacaaaacccaaacccacaatagccagttctgcctcaaattttacttttaattcatttcatattttcaaggcaataggaggaaactgatagataccaaaaaactaatacgtctcccagggtcaggctcctgatccattgataattttctctgtgcctgagggaggggtgatgaaatagtctgatcctcacaaatagctactataaccttaaagtcttctcttatttcatcagtaataatgaacagaataactaaatttgtggaagagtaagctatattctgtgacaaagtgtatggccttgcactagaaatcatgtccgcatgacaaaaatagtgaaaaattgctcatgaatactagtaaaaatgactcagtccttatagaattctgttttcatattcatatttacatgctataatttcctaacctatgataaattgggtatttgcaatagttattgctagttttaatgttaagaatctaattggttttgcctgttcattgtttctgatcatcccaaataatgaaattacaaaaataaatgtccgaatgtattaggtcatggttgttttcctccatgatactttagactataaaaatcattataataatataaagggtactacagggttacatactgcatttagaacaatgttttcatttggatctgataacatccatttattaaatgattgatgaactctttaacacactgcttttctttctgtcattaaatcctgatgaaaatatcatatttctctgataatgttttaaacatgagttgctacaaatgacaaactggagataagactcaaattgaaggaccttgaacctaaagcaatatttaaaatattaccagagttcacagtaatctggatcataaccttgtttttaaattgtatatttaataaaaatgtggtttaattaactattcaacccttgcctcctcctgccctgatgacctcaccttatcttttattaattccttaataacaagtctctaggaagtgctttacccatccaacttttattagaaacacttcctaggcaggtgtcattctgtacagagtgctcttcatgctgtaagcaggttttggaagagccagctctttcttcctttcttagaggaactggaagttcccctcagccacaagaaaccacagggtgcccccggggtgatgcagaggaagtgagagttgggagtctccatgcccaaggtattcctcgaagatttcctggtttggagatgctcaggaggctccaaaccttctgggctcagaggaggtcctcgttcattctgtctttcagccaaacacccttctgaacaggtcttctttagaccaagaccccccaacatcagtcctgtgaaatgctttttaaaaacaggctgtatggtcaaatcacgttgagagatgcatcatactctaccctcaatttttttttttcaggagaccatcgtcttattattactcaaattggtttccctgagcattcggggagcagagtttttaaggacagcttggtgggttaggggaagccagtgagccaggagtgctgatgggtcagggatgaaatcacagagagttgaagctgtcttcttgcgctgagtcagttcctgggtgggggccataacttcagatgagccagttaattgatccgggtggtgtcagctgatccatcaagtgcagggtctacagaatatctcaagcattgatcttaggagcagtatagggaggttcagaatcttgtagcctccagctgcgtaactcccaaaccataatttctaatcttctgtctagccctcaattcttgattcatagtatataccacaacacattaaaaagtcttgtttaccagcccgggtaacatggtgagactccatctctaccaaattttttttttctttttttttgtgatggagtctcgctctgtcgcccaggctggagtgcagtggcgcaatctcagctcactgcaagctccgcctcccggattcacgccattctcctgcctcagcctccagactagctgggactacaggcacctgccaccattttttatatttttagtagagatggggtttcaccgtgttagccaggatggtctccatctcctgacctcgtgatccgcccgcctgggcctcccaaagttagccaggtatggtggtacacatctgtatttccagctacttgggaggctgaggtgggagaatcgcttgagcccaggaagctgagattgcaatgagttgtgatggcaccactgcactccagcctgggagacagagtgagaccctgtccataaaaaaataaaataaaataaaataagccttgtttatctgtattgagtctagaatgtctcaaaattatttggctatggaaaggcaaacttatttggccacagaatcttttgtttggtttaacagaagaactaattcataaccaaagaactagtatcctgtgtcctcctcccaccctggaaaatgctgaatgactattctgggccttataagactcagtgaggctctactattgcagctgacttggatctccaggactcttggctaagggactgacatattcctcaagaccccagactttctgaaaggatcagaggtgtggcccattaacatccaacagtttaaaagtggtgctgctaggcattgatagtaaatggctgtaaccaaagatagctagaattaaaacagcatccaagaaagcctgcaagaatgatggtcctttatgcttttgcactcagatcctgatatctcttgcatggttagttccagaagatagcttttcagaggtgaatagagcataaaactctttttggaagcagcatggtatagtggaaagaacataggctttgaaatcagagaaccattggagtcaaacctgtcactcatagctgtgtgacgttgtacaaactccttgagcctcagtttccttatccataatacaggaatatgccaccaaaaataaaataagtaaaagtgcctagcaggatgtcaaacacacaagatggttaacaagtactaatccatttccctccttcctctgtgagtgagttgcccagtccctctgaccagctaaaggtagagacaggcctagagcccagatcttctggagctttgtccagtgttttttccatgctgcctcttctcactatgggcactggtgtcagttctctgtatttttattccgttaagtccttttggaataaagtggggacatggatgaataaatagttgatccagggaccaaagggaggaatttttaataagtgggcattacagagtgtttaataggatgtttttcaaagttgatgcttttgcaaaggataatagaatacagatgtttacctgagatcttaattgtttctagaaatgcacattcccagtagatggcagcattgcttcatttacttcaaaaaagttcagcagttcactctagtgacagtttcactaatgggacagcagggtgtttgtaggtgaacgtccctttttcctccatatagctttttctctcattgaagaaaataggcaaatgcctgtatgtatgttgtactgggtcttcccttgcactagtagtgatttttttttttaaaggaaaaaagttttctctgcagactaggttatgtgttctgtttagaaactgtacacattcttcttttatagcctggtttcaagtgaggaactctgccttcaaattctcctttcctttcacctatactcattgcaatctggccaaacatttgtttccaaaactcccttggctcttagggcagagttgctttgtgttggttttaaaaggtggctcctcaggattttagcctaacagaaactgatctttaatcaatgtcctgtaatgccttatagaggcagtatgcaaataatcccccataaatcccagagcaaacagacgaaagggagaagtccatgctgcattaacttgtaaatcatagcgctttcaactgacccctgatggattttctatatgtttctaaagagctgagtctggaaatgcagaggttgagagacagctgaatactgagtgtcaaaactatcagcgtttttggccaggcatctctgatgacctctgtttgtgtgttgtcacagctgtgttgttggctacatcggggagcgatgtcagtaccgagacctgaagtggtgggaactgcgccacgctggccacgggcagcagcagaaggtcatcgtggtggctgtctgcgtggtggtgcttgtcatgctgctcctcctgagcctgtggggggcccactactacaggtgaccctgtctttcctttggtactggaaacctctttctaagacctcccaggggaatgcctgtctccttgagatgagatgtatgaaatagtacctctacatactacatttaaaacgtgaaataggctgggtgcagtgacccatgcctgcaatcccagcactttgggaggccgaggcaggcagatcacttgaggtcagaagttcgagaccagcctggccaacatggtgaaaccccgtctccactaaaaaggcaaaaagtaacaggcgtagtgatgcacaccagtaatctcagctactcgggaggctgaggcatgagaattacttgaacttgggaggcaggggttgcagtgagccaagatcatgccactccactccagcatgggcgatagagcgagactccgtgtcaaaaaaaaaaaaaaaaaaaaggtgaaataacagtacaatttttactgttagctcaggatttcattgctctgaaacatcagtgcttttacgttttccttgttccattccagtcattgtccatacaccttcatagtatatgtgttatttatcaatcacaatatggttttgcgttccactctctttgtttaatattatatgctccccccatagcctgcataactataatttttcattgctgccttccattgagttgattttccacaaaatattaactgtcataaaagaaaatcaatatcttccctaatttggaaggaaatttctggtcctcagattttgtgcttttaataatttcaagttaacaattaaaaactgtagacaataacatttatacatttaattctttaaaactaacactacattagggtgcaggcacaggcatcacactgctcattttctgttttcttagaaagtaggacagcttcctctattatcatcaatattgaaaagcattttatgtacggttatagtttgtgttgtacaaaatcagtgagtcataaaactttagggctgaaggggactttatggaattatctagttcaatcttatcatttcatggctggaggacctaagacccacttgactaataggtcccaattctctgagatgtacaaaatatctgccaccatctgtagataaaaatttaaccacatttatgggtactacacaaccactcaagtggcaactgtcttgtgttctggaaaattcaacatatcagccaagatgtacttatcagagatcctgctatagcctagtgtagtggttaagagcacaggctctggaatcagattatacaggttcaaatccaagttagtgtctaaataacaccagacatgtgtcctaacctctgtattcattaatttcctttactataaagtaggaacaagaatagtacttatctcaagggttattgtgagattaattgggttaacctaagtaaaggctttagtgtaagtctggcatataggaattaataaatgctatctgttattttgattttttatgaactgtaaccttcccccaaaagagtcatatgctctaagcccttttctaccacctcttgagagacaagattcttaggcacaaacttgacattttaattcagtagtccatcaataacattgtaatttttagcctggtgtgtaatcaatatcttggatatgtgtagaaagaatattgaatgatcaatggttcatcccattggatcattgccaaagggcaggaaaaaaaaatggaaactagaaacttaagttcatgcgtgccataattattaagtgttttttcctatttgttgtgttatgatatagtatgtcttatgttctgttggcatttttcagagatctggattgaaagctaacggcaaattgctggctttttaaacttggaattcaaagaccagctcagctgaaagatgactatagactttacatacatataagagtatcttcaacctcagactctcatactccaaaaatcagaagtgaaaggactattccttcaaaaagaaagctcatcagaaccctttctttttctcttcactgaaatgcatccagagttgtacaattcttcctgagtgaatctatggttatttacctaacaattctgatcagtgtacctgcttacctctccgcaaagtttcagctatgtgcataactacgtttgcactatagatcaattctgacaagatcaaattaaaactgctagtctaaatgttgccatgtcatactcaactgtaccaacaaatacagctctaacattgagtttttaagttagacatgctaactgtttttctttaaagggttaaaatcagttatttcctcccttataccattccttgcctgtcttgtctagcttgtttgataccgtttgtcttctgtgtctctcaaaggattaattgtttgtgtgctgggtgtggtggctcgtgtctataatcccagcattttgggaggccaagacaggcagattgcttgagcccaggagttcaaaccaacctgggcaccatggcaaaaccctgcctctactaaaattacaaaaaattacccaggcatggtggcacacagctatagtaccacctacttgggaggctaaggtgggaggatcgcttgagccagggaggcagtgattacagtaagccgtgattgcaccactgctctccagcctgggtgacaaagcgagattctgtctcaaaaacaaaacaaaacaaaaaagactaatgtttgtgaaactaaataaatttttcaagtattctaatcttattagtttaaaacatgtgatttcttggaaggactcccttgtaagaaaatcaacaggaagtatttcatcacaaagtataactttgtttttttgtgggtttttttttaacttttattttaggttcaggggtatatgtaaaggtttgttacacaggtaaacttgtgtcactggggtttgttgtacagattatttcatcacccaggtattaagcccagtacccaacggttatgttttctgctcctgttcctcctcccaccctccaccctcaggtagcccccagtgtctgttgttcctttctttgtgttcctgagttcccatcatttagctcccacttagaagttagaatatgtgatatttggttttctgttcctgtgttagtttgctaagaataatagcctccagctccatccatgttcctacaaaagacatgatctcattcctttttatggttgcatagtattccatggtgtgtatgtgccatattttctttatccagtctgtcattgatgggcatttaggttgattccgtgtctttgccattgcgaacagtgctgctgtgatcattgacatccatgtgtctttatggtagaatgatttatattcctctgggtatatacccagtaatggaattgctgggtcaaatggtagttctgcagttaactctttgaagcatcaccgtaccgctttccataatgattgaaataatttcctctctctccaacagtgtataagtgtttccttttctccaaaatttcatgagcatcttttttttcttgactttttattaatagccattctgactggtacaaattataacgttgtacctttgcaactttggaattgtttatattagccacttgtttcaatttttttccttgaagcctttgattaaaacacataataacccacaccatctcttggtactgtctgtgatgccagattcacagcagcccctcctatccttatcactcttcctggaacgtccaggtagggcttttgacagagggttgcattcctagaggcaattaagctgcctatctgccccaggacagtggcgttattgtggagtctcacagatgcactgctctaggggctactgctttgaggatggggatccatctccatgctaaatctccccacccccacccctagtgaatgacgccgtgtatagacttagcgttgaatgtcaaacaagacagtactctaaaaaactggatttggaagcaagatacctagtgtatttcctggcttagccactatgagattttcttatcttgggtcatccactccttctgtctttgcctctaatttctttatgagtgagagattgcagtgggccagtaagagcagcctaggctttgtgtcatcatgaccgacttcttacactacccttggtagctgtgtgccttaggtgagtcactgccatttccaagccccaatggcttcacttgtaaatggagctaacatagtctgcctcacacagttgctgagatattttttccacagactgccccactcctccctgcaaaattagttgttttttcattgctatatcatcagtactaggacagtgcctggggtatagttagtactcaatagatacctgtgaatgaatgaatgcaaggctattccccccaacatacatgggcatacatacacacacacacacacacacacacacacacacacacaaacacacacacaccctctacctcacagaaccttggaaagagtgaaacactgtctggaaagcattttgagttctgcagaaaagactgccttaaacatctaaagttatgttcctagttatcttcatatttcttctctcccacacaagtacttaaattttagtagcaaaagcagttagttgtccctgatcatcactgagtgggctgagtattttgttttgttgtgagattgtctcaaattttggctttatcacaggactcagaagctgctatcgaaaaacccaaagaatccttatgaggagtcgagcagagatgtgaggagtcgcaggcctgctgacactgaggatgggatgtcctcttgccctcaaccttgggtaatgtgaccaaagcagatgaagcaaggaattggcttgatattaacccctattcattttttctattttttcactgagttcagaatgactggaatcagttatagcttccagctggtgtcagtgttagccaagaccacatcagctagggaggtcctgggtgggagggtgggggaactgtgttgttaactaaaggaatcagatgagttataataatgccataatttaatggcacaataaatttttggaatttttttctttcatgtagattctttctataacttagatttgtatgtgttatgtgaaggctttccatatttttagttaatacattccagatacatgtcttaaaaacccaagattgtgcttctaatttattttctttctttctttcttttctttttctttttctctgtcttttttttttttttttttttttttggacaggatcttgctctgttgcccaggctggagtgcagtaatccaaccactcactgctcactgcagcctcgaactcctgggctcaaacaatcctcccagctcagcctcccaaatagctgggactaccggcacacaccgccacgcccagctaatttttgtattttttgtagagacagagtttcaccatgtttcccaggctggtctcaaactcttgggctcaagcaatccacctgcccgggcctctcaaagtgctggaattgcaggcatgagccactgcactcaattttcttaattttcttaatatttcttaatatttcttttattttcttaatatttcttttctcacacacatttcaactccccaaatttcagtagcaaaatagttgccagatttaacaaataaaaatataggatgcctagttaaattcatacttatactgaaagttcaaatttaaattcaaaattaaatttaactgggttctttattttatctgacaatcctagatattttccgaaaagcacagaggtttgggaaattcaagatgtttcataaatcatccacttcagtaattgatcttggaacactagagggcagtcttgaaacaggctacacattcttgaatcagttaagggaatttccatttctagaaacctgtcagagttaaggactgattcagtgtgtgctgttggcattatttgtggtatatattgtggaagagactggaatacatggcaggtccatggaggattgaatccttagggaagagctattacagagaggttatggaggagcaaaggcaatgtttggggtccttcccacattattacccctactccccagctcccatctcacagtgaattcccagaaagtagctttcctgtaactgtgcttttgactaccaggtgatcatcttttcctacctgtaataggcattcagtgtttccttatttatttatttattttttggttggactcaagtatgggggaaaaaaatagaggctgggcaagtttgctcatgcctgtaatccccatgctttgggaggccaaggcaggattgcttgaggccaggagcttgggaccagcccggacaatatagcaagatcatatttctttaaaaagattaaaaaaaaaaactttgctgggtgtggtggtacacacttgcagtttcaggtactcaagagactgaagcaggagggtcacttgaacccaagagttcaaggttgcagtgagctatgatagcaccactgcactccagcctgagtgacagactgagaccttttctctaaagcatgagaaagaacatgagttctagccttactctcccaccagttggctatctaatcttgagcaattcctttaacctatgcagacttctgctccccactcagtacaaggggtttggattagatgatctctaagatcccttcagtctttatcagtctttatcaattccacaagtgtgtgattctaggactaagctctagaatgtgttggttctttgaggcctcatgactttgcgaacttctaaattacccagatgtcacttgtcagtctacatggtatttcattcaggttttgagtagcaggtttaattcatctcattaattcatcatcatgggaatgaaggagaaacacaatctgtgtatgactattaaaaaatcaaaagcatttgctgctgtcatgagcaacttgttggctcagagctatgttgggaggcctggggctgctgagctcagtcccccacagccgtcataactgtcgttgacagcaactgctgctgtagatatcagtgggagtgggagagagctgaacgctcaaactagaagaaagagcagaaacaaatgtagttctatcagctcctttccccacctcagcccagaatttcgggacctatgttcttctgacagagaggcacgaggttagaaaatttgcagtgcagagggttggattttgacttgagacagaaataatgggcatgtgtctttaaacagtgggttgcgtgttgattttgcagtgtgttgctgcaggagatcatcaatgaggaggagatgaagcatgatttgtattataagaaaatgaaaatacatgttctgtggattcacacttcccttaccaacatttccctgccttctgcctaattgaccccagtcatcatccctttctacacctttctcaaaggaaaatatgggcaaagagattgttttctactcctctttctgttgtttctgagttgtgtgctcctttctgtggagcgcccatttctgaaccaatgaagcgtgatcggccaaaaccttggggcagtccttgcactagttactgattgacaaggaaggacttcaccaaatgatgtcctttgtcctgttgtatggggtcacttcttttctttccttgtagcatggatctgttttaatatctaatctatctagagtgaatgtgagccagtgaactctggtcagcctgcattgcaagtgcccaatcaatttttgataatacaaataatgacaaaagtaatcattttgttgactgaagagaaatgttgttttctgttccttcctattaaaattctaggtccctaggctgttcaaccagcttgcaaaattgtcattgcactggtaattattactacctttaatggccccaaattactcagaacttggtagcatgtttaaatgagtgttattaatgtgtgtgtgcgtgtgtgtgtatgaaaagttgtagcacacacatatattagatattatttgcctggcctatgggcagttcttagaatacttatggattcttggattgcttatggtaaatcagtggctccagggatccgtgacctaaaagctgagattccataattagaatagattcttcagttaacatattggtgtgcctagttgctttaagacaaagtaacacaaggctcctcactgaatgttgaatctctctttagatagaaagactaacttcacagggcctttcttctgactttcactttccataggatgaacatcgtaaagccatagactttgattcaatgtacgttgagataatttgtgaattttaacaatatcctctctccctcctttttgttgtctgcagtttgtggttataaaagaacaccaagacctcaagaatgggggtcaaccagtggctggtgaggatggccaggcagcagatggtcagtttttatccctggctcctggtgaatggttatttttacttagatcctgactgtttttcaatgaaaagtctcatttaaccacacacacacacacaaacaaaataactaaattgtataagctatgtgaatagctgggctgtattgaaatgccatggacctgatttgcactggagttctatcttatatgaggttaccacgttcactcaaaactctagtcacagggcagcccgtgttcttgcactttgagcaagaacacaatggatgactccttgatttgaattgagttttggggtcattcttaaggtccaggatctatactggtagctgtaggtatagtcccagttaagttgtaaatggctccaagaaaacatgttccatgttcagcccatctagtgggaagtgtttctgtaaatttaagttgatctgaggattgtcctggggatttcagagtattcaggtcttatcaggggcatgaccttagccagacgcctggctgtctgtgaagtccagccaagccacttgtggagagaccataaaatcaacccaggttctcaggaactcagtctacttcagatagaaatgaactcagatacccttaagagttgtattatgatcagccttttggttttgggtctcaggttgagttttgtttcacaggccagaggacattgtttcacaggcctttgtgtcgtgagcctttggaaaggtttagagaaacttttagccaacaaaaacagctcctctgctaatgaaaggagctaatgaaatatcaactccaattgaattttctatatttttccttcttcaatgtgcttattatcataacctcctcctcagatttctttctggaaagaacataggcttcttgttttggaaaactcactctaaattcccttctcatacctatgttgccatgaaaccccaaatactgaattcagtacaactttattacctaatttgaagaaggcctggatatttaaggtacacttaaaaattgaatatgaaaactacaataaatagtatagtattttatatggatcattactttcccctgataatgaaaaaattcagcattttcaaaaatttgcttcagtgcttattgttattggtagcactattaaaaagtaatggaatatttgtagttactacttttccttgagcagctaaaagtgcataattcttacaatggtaacccactatagaggcacatataatgtaattttgcaagctaatagcacaacgattttacaggaatttggttaaacttagaaaagaactaaggactcattacagttagctgagtactcaggaatatattagaatgtctcttttgctgttgtttttttccccccgcactgtactgcaaacaatttgacccattctctgtgggccactcatataactatctcccagcatgagtgatcacatccccaatcatgtccagctgtctcataaatgcctggggtgaaaatgcgcatagagattggggtggggggagattgagtgaggaatgaaataaaagatcaagtttggctctgagccagtctcttctctgctcctggaaaactcattacaacacaatactagtgtagttccataaaaccatcttcactgagctcagctgacatcagttgacacaggttaagtgcagagtacatgctaggggcagctgactatgccaggggaaaagaaaagaaatacacctaaaatctgaattcagaccaggcacagtggctcacacctgtaatccgagcactttgggaggccaaggtgggcagatcatttgaggtcaggagtttgagaccagcctgtctctaccaaatgagaccagcctgtctctatggtggaacgctgtctctaccaaaaagtacaaaaattagcctggcatgctggtgcacacctgtagtcccagctactcaggaggctgaggtaggaggatcccttgagcctgggagatggaggttgcagtgagctgagatctcaacactgcactccagtgagactccatctcaaaacaaagatagagactccatctcaaaaacaaaaaacaaaaaacctgagctctatctactctcaagtcatttgtggtccagatggggagacagaagtacacagtaaaagctaaagagcaatgtgtcaggttctttaaatcacctcaaccaagactattgtaatttttttaaaaaaattttaagatgccaaccaagactattttaatttttaaaaaattattttaagtcaaggtcctactctgtcactcaggctaaagtacagtggcttggtcatggctcattgctgtcttggcctccccaggctcaagcaatcctcccacctcagcctcctaagtagctgagaccacaggcatgcactaccatgcccagctagttttttattttatgtagagatggagactccctatgttacccaggctggtcttgaactcttgggtgcaagccatcctcccacttcagcctctcaaagtgctggagttacaaacatgagcccctgcactggcctattttaattttttaaaaattgggctcagggtggggtgtggtgtctcatacctgtaattctagcactttgtgaggttgaggtgggcgaatcgcttgagcccaggagttcaaaaccagcctggctaacatggcaaccctgtctctataaaaaatacaaaagttagccgggtagtcctagctactcaggaggctgaggtggaaggatcacctgagcctaggaggaagaggctgtggtgagctgtgactgtgccactgcacaatctgcctggatgacagagtgagatgcttatcaaaaaaaaaaagagaaaaaaatgtgtctagagtagtttgaaaatgggttatctttgtgtctcattttcaggccagttcttcaaccactaccgtttagggtctgtcttgcctatctattgttaatgatatgaatattgaaatttcttttgtctttcatatagggtcaatgcaaccaacttcatggaggcaggagccccagttatgtggaatgggcacagagcaaggctgctggattccagtatccagtgataagggctcctgtccccaggtaatggagcgaagctttcatatgccctcctatgggacacagacccttgaagggggtgtcgagaagccccattctctcctatcagctaacccattatggcaacaaagggccctggacccaccacaccaaatggagctgactcagtgaaaactggaattaaaaggaaagtcaagaagaatgaactatgtcgatgcacagtatcttttctttcaaaagtagagcaaaactataggttttggttccacaatctctacgactaatcacctactcaatgcctggagacagatacgtagttgtgcttttgtttgctcttttaagcagtctcactgcagtcttatttccaagtaagagtactgggagaatcactaggtaacttattagaaacccaaattgggacaacagtgctttgtaaattgtgttgtcttcagcagtcaatacaaatagatttttgtttttgttgttcctgcagccccagaagaaattaggggttaaagcagacagtcacactggtttggtcagttacaaagtaatttctttgatctggacagaacatttatatcagtttcatgaaatgattggaatattacaataccgttaagatacagtgtaggcatttaactcctcattggcgtggtccatgctgatgattttgcaaaatgagttgtgatgaatcaatgaaaaatgtaatttagaaactgatttcttcagaattagatggcttattttttaaaatatttgaatgaaaacattttatttttaaaatattacacaggaggcttcggagtttcttagtcattactgtccttttcccctacagaattttccctcttggtgtgattgcacagaatttgtatgtattttcagttacaagattgtaagtaaattgcctgatttgttttcattatagacaacgatgaatttcttctaattatttaaataaaatcaccaaaaacataaacattttattgtatgcctgattaagtagttaattatagtctaaggcagtactagagttgaaccaaaatgatttgtcaagcttgctgatgtttctgtttttcgttttttttttttttccggagagaggataggatctcactctgttatccaggctggagtgtgcaatggcacaatcatagctcagtgcagcctcaaactcctgggctcaagcaatcctcctgcctcagcctcccgagtaactaggaccacaggcacaggccaccatgcctggctaaggtttttatttttattttttgtagacatggggatcacacaatgttgcccaggctggtcttgaactcctggcctcaagcaaggtcgtgctggtaattttgcaaaatgaattgtgattgactttcagcctcccaacgtattagattataggcattagccatggtgcccagccttgtaacttttaaaaaaattttttaatctacaactctgtagattaaaatttcacatggtgttctaattaaatatttttcttgcagccaagatattgttactacagataacacaacctgatatggtaactttaaattttgggggctttgaatcattcagtttatgcattaactagtccctttgtttatctttcatttctcaaccccttgtactttggtgataccagacatcagaataaaaagaaattgaagta

SEQ ID NO: 2482 - DNA, 100079 bp, Homo sapiens; identical to SEQ ID NO: 2481
  source 1..100079: mol_type = genomic DNA

SEQ ID NO: 2483 - DNA, 100079 bp, Homo sapiens; identical to SEQ ID NO: 2481
  source 1..100079: mol_type = genomic DNA

SEQ ID NO: 2484 - DNA, 93223 bp, Homo sapiens
  source 1..93223: mol_type = genomic DNA
caattcgggagcccgttctcgcgggattttccaagaccgggttggaatttgcgggggttaggagacggaagtcagagcctaggaagatttgggggtcgccttgccggcctcctgtcctcctccggcggcggcggagcccgagagaactaggtgaacaccgctttgccagcctcacacagcgtcccctggctctgccgccgctccggacgtcgccctcccgttctgcttgggtccccttagtcgctacctttgctgggatccccctcctccatcctgtggcttcgggttgccgaagagcgatgctcggagggcggccggaagtggcgttggccgccattggcctgccggccagccaccttgctgtcctccgccgccttccgggtgttacatgcagccgggctcggcccctccccctggccggatggatccgtcggcgccacagccccgcgcggaaacctcaggcaaaggtaccagctccgcgctcgccccttacgcagaggcctgtgtactgcgtcgcgttggaccagttcttgccggtgcccttcgggttggggttttgccctgtagatcctcttcagtgacagctgcagattgtgaacccctccaggcctggaaccaaatctccgattcagtgttgagaacctggactcgggagtcagcccctgggatctagtgctgcctctgacagttacttgctgagcaactttgggcaggctcctcatctgtaaaactgggttcattactaggttcttgcgattattaaatgacgtggggaatacgcaaagtatttatgtgaccccgcgtgtggcccatattaagcactcagtaaatgttattttcattctttattcttgtatgccccagttgttagtgaatggcagaagtttgttgtaagtagataaatgaaggttgagatatttagttcagttgagttttattgcctattgagtcagggcattatattctgccttaaataggaggtttaaagaaggtgtgattatctaccacaagtcacctgggatgccttctggcacccaaatgagtagttttcattaataattgtgctgtataacaaaagctaccaggtattgagtgattttcctgagcccagcaatatgctgattgtttacttgctttcctttgaggaagatatcgatctcattaaatagatgaattcagagctaaagttcagagagggcaagttacaagcctgaattctgaggtctaggaattgatgacgctgtaattcagggaccaaacatataaatacctataggagactggcagctaaaaatagatgaagctgccgagtggatattgtgactgggaggctcattccttttgataaatctagtcactcttggtatttagggaaattggtggaaggagcagaaagctccagggccccgaggtgggaacacccttgaggaatgcttgaggaggcctttggagtgaaagagggagagagagaccctatcaccagaatgagttgagttggtaattagtttaaaccaaaacaaatgatttcgactcattaaattttaggacacttaacccatttccctgttaaatccaacaggaaatcttaacaatttaagcagttgttctgtagtttggatactgagagattccatttctaactcaactgaatttatttcgtcctagaaattatccgaactcaaacccaaaatactccaataagttgtgtgattcccttaaggcttttttttttttgcacatgctgtacacttatctgagatacagttcttagacccctttcccttttaaattacatttctcaatactcccttctcatagcactcttcttccaatgcagtttttacagttatgtatatgttggtgtactttttagttttctcgcaagatatcaaggatttgtgagattgataatttgtaataggccaggcgcatggctcacacctgtaatcccagtactttggggaagcttaggcgggaggatagtttgaggccagcctggacaacataagcgagaccctgtctctactaaaaataaaaaatttagccaggcatggtggtgcacacctgtagtcccagctactcaggaggctgaggcgggaggatggctgagctcaggagttggagtttacagtgagctataattgtgccatgacactccagactgggcgacagagacactcttgtctaaaaaaaaaaagaaaaaaaaaagaatgtgtaataaattcgcatgttcactgaatgtctgctgtgtgactctgtgttggtcctggggataaaatttataacagtacaaacttttcttggaaaggaaattactctctactggaaggaaaagacaaaaaaccagtggacatgataattaaatgttatgataagtgctacagaggcaataaaatgatgagatagagaataatgggtaccctacgctaaataggtggactgggagcagagagactggttaggcataatttagggaaagttgatggtggcatgctttaagacagaggtctgcaaactactgcctgtgggctaaaactggtctgacacttttttttgtaaataaagttttattggaacacaactgtgcccatttgtttatgtattgtctggttgcttttgcattacaagggcaagagactgtatggcctacaaaatctaaagtaacaaatagctaataactgactctagagaaaatgtttgccagcctttgctttagagagatagtggcatggaggaaagtgattcatttttgaagtagaaccaggatattctgatggattggatgtaaggagtaatattaaatgaggtttaagggctgactaatggttttctaccttgaaaagttggttagatgatgatgccagttttttgtttttttttaaatgccagcttttttttttattatactttaagttttagggtacgtgtgcacaatgtgcaggttagttacatatgtatacatgtgccatgctggtgtgctgcacccattaacttgtcatttagcattaggtatatctcctaaagctatccctccccccttccccccaccccacaacagtccccagagtgtgatgttccccttcctgtgtccatgtgttctcattgttcaattcccacctatgagtgagaatctgcggtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctgctattgtgaatagtgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggctttgatttgcatttctctgagatgatgccagttaataagatgcaggaagactattagtcaccatcatttttgacattagttttcttcattttatacccattgtgtggtataatatttggtgaataatttgtgcttaaatcacatatgttgaataatagataataaaataagtcttaagaaatgatagggtaggcaaacacataatgggaaatataagtaatgtgttaagaattgctgtaagggttgctttaggttttaaggtgcaaatagtactgttatgaaaattgggcccattgacctatatgttgttctacttgtacagtggatcgaggctttagtttgacattaaaacactcttttagaatggtgtaacagttgtcaacagtttgggtccagagagtagagtgggagagaaggtttttccctctgtactcattattgttatggtaaaataacctcatcaaagttagtggctttacttttaaggaacaactgatggatgaggaatttaatgagctattcttgctttagatagtataaacatgtcatgttgtagttataaatatctaactggaggtcatcaggaagaccctaggaaactgccagtggttatctgatctcagtgagaaatgtataggaaaaataattcctagtgttcttatgtttgtagccatagaattatttttggattcttgccataagaaattccatttggaaaattatttttacttagttttctttatttgatactttttaattgtaccaatagtatactgtggactccctcctcattcatagtggtatattttctgggaaaataaaatagctgtatggttagtcacagaataagttcataaagagagaggtaatactctttaaagtgtaataggatctttgcagaaagagatcttagaattcatctcttaaagtaaatattcaaaacccggaagaggaaaagctgtgacatcactgtagttgaattggaggttcccatggttagctgtatacaagcagtggttaaagtaaaggcttagaggcaacaatattgcagtgaaaagaaacagctgtttctagagaaaggcaatggaataactgtaaaaaagacagatgaaccacaaagcattgctgtccagaggattttagtttactcattaccaagtcctattcacgattactctaccatatcatgaaatatatgtatatatatatgttcatgagtcaggaagaatattttagtcagtggctctcaaccctggctgtgcgtcagaatgatcttttgaattcaacaataacaaccaaacaaaacaataaaaccagatgcccgtgacccctatccactgaataagaatcactagaggtggtgtctaagaatgtatatttttaaactccaggggagatgatgacacacagttagggtaagaaccactggaaataaagtatgtaccctttattctgtttattataggagaatatctgaaaatctattttagaaaaatatctatacatgttagaatttatcttgttccagttttttggaaaaggcatttatgtgaggtatatattgtttctcacagctgtgaataaatgaggtgttactttataagctagctttggaaactttattttctttattcttgcagacatatggcatccaggagaaagatgtcttgccccttctccagataatggaaaactttgtgaagcaagcataaaatctatcacagtggatgaaaatggcaagtcatttgcagtcgtcttatatgcagattttcaagaaaggaaaatacctcttaaacagcttcaagaagtgaaatttgttaaagattgccctaggaatcttatatttgatgatgaagatttagaaaaaccttatttcccaaaccgaaaatttccatcatcttctgttgcttttaaattatctgacaatggagactctattccttataccatcaataggtatttgagagactaccaaagagaaggaacccggtttctttatggacactacatccatggaggagggtgcattctgggtgatgacatgggacttggaaaaacagtacaggtatttaattatgttataacagtaaagtcactttactgtgtacatgagtggatactatatgtaaatctttatttgtactgctgttacgatagctattttgtgtgttcctgtgtatgtttgtgtttgtctcactaactagatagtgaagtcctcaaagttgaggacaatgtctcagttattttatcattcttcagtacctatgaaatattttattccaaaataatgttttggtaccacttggtttgattttacctttggtaatactggtactaagatatcaatatatttgaagtcatttaactttcttcatacttaatggaaggaaagcattctaacatttgttatgccacatagcatggttaaattgttcctataggccttttgtgcatattgttcgaagtttatcatgttagaagtttcttaatctggaatccctgggtcactagcagttctgtttgtgaacttcagagagacttcaagattccctaaaatgtgtactagaatttgtacacatacatactttcctaaagaggggatttgttgtagttaatctgtttctgtataacaaattatgccaaatttagcagcttaaaacaatattcatgtattgtctcacagtttctgtgggttgggaatccagctgccgcctagcctggtcctgtagctttgcctctcacagggctgcagtcatctcaaggtgactggggaagattcacttcctagcccacctgtttgttggcaggattcagttccttgtgggttcttggcctcagtttcttgtgagctgttggctggaggcctcctttgcttccttgacacatggacctcttcatggggcatctcacacaaggtagcttgcttcataaaaggagagcaagtaggagggcaagagacagcactagtaaaacagaagtcatagtctttggtgatgtaataacacaagagacatcccttcacttttgtcacattcttctcattagaagcaagttgctaagtccagccagaactcaagggaaggagattaaacaggactgggaatatgaagaggtgggtattattgggagtcctgtcagaagctgcctgctacagggtctttagctttccttagattttcaaagaggtttgtgatccaagaagaatagagttttgaatctagattttatactaaacgatcactttagattttcaggagtgtgtgcctagtttgtgattaagttattctgcttcctttcttataattgagtttaacttattttcttcttcatattacctccattagttattggaactcaaaggtttaagtggaaaactaaatttaacatttataaatagccaaatttcagacaccaatgatggaataaggaaaaagaaaagaaaaaaaaaatagccaaataatgctactgtgtgtaaaggtctggtgtgaaaaactaggctaaaataaagtcttttaataatcatattaccattaaccatactctatgttccttcaagcctaggcagtgcagatagtttagacatgcacactggacgtgctaaatgattgtttgtggaataaatgaatttaccttcttcgtttattccacaaactatcatttagcatgccggcctgtaggtggaggatagacagcaagaataaagaaaggagccttcaagaaattacctctgaaactgacccaacagtcccacagacagttttgtttgtttgtttgcttgtttttggataaacatagaaattgacccttctggtcctaaagctttaaacttgtatttgttttatctgagttccttcctcaggaaaggacccccaggcctctcaaaaagtatcaaagaactgaaactcaccagatcgtagaattcagacagtgagacaccaggcctctcattcatcagattacttccttagccctcccaacttcctgttttcccatacattgttacatttcttctctgctgtaaaaactcctaattttaatcagggagatggatttgagactgatccttggctacagtgcctgattaaagcatttttccttggcaatacgtgttgtctcagtgattggctggctgtatggtgagcagcaggtcttagaccgaacccgtggtgtttcagtaacgccatctgtgaccaagattacagatgagtactagaggaaaattaataaattaattaaagccctgctgtaactgttttcgcatatacttctactgtttttgcctgtggtagaatgtttgttaccacaattctttgattagccagtgcatgttcaacttcaaaataaacatgaggctgggtttggtggttcacacctgtaatcccagcactttgggaggccaaggcgggcggatcacgaggtcaagagatcaagaccatcctggccaacatggtgaaaccccatctctacaaaaatacaaaaattagctgggcatggtggcccacgcctgtagtcccagctacttgggaagccaaggcaggagaatctcttgaacctgggaggcagaggttgcagtaagtcgagattgtgccactgcactccagtctggcaacagagtgagactctgtctcacatacaaaaaaagaagaaacatgagggtactacatacaaaaagtgatctgtttgggaaccaccatcctgcagcttaaatacaattcgaattcaaattcttgcgcacattttagtctcaaatttgaaggctgtctttcatctctgaggcccatgttacaaagaaatttactttattttacagttcataggattatttttaaaggagctgattttactgcagaattttctattcctgatacactgtaatcattgaaggacttggagatgttctggtacatgctgttagtgtgctgtgcaagtctttgagggagtaccgtctgaagattaggaaatggtttctgcactaattttgatactcagatggatttgtctgatgcttggggacctagttctctggttactgttgttgtaactcagggaataatttctacatagataggtggtttgaaagacccatttaaggtagagcttctatagatagataaagcttctatagatatgactaagccagttgaagaaatgtgaatgattactgtgttaactaaaatttcagaatgtagtaaaattaattgataatgaaaatagaccattgacatttactgtttgagctatagttttatcttcttttcttcttttttttttttcctgtttcttgatttcatccctttagtttccccctttttatattctaatttggccatgatatgaaactgaagtctttttaaagcttgttttacataccaaataaagtttccttccctcatttcaaatttaaaagtaggtgaatttaatattttacactctacaggggatgagaattgaaaaatgtccatttgttctagtgacatagaaatcattggtatgctgagcaagagccattttgctggagctttcagacacaagccataatggagtaggtgaagacgtggacatagaaagaacgtatatttacctctttaagaaatatggcttcgaaagggaataaaagtgacctagtagtaggtgaagagagagacgagaatttgagggggtttcttttttgtttgttttgtattgtttgggggtaggaaagacttgagtatttttaaggtgaattggaaggacagatctggtgaagagggcacagataaatatgcaacatacataatgatatgcccacatatacatgtacttctgtaaacacacacacaaacatacatatgcaaaaaatggagtcacataataactactatcttataagcaggttgcagatttttttttgtcaaagattatgaactaatttttcccgataccttctgacatttttctaaaacatagaagagttaaaagaatggtacaatgaaaagccatattctcaccacttagattctgttaatatttcattatacatggttttgtaatatccatccatcttttgttgcattttaaaatagcagacattaatacattttatcccacatacacatatccaagaaaagatcatcacagccaagacgatgaacatgtctatcactcctagatttcctcatgtccattgtgcccttgatatgttcaacaccatgcagttcatcacctactatttttggttttagtgggactgaaaaattaaagatacttgaggaaattttaatacaaaatccaagatttttatgactatctcccaatatttcacagaattttcacatctaattcaacaggtaacttgaaaatgaatcccttttgtacatttacgtgataattagctagtttaagtacaataaacaatttcactggagtatacaggtttgggaacctgacctttggtaatcagacaactcagtgataggaaaagaggtgagtgggtgcttaccatggagtagtggttctctaaagtggatatttgggtcagcagcattagtgtcacctgggaacttgttaggattgtaaattccggggtctcactgcagacatactgaattgtgaactcggtgggagtaggagaggatggcaatctgtgttttaacagatgcttcaggtaattccaaggcccactaaagtttcagagcctttgctcagacggtgtgtttttcagagggttagaaaactttgattaatctggtgagttcagtgaacattggttaagggatgtttggtctacgtgaatcttttttgttgttgttctctttttgtttttttgagatgggggtctcactctggcattcagggtggagtgcagtagcgagatctcggctcactgcaaagtccacctccggggcccaagcgatcttcccacctcagcctcccaagtagctgggaccatagttgctcaccaccacgcccagctaattttttgtatttttggtagagatggggttttcccgagttgcccaggctggtcttgaactcctgagctcaagtgatctgcctgccttgacctctcaaagtgctgggattacaggcaggaactactgtgcctggcctctgtgttaatatgtatacataggatgatgatcatttcatttaaaaaaaaaatacatttagaaatggaaatgatattagagataattttgttcagctttttaacttagtacgtaaaacaggcacaggaatgacttccctatctagggtcaggcacagaagtaataattttcatttctattctagaactgttatttttttcctcttctatcatctactgccttcttttgacttaataatacagttaattaaaagccttttactcaacttttaaccatttgttcaattggttgacatttgataagtactcactctgggccaggcactgtgattggcactgaagagccaatatgaatataaatgcatataatacctactgtgatggttactagtgagtgtcaacttgattggattgaaggatacaaagtattgatctaggttgtgtctgtgagggtgatgccaaaagagattaatatttgagtcagtgggctgggaaagacagacccatccttaatctggcaggcacagtcttatcagctgccagcgtggctagaagtaagcaggcagaaaaatgtgaagagagagactggcctagcctcccagcctgcatctttctcccatgctggatgcttcctgtccttgaacgtcggactcaagttcttcagttttggaacttggactggctctccttgctcttcagcctgcagacatgctattgtggcacttcgtgatcgtgtgagatagtacttaataaactcctcatatatctctattccattagttctgtccctctagagaaccctaatacacctgccttacagagttcacaaaagagtaataaaaggaaatgaggccaagagtcatctagtctggtaagtgggttgggggggagaaacaagcctgcctgggggtgtcaaagaagactccacagggaaattggtgttttcatactttgcttttggaaacccaccaaactttgagttttgaattgagttttaatgaattttattttttactgaaggcatagctctaatatagtatttgaaaggtttatcacaagagaagagctcaaattcattgaatcaaaataatttagtttttaatggtagtgtggtaattagcttttacagacaccaaaatcttaaggactactattaagcagatgcagtaatatgtcttaccatattattttattttctcatctgctatgcaaagaagataatagtactttttgagtagcagagatagaattttgcaaagcatgaagacattctttgaatttttgtttctatattattagatattacattattgaaaatgtcattactgaaggctgtcttattaaaaagatgtatagtaaacctcactcttgagagaaatgggattgctgataattaaaggtttcttaggttattttcagtaccttttttggataataagatcttcagtagattcaaaacatactaaaatatgaaggttcttgggatctcaagtcatgttattcactcaggaatatagtaataaagagaaaaataatattgtctttattttcattcattgagaaaatgctataatatccagtgtggaaggttaattagcccccagatccctgagcccttttaagcagaaacaaaaatgtactagtatttcacagataaaattgtatttcttcttttggcatgtagttctgattttaggggagagctttgtaaagataagtgagctagaccccatttcaaaacagcactttgtggtttttttttttttttcaaagcgagcaaaaatacttttgaagtgtggttctgaaccactctctctgtacctttgtatctcccaggaagttgaaaaataaggtagtaaacatttttttctttttgttctgtaagaaatagacaatttttgctatgccttcctcttctggtctaagggaaggtttatgccctttttcccagcctcagatttactcagtatgtcatgagctgactctgtgaggaaagatgacttataaaactgttggcttgacagagtttagaaaggaatacatgtaaaaacagaaagctttcccagagtgatatttcatttctgaaatgcagtttttggcctttcactattctagaggtgactgattaaaatatttgtttttgttcttttcatctataagcaattttagaactattccacaataaaacatgttctggctttttctttgcagataagttttgtaaaccttcattgtaaatgtgtctttagtcttctgtgaattaatattttgatagacctctactggaccaccatagtgtggtaagatggctagatctccacccaaaatacatatttcctttgccttcttagagtttgggctagctgacagagactgcatttcccaaatctccttgcatgtcagtggagcttgtgactgggttccgccagcagaaataagggtagaagtgatgagtgccatttatagtcctggtccataaaatccacctgtgctgttcttcacattctcccttccctaactgtcttttgtgtattgacactttgctgctagcattaccacaatacctattagtatattttaattaatataattaatatatagctaagagtttgttagtggttttagctagcttctccagtttgtattctcaactaaagtttattactatttcaacttaagtttttcgggggtgggtggataagtagtgttaagaggtagtgtagatgatttaaatgagatacaaagatttttaaaaatcattagtggatttagtgaattaaataaagctaatctatacttagagtttataaatttagctgccacatatgaaatatcttccaaagatctgagattcttaaacacaaggaacatttcacatatctttgttttagagaatttgacaaatgaagttagaattaagatcgtatatcaccttggatagatgagcaaattgaattatgaatttgcacaattaggaatataattttcctataatgaaacaatctgtaggtgagttaagagcaaatcagtggatttgatcttatattacctcatttaaattgttatggtatctaataggtatctctcttgtcttttcagtagcctttgaggaccagttgcctaaaattaaaaagagtatatctgtcaatatatgtgtgtgtgtgtgtgcatgtgtgtatctttaattctttaattaaggtacacttaaactgtaaaatgcacagatctcaggtatactacttaatgagctttgacaaatgtctatgtctgtgtaactaatatactaatcaaaatataggacaattccattaccctaaaaagttttttcatgcccctttccagtcaatatgccaattacctatacttttaattataaattttctgtgatcagtgtaaagttatattccaaaaggtagttagaacccaaaatgttatgcttatttacaccatcaaggaattcagtaaattctaatattaggtgatgtatttttaaatagaaaacataactttaaaaatatttataaaatgaaaattgtgaacatgcatcaaagatcttttacttaggtggtgttaacaatatttaaattgtccaatgcctaaactcagttatttgtggagtatccgttctctttcttttaatttatgttctacatcagccagtttgcgcacattaatctctcactggattctttagtaactgtttattttctgttcatttgtccacttttttctcaaccatgctccttcaacacatctcctaactacctcttccctgtcaccccaaatcagcttgatttcatactactgaatgatagaaatagcctttcatctagactattccagcatctagaaatagcctttcacctagactattccagcatcttggtattgagtaggtaataaatatatttttattgaatgtgttagtgaattttaagttgaattggataacattatggttctatggttataacttatattgcctatatttgccaggctctatgataaacattttccattaaacattcatgttaattagatattcttgcctctatttaattggtgaaaatattaaaatttatagaaagtttatgtaaattgcccagtgtcacatagctagtatgaaactggttggtcagacaccaaagtctttgtgataagtcctgcaaattgacatgcgaattttgttagaatattttaaaacttaggacaagtttaaaccatcctatttttcatctttttataatattttagacaacataatttgcaaaagctactttgtttattatatacaagatcatatgcaagaaacaaagccttctaccttaaggaatgatgccagaaaaatagctaatgtgtttttgttttttgagacagtgtctcgcttttttgcccaggctggaatgcagtggtgcagtgttggctcactgcagccttgacctcctgggctcaagtgatcctccccacctcagcctcccgagtagctgggactacagatgcgcactaccaggcctgggtaatttttgtactttttgtagaggtgggatttcaccatgctgcccaggctggccttaaactcctgagcttgcccgcttctgcctcctaaagtgctgggattaaaaatagctactgtttgcctgtaatcccagcactttgggaggctaaggtgggcagatcaccagtggtcgggagttcaagaccagactgaccaacatggagaaactctgtctctactaaaaatacaaaattagctgggcatggtggcgcatgcctgtaatcccagctaactcaggaggctgaggcaggagaatcacttgcagccgggaggcggaggttgcggtgagtcaagatcgcaccattgcactccagcctgggcaacaagtgtgtccctaactctgtctcaaaaaaaagctcctgtttattgaatcattgatatttactgacttgacactttacgtacatactttttaacttttttctagaataaaaataattctgattacactgtaatacacaaacgcattcttataaaaatgcaagctgtaatttttaaattgaggataagtccacacagcattaattcattatataaaatgattaattgagtgcatttaatgcattcagaatgttgtgcaactcccacctctttctagtttctgggttgtttccacttttagttattatgaataatgcttctgtgaacatttgtatgcaaacatttctcttgtgtgtattcctagaattggaattagtgggttttatggtaattcagtgtttctttttttttttttcgaggaactgcaatactattttccacaatggctaaaacattttacattcctaccaacaattgtccaggtttcctatgcctccacatcattgccaacacttgttattttttggttttcttcattatagccatcctactatgtgttaagtggtatttcattacggttttgatttgcatttctgtaatggccaatgatgttgaacatattttcatgtgcttttttggccctttgtagatctttagagaaagaaatatatatttaagtcttttgcctgttttttaatttcattgtctttattgttgagttgtaagaatttttatgtattttggatactaatccctcatcagatatatgatttgcaaatattttctctcattctatagttgtctttttatttgcttgttattttactttgatgcacgaaagttaagttttatgaagtccaatctgtttttttatttggttgaacaagttgtaattttaatgtatgtgtaaataaatttaaaaaataggactattatttctatatgttattctactccttgtttttttcacttaaacataggtcttggagatctttttatgttggtacataaggattgtccccattcattaattaataaattactgcatactatagattatatgttctgtaacttattttaccattcctctagggacctagggagaaggatttttgggttgttgcctattttaggaaatagcaaatagtgaatatctgtaggatagaattctaagagtatttctctgtaggatagattcctaaaagtcaagtttctcggtgaagtgtataaatctttttttttttttttttttgaggcaaggtcctgctccctcacccaggctggagcgtggtggtgatctcagctcactgcaacctctgcctcctggttcaagtgattctcatgcctcagcctcccaagtagctgggattataggcatgtgccaccacacccagctaatttttgtatttttagtagaagcagggtttcaccatgttggccaggctggtctcggactcctgacctcaagtgatccacccacctaaacctcccaaagtgctgggattataggtgtgaaccactgcgccaagccagatgtgtctatttcttttaatctgctagttttaccttcatatattttgaagctccgttattagggtcacaaacctttgtgattgttatatcttcctgatgaattgaccatttttttactatgaagtgtcccttgtagacagctcttttattcattctgacaatctctgatatttaattggaatatttagttcatttacatttaatgtaattcttatgtatggatttggatacaaatctgttcattcagaaacagtctgatttgccttttgggttgatatgatattttttagaattttattttaatttttctattgactttttatctatacttctttgctttttatttttagtggttgctctaatgataaaatatacattctcaacttcttgcaatgtacctaataatgtactgcttcagataaaatatgtttcttgtaaataggtcattctattctcattttaaggaatctaagagttaggaatgctaagtgtaatgcctaatatacctagctgataactacctaatacctaaatttcaaaggttaagtcaaacttatatttgcagaatatacccagtttggttttggtatatattatttccttttttaaatttctgtgttctgtgtgctaatattttgtttaagagtttggcttctatatgagtaagataaattggcttgtaaatttcctgtattataatgttcttgtcaggttttcttatcaaagttacgctgaactcataaaacgaggtcacagtattttcccctttttctaaaccctgaaagggtctgttacagattggcattacatttttcttaagcattaggtagaatttgttggtgaaactatctggcccttaactttctttgtggaaggtttataattacatattcaggtttatttcatggttttatgagtatttaaatttccttttcttgtgttggtttttgataagttctatttctaaatttcctctaaattttacatttattggcaaagcattattatggcttatacatattttttgtttgccttttctctattttttcttcatcaattttgccaggggtttattgaaaaaattctttcaaaggatgatcatttggcattgttgatcattttcattgtatgctttagtaatttctgcttttttgtgttaaattttctgttattttcataagtttttgagatagattctttgataactgattaatagtccctcttctttcctaatacagatgctccttgacttacagtggggttatgtccccataaacccattgtaagttgaaaatattataagttgaaaacacatttaatacacctaacctactgaacgttatagcttagcctatcctaccttaaacatgctcagaacacttacgttagcatatagttgggcagaatcatctaacacaatgcctgtttcatactaaagtgttgaatctcatatagtttattgaatattttgctaaaagtgaaaaacaatgattgtatgggtacttgatttacagttatactgaatgtgtattatttttataccattgtaaattgaaaaattgcaagttgagctatcataagttggggactgtctgtaatattcatttaagtccctaaggtacagctttagccatattctacaaattcaacatgtattgttactcattatttaattcaaatattttataatttatattgtgagttgtttgaactctgttccttactgtccaaacatttggagattttctgcttatatttttgttatttctagtttcttgtattgtgatcaaagaacatattctgtatggtttctgtctactgaaatgtattgagacttctgtggcctggcatatgtcagcctttttttttttttttttttttttttttgagacggagtttcactcttattgcccaagatggagtgcaatggcgtgatcttggctcaccgcaacctccacctcctgggttcaagtgattctcctgcctcagccttccaagtagctgggatcacaggcacacgccaccatgcccagctaattttttatatttttagtagaaacgggatttcaccatgttagccaggctggttttgaactcctaacctcaggtgatccgcccgcctcggcctcccaaaatgctgggattacaggcgtgagccactgcaccaggcccggtatgtcaactttggtaactatttcgtgggtacttaaaatgaaactgctttgcagtagtgtgcagtgttctagcaaatattcgttaggtgaaggttgacaatcatgttattaaagtcttctgtatctttactgattattttgtttgttcttgctgagttattttaaaatctaccattgtgcttgtggatttgtctacttttatttcaataaatttttctttattgataaatttagacttcttaaaatttccaagtgaactaattttattatcaatattaagttaaagtgtgcctctttaatttcataatgcttttttgtctcagcatctttatctgatatgaatatagctatatcaattttctttgatttttgtttacatggtctgtcatttttattttcttattagaatttttatcccttttttaagaagtttttcttgtaaatgacaaggaaatatattttatttggacagtctttatcttttgtttagacagtttagtccatttccatataatgtgctttctagtatatttggatttaaacttagtattttactgtttgatttttatttattccatgtcatgtttttcccactttttttgtgtccttttgggtagattgtttcctattactttattatccccttttattaggtacacattcttttattcttctattaatgattaccctagagattacaacagataccattgatttatcataatctaacataaattagtactttagtttcctccctacagcatagtgacctcagaatattataactacacttgtgctccttctgactcatatacatttgttgtcatagctttttttttttttttttgagacagagtcttgctctgttgcccaggctggagtgtagtgcgcgatctcggctcactgcaaactccctctcccaggttcacgccattctcctgcctcagcctcccgaatagctgggactacaggtgcccgccaccgggcccggctaattttttgtatttttagtagagacggggtttcaccgtgttagccaggatggtcttgatctcctgacctcgtgatccacccaccttggcctcccaaagtgctgggattacaggctgtcatagcttttaacctgttacttgatttcaaccaaacttttttattgtttcataatgtcaatcaatgtacatatatattttgtatatatttaccatttttgttgctctttatctttccctgtgtcaccgatcttctaactagagtcattttccttgtacctgaaaacattctttagttagtttctttagtgtggctcttttggtgatgaattggctcactttttggttgtctgaaaatctttacccttcattcttgaatatcatccgtaggtataaaaatataggttgcttttattatcactttgaaaatattctgttgtatagtatcttccattctttttcctgcaaggtcagctacttgtctatttgtttttttgtttgtttgtttgtttgttttttgattttttttttttgattttttttttttattttgagacagggtcttgctgtgtggcccaggctggagtgcagtggtgcagtcacggcccactgcagcctcattctcctaggctcaagcagtcctcctacttcagctttccaggtagctagtgatacaggcatgagccaccctgtgcccagctaatttttctaatttttgtagagatggggttttgccatgttgcccacgctggtctcaaattcctgggctaaaatgatcctcccgtcttagcctcccaaagtgctgggattacatgggtgagccactgtggccagaccagttgttgcttttttgtaggtgatctgttgttatttcttctggctgcttttaacaaacattttgctgtctcaagcacctgcttgtggttttttgtttgtttttggttttcattttgttttggttttggttctggttcttggaagaagatcttgaatctgtggcttgatttttaaaatcagttaagttttcagcttttatttcttcagatacttctgtatcatttcttttcttctatcatttgggattcagattataggtatccacacccttgttaagtatacttttttctataatttttctaattctcacatagttttttgttttatatagtttttcttcttatttatttttgtaaggtaatgatcagttattttcttccatatggatacctcatatacctttcttcccaatctttaaaacaaccttgccaaaattattttttgccatttttacagatattattcagagaggttaacgcccttgcctaacttcacagagcagccaagcaatcagagctaacatttgaatcaaagtcaaatcaatttagtatttcttgctctaatttattatatgaggttatggttccttttttctgttttgctcacttgatttttggagatgagctgttattcaaaatgttgcatacattaatgaattagtctgtcttaaaataacatttttccatttcacctatatttattagataaatagaagtgtacaaatttatgggccaaatattatcccccttaaggaatttattttctacatggaaacaagaatgtatacagtttattctgatagaggatacgaagagatagtttccatggttagaaacaaataagaaggtagtgtctcaagtgatggaattaagaaagaattcattgggtaggtagaagttatgaaaagaaaagatggtaatgtgaggatttttgtttgtttacaagagtgaaaaacagtttgttattacaaataaagaaaatcagtactaatatttcatgttctatttcccccaacaaatctctttgtacatactttgtcactaattgaatagtcatgtaagcagtgaaattttgtacgtcatgatacattatacacagtgattgaaaaagtcttttttccccaggttatttcatttctggctgcagttttgcataaaaagggaactcgtgaggatattgaaaataacatgccagagtttttactaagaagtatgaaaaaggaacccctttcttctacagcaaaaaaggtaaaatctctagacaatgtatattctactcatgatgctggtattacaaaagcatatagaaatatttaaatatcacacattaaaatgtattggtatacattttaaaacctaagaatttaaagatgttattaaaatatttgttttataggcctaatttttgaaagattaccaattttattcccaagttaaatttgattgactgtcatggcaaaacagaatttcagcttggttttgctttgaggttttaatctgttggttggctggatttacatgatttacttaggttgatttgttaaacttacagaatgtatatgtaaagttaattgaaaccttcattatattgttttttatttatgtgagaatgaaaaggcgatagttacagatattggtaacaaaagtgcgtcattgacttatttcaagttgcctagctaattgcatccaaaaaatatgaaataagttctaccaatataggaaagttggaatcagaaagactaggtaggtctgtgcttatttctctttctgcccatatgactgaatgctattcatatccatacttcagttttcttcttcataaacgtatgtttataaatacgttatatatgattcttacaaaaaagatttctaataaagcaatgaaatataaaaaagtatattatacttacatgtcttttaaaaaatattatcctcagcctccaggaaaccagataagaataaaaatgaagtgattttatgaaatcttttattatatttggtaatgagctacttacagcaagttttaaaacagactcttttatacaagtcttatgtacaagattgctgagaagtccaagtttactcttgtctatcataaagaccatttcaatgcaaacttttcagaactactggcttaagatataattgctatcattttaaattctctttatttttcagtagaataaatgcatcctgagtatcagattcaatgtgatcctgaagagaataatggttcttaatgtattttaagtattcaatagctcaagtactgtttttagctctggattcagttgttccctggttctaaatgtcaccacagagcctatatatatctcttttatgccactgtgacagcagatagaagagagaacaaagaaggaaaagtaatattttaaatatattaaaatacttaaagatatttaaaatattatagaacaagaatgggccaggcgcagtgattcatgcctgtaatcccagtactttgggaggccaaggaaggcgaattgcttgagcccaggagttaaagaccagcttgggcaacatgtcaaaacctcttccctactaaaaatacagaaaattagtcaggtgtggtggtgtgtgccagtagtcccaggtacttcggaggctgaagtgggaggatcacttgagcctggggaggttgaggctgcggtgagccatgtttgcaccactgcactccagccagggcaataaagtgagacccctgtctcaaaaaagaacaagaatgaaagaaaagaaagttaacaaagatactcatttgataatgtggtaaaatatgcttataatagttacctcagttgactccagttcctctccttccttctttcctttctttctttttttctctttatatatatatgtgtgtgtgtgtgtgtgtgtgtgtgtgtgtgcgtatgtatgcatatgcgatgtatcatatcacacacacacatatacagttgtcccttggtatccatgtgggattggttccaggacctctcttgggtaccaaaatgtgtggattctcaagtccttgatataaaatagtgtatttgcatataacctgttatcctcccatatactttaaatcatctgtagtttacttagtgcaatgtaaagtctacataaatagcttttatattgtattgtttaggaaataatgacaaggtctgcgtacatgtttagtgcagatggaattttttagtatttcaatttgtagttagttgaatccactgatatgaaacccacagatatggaggaactgtaaattccttgctataatgtacattgctatttaccttcttcagttgatttcttaatttatttattttcagtctttttgtattctaataaattaccttaaagctataagtgttcctttgggccaggcatggttgctcacacctgtaatcccagcactttgggaggctgatgctggaggatcgcccaggagtttgagaccggcctgcgcaccataagaataccctgtctttacagaaaataaaaaaataaaacaattagccaggtgtggtagtgtgtgtctgtggtctcagctactggggaggctgaggtgagagaatcgcatgagcccaggagttctaggctgcagtgagccgtgatcatgccaatgcactccagcctgggcaacagagaagaccctgtctcaaaaaaaaaaaaagttcctttcagtactcctttgtctgtgttctatagtttttaatatgtagttttttcgttagtcttttctaaattatctgtggccctaatttttattctcttttacccaagtactatttgaaagagaaattaaaaaatttccaagtgaatagctattgttggggctcaggatgatgggagggctgaaccctttttgacaattctagttttgttgcatcagataacagccttgatatttttttctttgtgattacatccatggatcagtttttatgctttgatgtagtgcattgtgtagtctctgttgttttaaaatgttgcttatattgtgcattctttgtaatcatggtcacatggttttatatatttctatttaatcatgtttgttaattgcattgttaaaatgtttaatagtgttattttcttcttgtctgaacagttggatctggaaagaaaaacgttaaatttttttatttctctttgtgttcataccaactttttcttaacgtcttcagttaattcttcagaggccaggtgtggtggcttgtgcctgtagtcccagctactcaggaggctgaggtagtaggatcacttgagctcaggaggttgaggctgcagtgagccatgactgtgccactgcactccagcttgggtgacagagtggtactctgtctcagaaaaaaaaaaaaaaattcttcagtaaattttatgtgtttgtatattgctctcacacttgattatccataggcttatctgcctatggaattttaagttcaaaattttcttttataatgacaaaacatcttctgtcactccatattgcagatgagagttcagtgtcaacccgatttttttccttggaaaggattttttttttaattgtttggaagtattaaggacttttttaattgatgaaatttggaaatttccatgagccctaacactcaccatagaattcttccaaataagttttgctttagaaaatatatatacagtgctttatgcagggaaagttgcatactgatgctagaatcagtttctttgatgactggtgtaacttttccttcttaaaattacttggccattatttttcttgacttagtctttccaactaccttagctgttttgttgagttttgttttgcttgttgttgtttttaggttccttctaggaaaagtaaattttttagcgggggagggcagggggagtttttgctttcagaggtgtagggcggattgctcagttcttcaggtgtgccagttctcatctgctcctgcactgttctgacctgctggtactgcccttccaggcattctgccactattatggatttattatgtttgttcttttgtttcattggcatcaatacaaacgtgttgagttagtcatttgaactggaatttagagtttttaatggcatcaccagtgacattctacagtatttcccagaagtaaatacaaacaaaaattataactttgaaagttttaaaagataaatttgtattggttcatttaaaacaatgtatgttttaaaaagacagtttatgaaatggagaagaaatcatttcttttgtatttattatgctaatgccagaattacaattgaattctgaaaaattaatgttgaagcttgttgaagaaagccctttaatgaactgaatgttacaaattaaggagtggtgggtctaaggtatgtgtgtgtgatacgatacatctcatatacatttaaaaacttttcaagtgtgaataaatcatctgaataagaatgcatgaatgttttgtgccaagaataaattcttaaaggaaaagacacaagctctacattttaaacattgatttttggaatggttctttagatgtaggctaagttttgattgaaattcaatttttatgaatcataataaatttattataaaatattactatcttgcatgatgaagctttagagattctaagtaaaattcataattaatgcaaaagaggaggatttttgtagcaatcacaacaccagcatcggaagcaatttcaatgacaatttaacaaaaatattttataattattttatttactatacactatttttttagttcttcatatgtaccaagaggattatgttgcacatgatgctaccgtgagcatccttatgcacaacttttgcaataataactgtaggataaattcttagtactggaattggatagcaggtagagctggatttaggggattactttttgataactggagttaaattaccccatatccccacgagtgatgtataagaatgtctgtttccaccttttcgtttgcactaggtattagcaaacataaatttatgactacctgagagatttaaaatttttatcttgctttgatttacatttcttaatgagtgaagctgtagcatttcagatgtttaaaagctatttttaaatctaattctcgtttttaatcatagtccttgattaatagtccttaacgatatatcctggaatctaattttttgttcattatatattttgaaaatatttcttccccatgtagagtcagctttgaattatttattgattttttaaaaatgtttatgtggttacatgtattggtctgtatagtttctgggttttatgtttgcctagaaaagccttttgtactctaaatttataaatacattcattcatggttcttttataatatgtgtgattttattttatacctttatatctttgtttcagctagaatttattttgctgtaggtgtctagtaatccaattttattttcctcagttggttaaccagttatcttaatgtcatttgttgagtaagcctgcttttccacagtgatttgaagggccactttggtgtaaaattaaactcatttctatttctagacgtattattctgtcctaattatttgttcatttctcttccagtgctaaacagttttagttattttagctttataatgtaatttattatttggtagttactcctcaagttttctcaacttatgaaaaataaattttctcaaatttctcctcaaaacctattgatatattagttgatgttgtgttgaatttatagttaactttgcttgtcatttccattcttatatttcttatttacttctcttttttaattgcaagagttgatatttattgatctggtttgtaactttctgttttgatagaatatcaagttttggcataatgccaaactttaatacttcatatagtacttagaaaatagaaggtgttcaattgatgaatgaattaataattgaagccatacatgtcagtgctaagttaggactaataatgtatgttcagaggacagtgacagtagagttgaaacaaaggtttcacatgggaagaagtgtgatatcaaaatgaaaaataaattatacctttacagaaaaattacagaatgtaaaattggaatctttgctagaaaactcaaagtactaaaaaaaaagttttcgtatttatctctacaatcttaactctctcaaaaatacccaacataggtaattaatttatttaatgccaaaacttgatattctgtcaaaaattaggctgtttttatacaaaggacttggaagagcccctgactacagtggattctaaactgaaatttctgtatatgaaataactgcagcatactgaaggagaaaatgatcagctatacacacagtagggtgtaaattaattatgttaggtatttttgagagagttaaggttgtggcgataaatacaaggctttttttagacctttgagttttctagcaaagattccaattttatgttccgtaatttttctgtaaaggtataatttatttttcattttgatatcacacttctttccacgtggaacctttgtttcaactctactgtaatctcactgtcctctgaacatatattattattccgaacttagcattgacatgtatggtttcatgtattcattcatcaattgaataccttctattttctaggtactatatgaagtactgaagttaaggtaaataaagttacacatctcaaggacgtagactttttgattgaaggtgctaacaggatatgtcatggtagttaagagttttagaattaggcagacctgggttcaaatacttactttgctacttaatagcagtatgaccttgagtgtgttgcttaatatctctgtacctcagtttcctcatctgtgtttctgggtaaagtccctgaattaatttctgtaaactacttctaaaggccttggcacacagtaagtgctcaataattgttatgttattattaatactattactacttctgccacaaaaattgtcacgttaatctttgagtatctcatcacagtccacactacatcattcttctatgccgtggttcctgaggaatcagatttgatagaaaactccttaataattgagcaagatttattgaaagatataaataattcagtattctctagttgcattatttaacctagcttctgttaattttaataatacgtaagcaaatgaattttaattttatttgtgttaattttatattcagttttataaaattgtattttagcttcagaataagaattatcacccttcccccatgtctacagcaataccactctgaacacaccacatctcgtctgatcttggaagctaagcagggtcggacctggttagtacttggattagaggaatagctcccagagttgctttgtgtgtagtgacttagcagttggacactgctttccattttattattttggcatcatttgcttaaaaaagacttattaaatgaaatattatttattggattgtaggaaatgctaagttcttatgtactttccctggactctgcataatagcataactcagttctctgacatctttcactaccaaaatgaatttttgaaccattatttcacctttcataattttgaagaccaatgtttgtaagaaatatcaagaattatgttgccaccttaatttttaaacatcttctggaatcttagggctgatgccaggactctttagattcattggcacctttgatgaatggcctctcaagtggaaaactactaagactgctcagatgcaatttgcacctagcattgtcatctcgtaatatacaaaaaaatcaaagggagacactgtaattggacttagtaattggaggcctaatttcatatttgaaagttaaaaatggaaatcataggattaaccttcacccaaaggacggacatacttgagatgaatcaagtataagaagtacttacatatgcttgatgatggcttgggaaaaaggaactctcacgttcagcatgttgattttctttcgttttcttctttctctttccaaaacacagtcacaaatttgactttttagagttgacaaatggcctaggttaaatgtttcacagaaaacagagcagaatttagagcagtattgtattatttcttggttaaactgaattttttcagtatgtttaattggttcatctctatcaagtagatcaagtataaaactttagaaaataatcgtactggtaaccctattaaacttaacaggataggaatagtggtaacagggagaaataaaaacattaaaaagttaaaatggttgatgacagcaggattctgggttagtacaggaaaggtacatgaatgtgaggaataaccagagagttacgttggtaatcctcagagggactgatttggtaggcattattagggcacaagtcccatttacctgagtttcaagagagagcaggaggagagttaagcactgataactcttgatctttgctatagggagagtagagtaatgaggtaatagagatagatgttgggttaaggaaaagaagttttaaaaaatttttgtttttcggatttttttaaccctgggaaatattctaacatgcttgtccataggtgatgtggttcattaaaatggaaaagttaatcaggtaggggagattgggggcagtttctgcagcattgactttaggttggcaagaaggaatgggagccactgtatgaggggtttttttggagaagaacatgagcagcgtacccatggcaacaggtgggagggcaaaatatatggaaatgaatatagataggttattgataggatactgagagaagttcatccaggaagttttcttctgattgcttcaattttccagtgaattttccagttctttaactgagagtatctgaaagagggggagcggaaatgggctaggaaaatgcagaaggaaagagagctccaggagaccatatatttcaagaacacgtggcctgcttgtgtatgtacattacccacttggcctttgaagctattactgggatccagattttattcttttctctcttttggaaagttacttctctctcatttctcagtgcctttttggtagggggaaataaaaaacacgtgtttctttgagcaaggttaggtgtctgtcttgtcctgataaaaagctaattaaacagcaaattattttttgagaatcttcaatgtccagatatagctaatcactcagttgtatttattgttactaactagatgtcaaaattaaggaagaggactattgatattgatattgtggatttcactttgggattctttttcagtttttaaaaaacagcaaaatttttttattcttgttttagatgttcttaatagttgctcctctttctgtcctctacaactggaaggatgaattggacacctggggatatttcagagtcactgttttacatggaaacagaaaagataatgaattaattcgtgtaaagcagaggaaatgtgaaattgctctaacaacttatgaaacactacgcttatgcctggatgaacttaacaggtaatgggaataataggaataggaatgattgtattaatagtctacttacatccctttatattaagagtttttttttttttttttttgagacagagtcttgcttttgtgtttttagtaaagacggagtttcgccacgttgcccaggctggtctcgaactcctgagctcaggcaatccacccacctcagccttccaaagtgctaggattataggtgtgagccaccgtgccaagcctatattgtgattttttaaaaaggaataatgatgattcctttgcttgatttaatttcattttagaattattgaaatatttagttcataataacttactctctgagaaggaaaaacctgcatcaggttttctagaacttcttattctatttcttacattgaatacaggatacttcttcaaacactgattgttaaagaatgataagacttgtcctaaatctcatgtacagccttttatgcagacactgcctctgaactaggtcagtaattttcatgaattatttcaattatgggagtctgttgtgaatatagaggggcaaaaactacacacacacacacacacacacacacacacccccacacccacacacccactgtagcatagagtgtgagggagaagtggccaagaggtaacaccagtgagataagcagggaaaagattatagagagtattggaaggtactttgaggattttgatctttatcctgagagcaatagagtgccccctacagtgttgtcagcagattaccgataggataaaaatgatcagatttgcactttgtaaataccttagcttctgtgtgtgcagataaaggagagccaagctgaatggagaaggaccaattaagaggcttgttatgtgctgaattgtgtcgcttctcctcaacccccattccacaatttaaatgttcaggtctcaaccccagcacctcagaatgtaactgtgtttagagacaggtctctttgattaagttttaaagaggtgattaaaaccgaggctgattgggtggggcctgggtccagtatgactggtatccttataggaagagaaagagacaccaaggacacacacacaccacagaggaagggacttgtgaggacacagcaagaaggcagtcatctgcaagccaaggggagaggcttcaggagaaaccaaatttgctgacaccttgctcttgaaattcgagcttccaggattgtgaggaaataaattttggttgttttaagccatccagtgtgtggtattttattttggtagccctagcaaaccaatacaaggcttttatagtaatgtggtcacgggaccatggtagtgaggtctgaagtcttcatagttgttccagcagtaggctgggccttggtaaaatcattagtttccatctgcttgtagcctagatttgtctctacagggatacaatttataccttttaggtgaagattaaagcatggcattagaaacagttatctagtaagtctttaaaatgtttagacattatagttatactcaatttgaactactgctaatgaaggagttaatgatattcccccaaagtcaaccgaagtttagaaaattggtaatttttttaaggtgatactttcacatcagcattaaaatgatttagcataggatgaaaatgatgaacaattgatagttgtctcaaattttatgagcacacaaaaaagagagtaaaaaaatcactaattagccatgtggctttgggtaaattagcccatctggaaaatgacagaggatgaattaaatcagtctttgtgaaaactagcccctcaagcccagctggagagttgtattaaaatcaactttaatgagagttaatttgtgtagaataattatgccatttcaggaatacaatttgatgaatcttgaccagggattggtaaactttttctgtaaagggccagatagtaaatattttaggcttttgggccacatatagtctcggttgcatattcttcttttttatttttatgaccctttaaaatgtaaaaactattcttagcttactgaccatacaaaagtggccacgggctggatttggccatgggcagtagtatactgactcctagttttgacaaatgagtgcaatcactatcccaaacaaggtaaaaactatttttatcatcccaggacttttcttttacctctttacagtggcttttcctcaaccctcaccttgggcaactactgattttaatttctgccacttataggtgagtttaagctattacggagcatgtcaatggtattatacaggaagcacccttttgtgtgtgtcgcatcttttgttcagcatgttttttgagattcattcatgttgaggagtgtatcagtgattgttctttcttaatgttgcattgtattccatttcatcaatattcacattttgttacccattcatttgaggatggatttttgggtttttccagttttggattattatagataaaacttcaaggcatatttgtatgtaagccttttttggacatatgttttcatttctcttggagtagaattactgtattatatggttaactgtaggtttagctttagaagaaactcccaaaccattttccacagtggttttactccagctagcaatgtgtgagagttcagttgcttcgtattctcagcaacgtttggtattgtcagtctttttgttttagctgttttagtagatgtgtagtagtatcttgtagtgtaatttgcatttttctgatccatgtgcacttggaaaacaatgttctatagttattggatgtagtgtttataaatatcaataagactagattggccaagatgttgcttaggtgttttctatctttgctgatttccttttcgattggcttacagtatctgagagaggagagttgaaatcttcagttgtaattgtagatatgtttatttctcctttcacctctgtcagcatttaatttagtattttgaagctcttttatgaggtgcacatgcatttatgattgttattttttcctgatgaattgatccttttatctttaaaaaatatacctatttatttctaataatatctcttatcttgatgttttatctgatatgagcatagccatattgtggtacatttcagtagtttgttcctttttattgccgatggtactattatatagctatcccatattttgtccattcaccagttgatggacatttgaattgtttccagtttttgactgtatgactaatgctgctgtcttatgctgagtcttatgcttactgcatgtaaatagcttttcctgtttttattgcagtatatctgttcttaatatttggagtgagtctccaaatattgctttttcatccattcggataatctttgcctcttatttgggtatttagaccattcactttgaatataattattggtaaaattggatatggagctaccacttttgtcaggtctgggatttaattttataaatcaaacttacaagctaataaattagcctgttactatttcatggatcctgacagaagactaatctgaggcatagagaggttaaataatttttctaggccttcacaactaagtcagtggcagacatgaggactgaaccttgaccatctaacgccagacctcaggttttgttttgttttctttttgagatagagccttgctctgttgcccaggctggagtgcagtggtgctatcacagctcactgtaccctcagtctcccacctcagccttccaagtaactaggactacaggcatgcgccaccatgcctggaaaatgtttttgttttttgtagagacaaagtctccctgtgttgcccaggttgatctcaaacttttggactcaagtgatcctcccacctcggcctcccaaagtgctgggattataggtgggagtcaccatgcctggccaaaccttaggtttttaaccaatatactgtaccaccccaaaagatgttttgcaattagataaatgtaataaattcttctatcatagcatcagtcatattttaattatttcttacctgtctgtccccttagactgtaagctctttggtgtaggaaatttttatctttaatttctgtatctcagtacttttagcacataagagttgccaaataaatgttttttaggtgactttttttctgattgttataaatattgttataaatattaaataagaattctgaagtagaattatgtaactataaatcatatatttataagattagaggaatgtttatgattttatatttatttatttagttgaatttatttgttcaaatgcctttattttgtttgtgtttggcaaatatttaaaataattaatattttacctgagcaaatattaagttgtttttgtgaggatagtgctctgtgcatttatcacagatactctgtggaggggatgaacgtgctatgaactgaatgtgagtgagctgtagtttttttcttattgctgttatattttttacttcatttcagtttttatcaaagttaattatgtatatgatttaaagagccaaacatgataaaaggcttttagtgaaaaactgcagttcactgtccgccaattacctttacctcaactcttactgatcttcatagtctttacttccttattgctaaagaacatgtttatgctgcaacttttcaatttttctttagttttcagcatcatctattgatttctttttaaggaaaattaggatttttgcccttctcttgcccgctttaggatgacctggcccatctactttgtgcagtgggaggattcttaaacagactattgaacatttacatgactccaatttccagaggcatctggagccaccaattcttaacttttcaagaatgtgtaaataatatgaattagattgcttcttggctttttccactattggcataggacactagtctctgcttttgtcagccatcttgtccatgttctttttagcttctagaatttttgctatttttctcctgtctttgttcttgaggcttctagcttttttcagctttatattaagaaaatgatgaaacctatagaaaagttaaaataacagtacatgagcatctagattccaacagttttgtgtgtgtgtgtgtatgtatgtatatacattcaaatgttggcaaaatgtaagttaatgtatgtaaatgtgtgtgtctatgtctatgtctttgtgtacggtggtggtaatgagtcatttcagcaagttgcataaaacatgacatccttatccctaagtattttagcatggatttcctaaaactagtgatacttcttgtcataccacattatcattgtcacacacaagaatattaatagcaattaaaatttcctcagttattctcaaaacatctttaatatcttatgtttataaagcaggattcaataaaggttcaggtgatgaatttggttgtctgtttattcttctaatctacatcatttttccaacttgtattttttaattatatgactttttgagaggaccaggccagtcagttgttttaggatatctcacatattagatttgtctgattactttctcaagatatattcatctgtcatctgtattttagtaaagtggttttggcccaaaggcttaaatagattcagattaaacatttttggcaagaatgcttcataaatgatgctgtggacttcatattgcatcacttcaggaagtacctaatgtcaggttgtttcactgtcagtgatgccaagtttgtcccacaggttaagaaggttaccatcatcagatctctccattgtaaagatatgtttctccctttgtaatgatcaaataatctgtggagtgatactttgccaccatttaaatatcctggtatccctcaatccttttacttagtagtattagcacatacaaattgttcttgtctgaatcagttactttattatgtttggcaaaataatatttttctaattttattatttcttttctacacattaattaccggtattctcctgtaaaggaaagctttctccattaattaggaattaaccacaattttgactttaaaaaagcaaggtgaatgctcgattctttttctttaatgactaatttttggagtaagaagttagcataatggtcatctacaatggtggcaaagtttcttacacccttcgcttgcttgcccgcttgcttgcccgcttgcttgctttctctctttctctctttctttctttctgaatattgctatggacttgaggattattgaagtatatttgacataaaacgtacccttgtaagttagaatgatttttagtgaattttaaaagttgtgctattaccacaatctagttgtagaacatttccatcacctcagaaagttatttgtctatagtcagtccctgcttccatctccagtccctggcaactactgatctgctttctctttctatagatttgccttaactgggtatttcatataaatggagccattcaatataaagtctttggtgtctggcttctttcacttaacataatgtttttgaagttcatccatattgtagcacatttcagtagtttgttcctttttattgctgaatggtactattatacagctatcctgttattttgtccattcaccagctgatggacatttaattgttcccagtttatggctatacaaatttgctgctgtgaacattcacatacaagtctttgcacctaagttttcatttttcttggatagatacctaggaatggaattgtgaggtcttatgctaagtatatgtttaactttttaagaaaccgccatctgttttagaacaatcgctgtgcttttccaaaagcagtgtttgaggattctggtttctccacatccttaccaacacttgatattgttaatcatttttatcatagccattctagtgggtgtgttgtggtatttcatgttttaatttgcagttctctaataactaatgatgctgagaattttttaatgtgcttatttgacatctatatcttcagatagacatttggtgtctattagaatcttttgctcatgttttaattgggttgttttaaattttgttgagttataataatttttttttttgagacggagtcttgctgtgtcaccaggctagagtgcagtggcgcaatctgggctcactacaacctctgactccctggttcaagtgattctcctgcctcagcctcctgagtagccgggactacaggcacacgccaccgcgcccagctaatttttgtatttttagtagagacaagatttcaccatgttggccaggatggtcttgattttctgacctcgtgatccacccgcctcagcctcccaaagtgctgggattacaagcatgagccactgtgcctggctgagttgtaataattctttatatattctgtatacaagtcctgtatcagattatgatttgcaatatagtctgtagcatgtctttttattttcttaatggtgtcattggaagagcaaaagtttttaactttgatgaagtccaacttatcacactatttttaattgactataagttttgtgtcatatctaagaaatacgtgcctaatccagagtcgcaaattttttttcccattttttaaaagtttgagttcatatttaggtctgtgatctgtttttagttaattttcatgtgtggtgtgaagtaagtgtttaaattcatttttttcatagaactcctggatttttgtttattcaatattttcaattgtagtcaatatttgtaacaatgctcaaatattccaattaggctggcgtctctattctttggacatattcgcatttgtctttagatacatctgtgcttttcggctgttcagtgtttcccccaacatatgcctgaaatcagctgtttctccattcttccgtgaggctctcattcctttcagtaaagagaccactatgggtgctcattgctactggggtaacaatcaactctaaactttcttagtggacagggctatggaatacagcttttaaaaatcatgagtttatattgatatttttcattcagaaaaatattgcaataaaacattgcaagttttatttcttttatatttgtttttctggtttgttactttaaaaaattcctttattgtcatttcagtgatgtttaaatgaaatttttctttttaccatcattaaagaatgtctataccctttcttttctacgcattttatttttgtcgactgtccaagggtgtgaccatttaactaagtgggtaagaatccaatggagtcatcaaagagtaaaaaggaaaaaataattccaaaactttgatagagaaagctactgtctaaaattgtaaggactaagaaaggaagttttctcaacctcacccttcttttttcttactttatagtttggaatggtcagctgtcattgtggatgaagctcatagaatcaagaatccaaaagctagagtaacagaagttatgaaagctttgaaatgtaatgtccgcattggcctcactggaaccatccttcagaacaacatgaaggaactgtggtgtgttatggactggtgagagaaaacactttttaaaaaattgtttaatagttcttcagctgaatacggtcttgtttgctaatcattagtttccaaacaaacgaaacagtcatttgtctggttttagatgtgtttgatcccagatgtggtatacacagtagagagtcccatgaaaacctatctttatatatattactcttggtccctgaagtaaatatacatgttcactgccagtttcatcctcatatcatagttagaacctgaaactgtcgtaaagaaagaacattctgttttcttggcttttgtttttgttaccgttgataatcaagtaatgtagtatatctcttagaagcaagaagttagtgtttttagataataaagcccttacatttttcttattgtctttataaagggctgtgccaggccttttagggagtgggacctacttcaagaagcagttttctgacccagtagaacatggtcagagacacacggcaacaaagagagaactagccactggccgaaaggccatgcaaagacttgccaaaaagatgtctggctggtttctcaggcgcaccaagactcttatcaaggatcagttgcctaagaaggaagaccgggtaagaaccgcatttgtatatattattaatttgtggtcatattttttttttcctttttaagaaaaagtctgtctcctgtggcattttgtaaatacagttttttgccttttattctgtatggaaaaaattgttgcgcgcagaatttcagaaaccattgattgagctcagttgttttccttactgactttattaacctgttagctaacaggtttattattagtatacattaaactcatttctcatcaaaaccttttttttttttttttgagacagagtcgggctctgtcacccaggctggagtgcagtggcgcgatcttggctcactgcaacctccgcctcccaagttcaagcgattctgcagcctcagcctcccgagtaactgggattacatatgtgcaccaccacgcctggctaatttttttgtatttttagtagagacagggtttcgccatgttgtctaggctggtttcgaactcctgacctcaggtgatccacctgcctcggtctcccaaagtactggaattacaggcgtgagccaccgtgcctggcctcatcaaaacttttgatgcagtttttccccagtaaagaaggaagagcttctctctgcagtgtgttttctgttcacacgttgtccttcctatactgtgtactatccaccacacagtgtattctttggtaccttaattctagctgtaggatcaaagtggttaagagctttttaaaaaatatataggtttgtttcttgtagaatgctatttgcagttacacaactaacctaacttttagaatttgtaggaaaactacattgttaaattgttcaagaaaatatgaggagtggacttcaagaggattttaaaaaaatatagtagtcttcttttatagttcttcatcttgtgtttcttctagcttgggcaatggaataaaggttctgtagattactatggaactaaacctaattaatgttgtcccaaataagggcaatcctatgaaatgccctctaattttagtgtatcctcttgattgtttctttaaaaagatagatttgaaaggaaaatacgatattgatatgcaagttggggaaatagatacatctgacttttgatatttatctaaagcaaatattgttactaaattgagatacttcatgaactctcacttttaaaaatgttttatgcaacttcatatatgtgatttagctatctgtctagtaggaacagtacaaaagtataagaaaagaattgttcatagaggtttagagcttggcctctgaaatcaaatactatttgattagagtatttgtgacttgcagcacctctgcttagagttttgtgacttggagcaatttgtgaggccctggaacctgggtttcttcctctgttaaatggtagtgatgataatagtgcctgcctcacatggttactctgaaatgcatgacacataagaaatattgagtaattggtactatgtttaataataataaataactgaagatacctttgtacttcaatcattgaccaccaacttctatattctctttttttcttatatgtacttttatatttaaggttggggtcaggctgtactaaatattttatataaacattttttaaaaatctagcatcaggagggggcaggctggatgtgtgctgccatgcatccttcttcagtctggtttgggtctttaaaaaataaaagataaaaatagcttccaaaagagttgtggtcatcctggctaaaggagcagaggaaatggaggcagtcagccctgtagacatgatgagacaagctgagattaaggtcaccattgcaggtctggctggaaaagacccactacagtgtagctgtgatgttgttatttgtcctgatgtcagtcttgaagatgcaaaaaagagggaccaaatgacacgatgtttctaacaggaggtaatctgggtgcacagattttatttgagtccgctgccttgagagagatactgaaggaacaagaaaacgagaagggcctcatagctaccatttattcaggtcctgcaggtctgttggctcatgaaataggttttggaagtaaagttacaacatacctacttgctaaagacaaaatgatgaatggaagtcattacagctactctgagaattgtgtggaaaaggacggcctgatttttacaagtcggggggcctaggactggcttcatgtctactcttgggattgttgaggcctaagagccaaagaggtggtggctgaagtgaaggctcgacttgttcttaaagactagagcagaaaaatgtgaccatcagttagagaaataagccatttggaatccattctcattgtgttttttaaaaacagaaaaatggtaggttaatatgctcagaagccatcatcagtcctgctgttgtgaagtaacaactacacagagatttctcaacctacaaattgtgtctgtttttttttttaagacggagtctcactctgtcacccaggctggagtgcagtggcgtgatcttggctcactgcaagctccgcctccctgggttcaagcgattattctgcctcagtctcccaagtagctgggactacaggcgcacgccaccatgcccggttaatttttgtatttgtagtagagacagggtttcaccatcttggccaggctggtcttgaactcctgacctcgtgatctgcctgcctcccaaagtgcttggattacaggcgtgagccaccacgcccggcctgtgtctacatttctgagcctgtttacagaataaacatggcatttagggaaaaaaaaaattagcattgttttatagagacattactgtatttgcttgtatgcacctttgcctgtttattgccaataatctgatgtagtgatataagcatacaaatatttacaaatatttatatgtttctattttacaaataaaaaaatgtcactgctttgtccctgaagtcaggaagtgccttgccagtaaaggactaccttttaaagttattttgatgttggataatccttgtggccacccagaaccccatgagttcaacatcaaaggcgtcaaagtggtccacttgcccccaaacacaacatgtctaattcagcttctagatcagagggtcataaggacctttaaggctcattacacctggttctctatggaaaggattgtcaatgctgtggagaagaaccctgatagaatatcatgaatgtctggaaggattacaccatttgaagataccgtcgttgttatagaaaaagccatgaaagccatcattcctggaatagtaaattcctgctggagaaaactgtgtccagatgtgcatgacttcacaggatttacaacagagccaatcaaataaatcatgagaggcaaaaaaggtgaagggtttcaagagacggatcttggagaaattcaagagctaatttaaagaaattcaggacaccacaccagaggaattaatcgaagatgacttgatgcagataagtgctttcaaaccagtgccagacgatgaggaacaagacgcagaaaaagcagtgccagaaaacaaattgacattaaataatgtggcagagggattctgattatttgagactgcttttgacttcttttatgacatggacccttctatgatatgggcactgaaactaaagcaaatggtggaagaaggactggcaccatatagaaacatttttttagagaaatgaaaagcagaaatgtcagacagaaattacgacatgtttctgtaaagttacaccaagtgtgcctgcctctcctgcctcccttgacttccttttcacttccttcacctcttcatttctgccacccatgagaaaacaagaccagcctctcctcttccttattctcctcagcctactcaatatgaagccctttatgatgacctacttccacttaatgaacagtaaagatattttcacttttttgtgattttcttaataacattttctttttttctagttttatcgtaagaatataatatataatagatacacaaagtagtgtttctcaactatttatactgttgttaaggcttccagtcaacagtaggctattagtagttatgtttttgggaagtcagaagttatacatggacttttgactgtgtggggagttagcaccctagcgccatccatgttcaagagtcaactgtgtaaggaacatcatttgtttgttcatattatgatttcttttaattaaaaaaattctatgaggtttatttgaaagtgaaattatactttatattatccagggtggggtggagagcaaagaatataagacagtcagtagaaatcatcataatgatgtaaatagagggaaaaattagtttatagcaattttcactattttttttgagacagagtctcgctctgtcgcccaggctgtagtgcagtggcgtgatctcagctcactgcaacctctgactccttggttcaagcgattctcctgcctcagcctcctgagtagctgggactacaggcgcgtggcaccacgcccagctaatttttgtatttttagtagagatgaggtttcaccatgttggccaggatggtctttatctcttgaccttgtgatccgccctccttggcttcccaaagtattgggattacaggcgtgagcctctgcgcccggccagttttcactgttataatctatgaaatcagatgtagattatgatttttattattgttataaacaaaatactaataactaccttgtattttatcttggcagatggtgtattgttctttgacagatttccagaaagctgtctatcaaacagtgttagaaacagaggacgtgactttgatacttcaatcttctgagccttgtacctgtaggagtggccaaaaaaggagaaattgttgttataaggcaagcatttcaatatatctttataatcatgcttttgattacatagtactctcttctagtgtaaaagaaagtagcagatgataaaataccttttcctcagacagttctttaaagctatgtcttaaaaaatagttttcaaaaatattttacaatatcaaatagtaatcacatataaaatacaatattcaaatatattttcaaaaagttaattgcagaaagtaagcttaattttgatatcctccattttagcttttcttgggaagtatcctttcattttgaaatttcatttcattttcaagaagtttctcattatccactaatagtaaacgaacatactcttgtataggaggcttaaaatactattctgatgttagatatagtgtcaatttaatagaaactgagtatcaaagaaagtgttttttttaaagaaacaaaatttatttgtactttttctaaccttttgtttatatttcctgctcatgtttcacctctgttttattaaattatgtcacatatctgtgtacgtagagaaaccctaagtgaatatttatctagtttgatatttatttggtctcatttattttgctgtttttaactacttcccttttttgtaatagcccagtttcctaggagccttggagcataaatgagaaggggtctgcatagcactgccactgcacttagattttgttaccaggcacctcgtaacagcaacatttccatcactgtgtgtcatgaggataaatactttctgtaataaggattttctccctttatgaaaaatatagttgtattatgatttaccaaaagtatgcttccacattagctatttgtggatattttgtgcaatagttgaccatcattttcttggaatttattgtgccaaagtaacccgataataaatgttattgtaagtgatacattttatgatgtaagcaggtgcatagctatgctggtcctttttattttctatatttttctggttacagaccaattctcatggtgaaacagtgaaaaccttgtatctcagttaccttacagtccttcagaaggtagctaaccatgtcgcgctactgcaagctgctagtacttccaaacaacaggtttggttagcattttacatttctttgtgatgctattgttgtgaatattttataaagttttaaaatagttattaaataaagtttttgtggatgaaatttaagaggaaactgatttgcttatttttaaatgtagatatcaaggagtatgtgcacttaagtttttaatcaaagtgaacaaatttaagcttaatttaaaataagaactatcttttatgcctttaataatgttcatatctttatttttcaaaacagtctttggtataattactaaataacatatttgatgggtcagttctattcctctaataatgtctgtaatggtatttaatctactgggtaaaatgaggatttataataatttgtatattaaatattagggctgtttaccaaactggcaaaaatcagtaatttcaaagtttactttggttgtttccttttattctagagcacacataaatgaaaagatgtttttgtaatgattttatatttttttctgttatagttgatgccatttaaatgtaattttgaaatctcataagaatttgatattgttctttgatagtactctttactctttgggagtatttagcaccttgttttggaaatcttaaaaaattgaaaagtaatgatcaagttaataaccacatcattaagaattcagtgccatacgtttaacatataactttaagagtttttgaattcttagtctgacttagggaagcaaaaatctttaaagtaatacattctttctaaaaagaatttttttcataaattatttcaatttatacaggtttgaatgtgttaagtggaaatatcttttcttctgccttttcccttcaaggaaacacttatcaaaaggatatgtgatcaggtattttccagattcccagattttgtgcagaaaagcaaagatgcagcctttgaaacactttctgaccctaaatacagtggaaaaatgaaggtaagtgctcctctttcaggttgcatacagacatgatacacaaaatatttattcagtggtatgacagagacaccaactaatcagaacaggtgctcagtcattcagaagagatggtggctatggacaagtggtgcaattgtatcagcatttactaggtcactatgaaccccgaatacagatggtgtgcactcgataggtcctctgtagtagttgcttcaaatatacttcaaattttccttattgatatattggacttatgccctcttaaaatgcgtgtgctgttaccacatagataatagcttgtcttcagatgtttaaggaaataacctaccagaaatataaaagctaatgcaaaacaggggggtaaggaaaggccttaccttggaattagagaaaggaatttcttgaagagtttaagatgggcaaggtctgtatgtctagaattttctgcatgttgtttttacttgcagaactagatcgtaaagttgcaaatagtcatttgtcatacacaggaaaattgacctgtagctgtgctgctcttggtaatgtgttaccgagggaagggtgggaaaagtaaggctaagttctccaaccttgacccaggccttgggcattgcctgtggcagcagcatgaaatgctgacagcttcctgcctccttgcaacaacagagtttgtttaaccccttagtgtctatcaagaatctttatttgtagattcacagatttttacagaacaaaactcaactttgttatagtttttaaaaggtaagttctttttgacataaaaagaataaaaaggaagtagttcaaagcagtttttgttttttttttatagaaatacttttagcaattgatctagataagttcatcatggtttagtttgcttgggacctctaaaatcaatgaaataaaatagaaggtaggaatatacatacatacataaagactattgcattaaaaacttgcttttaaaaaataaatgtttatattaatgaggatatcatgtgatttattaccacaacaaataattcaaatctaatgatatttcctaaggtagcaaatttttgtcatccatttcattgactttaattatttttaaattaaaatatataaaaagtccggtttagaactgagcacttactatcccacagtttaaaccagtagaacatttccagaaattatagcctcctctgaaaactgcattagtcattgctactcatttaaattttattccctgtgactcttcactaaaaaattgccagtcttgaaattaagttttataactctgcattttatattttttatatattcattaatatatacttgtaaaatatacttttaaagttaatctccctaggaataatagtgtctgattaagagaatgattaaatttaattttattttaatttttaggagggaaaaggtaagcataaattgttgctggaggctgggtagtatttttatatgtgaatgatgcaggtaatttacttggtttgtgagagagcaccagccaaacagatggatagtaataagctagggatatatttttaggactatgttaaatcatttgactaacagcatcatctggtcatatattgatttggtaatgcagacttacaggcttatcatagaatcattgcctatgggtttaagaactctaagaattgagttgcatttaccttttgaattcaggtgataaaagatctttgtttagcttgtcttgtcacaggtcagcctgcaggtgcaaggactctgaacagaatgcctgctataatctttatagcctcaaagctacacttatgaccccacctctttctcttgagtgtcagagttttgacctcaactatcattcaaggggttagtcacaagttgcaatcattcacctgatgaaaatcttcacttttctttctcttgagaaatgccgcagagccacttactgtggagggtggaaaaaaagacaggaatccagcttggtgctgctgaagtcacacaagggtcatgttcatctttctaggcctgactgaccaagttgaggaaagttaagatccaaggttccttgctgttaacacccccaaataatacgattcctttataggtggattgtcttgttctgtggaggacaactgagtgataaaacattgggtctatattgttaagactccaacatctgttgattacattgtcattttggaaatttctgggatcttaatttatagtcgttcatttagttagtctctttaaactagcctaattaagatctccagtctaaaaacatttacttttcctgtgacttgtttttgtttttactgtaaaatacttgaaaacacttaaagttgcaatagttatgataccaccccaaataatgagaatggatttctatacaatatatccttggtttaaaatgttaatatcttaagaatgaaaaacaaaccacagactgggagaaaatattagcaaaacaataaaggactggtttacaaatatacaggtaactcttaaagctcaacaatgggaaagcaaacaatccaattgaaaaatgggcaaaggatctgaacaggtacttccccaaagaagataatagagatggcaaataagcatgtgaaaagatgctcaacaacatatgtcattaaagaattgcaaattaaaacagcaaggagataccactagatacctattagaacggccaaaatccagaacactgtcaagcccaaatgttggtgaggatgtggagtaacaagaacccccatctgctgctggtgggaatgcaaaatggtatagtcactttggaagacagttcagtggtttctcacaaagctcttaactaaaaaatattaccttaaatagtcttactatatgatcccgcaattgtgccccttggtatttacccaaatgagttataatgaattaaattttattgagttttaatgagttagaaacttacatcccgacaagaacctatgagtttatttataattgccaaagcttggaaacaactaagatgtccttcagtaggtaaatggattaaaaaagctgtggtacagccatactgtggagtactatttagcaataaaaagaaatgagctatcaagctaccaaaagacatggaagaaccttagatgcatattgctgagtgaaggaaaccagtctgaaaaggctacatactgtataattccaactatataatactatcaaaaggcaaaactatggagacagtaaaaagaacagtggttgctatgggttctgggggaggaaagaatgagtaggtgaagcacaaggaatttttagggcaatgaaacaattgtgtatgatactgtaatggtagatacatgtcatgatatatttgtcaaaacccgtgaactatgtaacacaatgaataaaccctaatgtaaattatggactttagctaataataatgtatcaatattcactcatcagttgttacaaataaaccacaccaatactaataatacttgatgttatattttctaataatattattaatacagatattaataagagaaagtgtggaggaggttggaagtagggaaagaggagttttgtgcattttctactcagttctgtaaaacagaaaaaataatatctaccaatttaaaaagtcttatgtgaaattcaaattacatacttcatatagaatcagttattttattaaaaaatgaactaaatgcaaataaaacttcatatgttctccaaatgtgaaagtaatgtttacccgatccataacatttttatttaccatttgataaataaatttggttatctgagtagaagttttttttaactccatagctttttttgagggactagggggaggtagaggtcaaagttagcacaatagcttctcttgattgagtaagtgttatattgagtattttttttatttaaaagcttaaatgtttatcattaaataaattgttttagtgtttgtttcatctttcagaagaatttagactttgtatagaaaatttctttttcccctctgtggattgcttttccacattgttctggagctgtcattgccagatgtggaaataaaagtaacagtgtgactgttatacacaaggctttggactgtttgtttcctccctgaaagcactgtgtgtgggggcagattactggcattttgaggtcaaaatcaaatctggaagtcagagcttactgtaaatagagaaacaaaggggagaaaatgagaagaggtgtgtatctgactgattattctaagaaaataaatatcaagacttttagaacctagatgtaattgaacacatttcattacatccatctagggacaatttaaatacttcctaaaaggaatgctgctctataatttagtttcttagcatattgtaggtataaagaaagtgtattttggaaattaaattaatccatttaaatgcatcccataatccaaaatgcttcctttttattaaaaccagatgagatgaaataaaagtctttgggaactttacctccttattgacaatatgatgatgaataacatttgatgtaatagctaatactttatttctctaacttggaaaaaatgaaaggaattagaaaaaatgaatgaggttagtattgtatgaaaataattttaaagaaattctcaagtgatgtttatatgtataaagtgtacttttagttggaactggttcactgattttctgtggttcattttcaggtccttcagcagcttttaaatcattgcaggaaaaacagagataaagttcttctcttttctttttccaccaaggtgagttcatctaaagtatatccttgattggccagcctcaacttttgaggcataaagaataaagcatatgcctacatgacaccttacagccacattttctcttatctacacagtaggaaatagtgaggtaagcaacttgaagtttttaaacagacactaaaatttcaattgtttcagggttgctaaatatcaaactcaaagatagatttttattttctgttgatgttcttaataattacaatgttctttaagacatttcatatattttagaacttaaaaaatagcatgcatatatttatgtaaatgatttgaccagtaatattgtttgtttcttaaaaatgaaaagattgatttttaaaacaagttctgaatgttaaagccataatgttgcaggataacgggaataaatatatgggtcagaagtgagaaaaatatttattgttcttggaattataagaaagaaattatgaacaccaataattaatacttaacaagtctcaactttgtaatggtctgaaacttacttaaccaagattcatgtttgcccatcttcatacctctcgtctagttgcttgacgtgctacagcagtactgtatggcgtctgggcttgattaccgacgacttgatggaagtacaaaatcagaggaaagactcaagattgtaaaagagttcaacagtacacaagatgttaacatttgccttgtctctacaatgtaagaaaattaaatttaataactagatttttatccaattgtttttgagatttagcataatttttaaaactattactggattaatttttaatggctatgcttatttagaagcagcaaaaatactattatgaccgaaatttcaatgtcttaagttttagctaagcttttctctcatttcctttatcaacattgaattcctcttagaagtctgggtttataaaggtaacaataaaaaaattgatacttcctcctatgaattttccatggtagtgttttgacccaagtctcctggtgagaataatcagacttcttattaactggataactgagactcactgtagcagcagttttcccactgtgtcagggagcccttgagagcccactggggctaggggctcacgtttccctcctctgcctctacctcatctcaactggagcagctctgcagttagagtttttatgaaaggtaaattggttctaacccctatgtatgaatatccctttaagaccttttagagaatatacacacttctgaaaagatttaaatcaacataaacacctaagtaagattaatcccattttaggaaggaacagatcaataacttttgacatcctgtgtaataagaattttatagattcactcccactgtctttcagaatttcaatggactttaaaaataaacatatataaaatgcacaaagtaaaaattaaatcagaatagaaattaacttaaaatgaggaataaaatatacttatgaatgagccaacattgttgagcactttaattattcttgaattcctaccactaaggcaaatggggaaaagctttggattcccattttcctataaaggaatgcaagaagtaatttttttcatgcgtccttacatacagagcactaaatgacatagaatactgtggtcaattaaatttcataaaacatataagcattctaactttaaagtgtttccagttgatagatgcactaaacaatggttccaataatagactctataatgacaagcagtagtctcttatccttcttctgctcacttccagctcatttgctgagatcctccataaagttcctaattaccccttcacctctatctgtcagaaactgctatttaacctatccattgaatttttaattttaatcatacttcgaaaaacatctttttggatggcatttttgctctattaactcctgtacttggtggtgctgatccttctatttgttgtttcctctggctcttgcttatggttgatagtttcttcatgtttggtcattttttttcttttgagcttatcttcaatgggatttttttcctctggaaatcctttggagaccggttgtaggagttttctgcttgtgtggttttgctttggcttctgctgggcatcctgacaagacaagggaaaaagttttggattcctatttttctgtgacaatttgagtaatttatttcataagtcattatataaggaaccttatgtaatataataaatacattcttcagctgtgttttgcaaaagacacataagctcagtttttgtttagtttctatcattttgcaagggtttatatttaatatgttgtgacagaaatgttttcacattggcttagccattatcttgccagagtacaaagtcttcattatcttttagtttatcaactttacataagttggaacttctcttaagaaagatgattaggctactttcactactctctccccgtttttttctcacagtgtttgctattttaaaattatttgtctataaactacttttgtaactttcaatctttgtacttctgcattagatccattgaattttctcttagatctttttcctggatcccgtgtcttcttctttcttggtttgccgccatgttttactggaaaatgattcaagttttgatgtttggtccattaactttccacatgccttctaagtctttgtaatgtgtggtattagcattagcacacacccacccacccttctacttttgtcacctatacatattatgttaactattttaacttttactttgtcaagggtattaatgttttcaataagccctgtaccagtaaccggttattgtccataggttggcattaaaatttgaaggcaaaaaagcgtttacattactatgtttttataaactaaacatctttaatgcaggggcaagtagtgctaagataatttttcttaatgttcacgaccttttggtcaatgcaagatcagtcttaacatcaacctcatatgacttctctttcctaagacttcatccatgttttatgtttgcactgttcagttcacttcaaatttcaatcatgactttttcggtcttttccccctctcagtctgtttctgccctttgtaataatcctcaatgttactaattctcattcacacattctcttctgttgagtcctctgtatcctgaacctgcctcctgaaacttttattccttagtttcaatctggcccagttttctaggcctgataaagaactgtcatgttgaagctttctttcactgctcttctgtgttggatctttttcctgggttccatgctgtttttattcttgacttgcccctttgttttcctaggaaatatcctctggtaactttttaagccagaatatataggaagtaaattttctgcatctgtaaatacagaaaatgtcttttattgctctctcacttaattgatactttgtccaactatataattctaaattgaaaatcatttcctcttagatctttgaagggcttgcagcattgttttctgatagatggtgtggctaaatagatgtgcagtgccaatctgattttcattcctttttgggaactcgtaagagtttttcttcatctacactattctaaaatttcacggtgatatttgagtcttggtgtggatcttcgttcatttttttgtgctgggtacagtaggcttgtattctgaaggcttatgttctttttcaactctggaaaatgcttttttattatttctttaacaatggccttttttttttcttcctttttctctgctccctccctctggcatgccaggtcatcagactttcaaactttcaaactatattggttctttaaatctctgaacttttctctcagactttgtctttttgctctgttctgagaaatgtcatttttcgatcttattattttgtttgaaatgatcacttttttttttttttaagacagtgtctcactctgtggcccaggctgtatggtgcaatcttggctcactgcaacctccgcctcccggatttcaagcaattctcctgcctcagcctcccgagcagctgggactacaggcctgtgccaccccacccagctaatttttgtgtttttagtagagacaggatttcaccatattatccaggctggtcttgaactcctgacctcgtgatctacctgcctcgccctcccacagtgctgggattataggtgtgagccaccatttctgccatcacatttttaatctaaagtttttcttgctttctgacctcttttgtttttggagttaccttttgttttagaacatcagtgtgttaaactctagctttttatagtcatttcattcagtttatttaaagaatgatcatctggcatttttcctggggtttgttttttgtttttggagaatcaatgaatttattaatgagtttgaggaaaattggagtttttaaggtatgaagccaccctatccataaacatggtatctctttatatttatttaggttttcttagaagcattgttcaaatggatacttcgtttgaccttttataatacttaatacataataataaaacttatttcatcaaagacatgtttgtagaacattaagatgtagttaaggtgtactttctgatatacttatttgatacaggaagagcatgtggcagacctaaggaataaacagcctgcatactcattaagtgtctcaaataccagtcctcagttcgaaaagagcaatattaaaattttttttgcttaacaagtaaccctttgctgttaaccatgtaagaacagagtgacaagttttaaagtttaggtttctgagttgtattatcatcaaagggagaattatctcatctgcagagagagagagagtctagggcctttttcttcttctttaaagggagctttgcttcttcagcaaggactgaagttattacttcagaatctcttggaagattgctacctcaactagtagagatcttatctgtggctcatatatggcatctgagatggcatcatacatggttatgcctgaccttgccatcaagaaggtaactggaacagttgattagatttattcaacatagaaacctttaacttcgtttctgcttttttgctgtctaaattccacccaatcccctaacttatccatttttttaatcctttctaatactttctccctatcccacctcattcttttcttagagttcagtcaagtctctatgacatcttcatggtatgtctaataagcagttttccaaaggagaaaattcagtttctactgagcactgaactttcaatcaggacatttgggtttgaatcgagacacttgctacttaggagaccttgaacaaattaatttttgtgattgtcaattttctcgcctgaaaaatcaggatattttgcttatagaagtcttcagaacaggccaggtgcagtggctcacgcgtgtattcccagcactttggaaggccaaaacggatggatcacctgaggtcaggagttcgagaccagcctggctgacatggtgaaaccccatctctactaaaaatacagaattagccaggtgcagcggttcatgcctgtagtcccagctactcaggaggctgagacgggagaattgtttgaacccaggaggtggaggctgcagtaagctgagatgacgccactgcactccatcctggacaagacagagcaagactctgtctcaaaaaaaaaaaaaaaaaaagaagtcttgagagcaaaagaactagcatatatgaaaataccttgcatagttcctgatatatagtagatgctcaataaaggttaatttatttgcatttttgatagaaattgtaggagaaaagattatcatttttcttcccctggatgattagcatccagtgtaaagcattatctaagtgtgagttgttttgtgatacagtgtaggcagctgatgagggaaaatggcaatgcaaagcctcagaggaaagcctgaaagacagctgggctcaggaaaacagttgaggaagagaaagaaaatcattgtgttcttggattttggttttgccttttctttgtaaaaatgtaaaaatttatcatcgttgtcttacagagtattaaatacaggatatgtagatcagatagttcaaaacatgaaaagatcacaattattgttatttaaaatctattaaattatataggcagctggaatcttcaactcagtatacaaacattatatacattcagttttgccaaaagtttcctttagaaattttattccaaaagaaataagtagtatgctgatagaaaaaaatgaatctagcaaaaccaatatgtgatttttatactaataataaaaactgccaaaaaatatgtctttagtgacttctcttcactgttaccttaaccacaggtcaagttaaatgaagacaaaacttttggcttccatttaagtgtcaaaaagactctgtagcatgaatactaggcacaacttcattcttggttttgactttcagaatcatacactagttgactacaaacagctttctaagcaaaccctataatttgaaatacaatgctttattcatacttactaacttgtgaggattaagttaaggatttggggtaccatactgcaaaagtaaaattttccagatgatataagtacctctaggtagtccaacaccaggaatcatgagctttgaagggatcaggagaaacatcattttctgtctctcataacattattccaaaacactgtcaactttcccagaaagatgaggacatttcttttgttatgtaccccaagagaaagacattctaaaccactcttttcaaataaataatgagaatcatattatatgccttttgttaaaatctgcctttactgctttattttgtctcagtctcacacctttttgttcaactactaatatcttcatggacccttaatgtgcagcaagaaaaataagagaatttttgcctttgaagagcagtataatgcaataaatgctttactggagtttatgtgtgaagattcataggcatttaagaaatagatagatcaaaaaatcccatagaaggatggtgatgttttaactggttctttagagataagattttattaaaaagaaaaggaaaagcaggttttggtaaagggcattttaggcacagagaatagcataggtaccaaaataactagagaacttatgtgtttagtgcttaggatatgtggaggcaacagcttgggtgtatgactacataggagaactcatgagttattttaacgaagctcagtttaacagagtgtaagtatccactctgtgacaggccctggaggagacacgtctcttaaagtttataactcaaaaagtagaggggtacaggaggagttgttcagaaacatgtaaaaggatagttcaatacagtatggcgaatgcagggtaggaggaggcacagaggagaaagatttagttcaggctttgttaatgacacctgaaggacaaggaaaagttagccaggcaaataagatagcagagaaaattgtatgaaagcaactttaaatgttttggtcacttgtggtatagttatcaagaatgactggtgtgataccagctgcagagacggtaggcctggtcattgaggccgattggtctctgatgaataggaattaatgggttttaagctacaaacagctttctaagcaagccctgtaatttgaactacaatgctttcatacttactaacttgtaaggattaagttaacgatttggggtactatactgcaaaagtaaaattttccagatgagtagtacacttagttctgtatattctgtgcttaaaataatttttatgtaatgtgagaatgggcatgggtgtaaggtctgaagtaagagaggacaatcagaagaccaaagaagtaatacatgcaagtgcaatctaataacagctctgaaaagggcagtggtaataggaatggagaagggactcaagagaaaaacatttctgagctaaatatgacaggacttgatactggttagcttttagtgggaaagggaagtagtcatggagaagaagaagtctatagtgatacttagcatggcttttgactttgatgagtgagtatatgggtggtatcaccaggaaatatatggagaaaaagaactctgggtccagggaagtattagatgtagctcattataaaattagcattgatgttatttcatcttgttctcttccttttggagagagaacatgtggcatcctgttgcagtgtaactcttggctctctctgtattcactatgacaagcctgaagcatatgcggtagcaccctgactgcctgtcttgtgatcaacatgtgatggtggaaataatctgtacttaagaatccattctgtgttaaggccatatggatgttagccacatttttaaattaaactttttattctgagatatttctagattcacaagtagttttaagaaataatacagaatgatcccatgcactctttacccagttcccccaatgtaatatcttgtaaaactgtagtacattatcacaaccaggatactgacgttgatacagtgaagagcagaacatttccatcacaagaatccctcatgctgtccttttgtagtcacatctgctttcctctctcccctttctccctgagccctggaaaccactaatctgttctccatttctgtaatttagaacaacataatcaagaatgttatgtaaagggagtcataaagtatgtaaccttttgggattggctattttcactcagcgtaattccctgtaaattcatccagttgttgtatgtatcaatggttcttttctttttattgctcttagtattcatgatatggatacaccacagtttgtttatacattcatctgttgaagggcatctgggttgtttccagttttcggctgtgacagataaagctattaacatttgtgtacagacttttgtttgaacattagttttcattcctctgggataaatgctaaatattgcaactgctgcattatgtgatagttgcgtatttcgttttataagaaattgctaaactgttaacaaagtggctatatggttttacattccccacagcagtgtgtgagtgatcaggttcctctgcattttcactaacatttgctatcgtcactatttttttcattttagccattctgatgggcatgtagagacatgtcattgtggtttggatttgcatttacctaatgtctaatgatattaaacatcttttcatgtgcttcttgtataaagctggtgttaatgcttctgtaaatggtaaaattctccagtgaaatcatctgggcctggaggggttattttttttccctaagagttttgaaaataacatactcaatttctttaatagttataggactattcaggttgtctgtttcatttagttgagttcagtggtttgcggtttttgaggaattgtttctcttctaacttattgaatttatgaccataaaattttttatagtattcatttatccttttaatagctgtaggatctgtggtgatatcccttgtttcatttctaatattggtaatttgtgtattctcttttatctttgtcattgctagtttagcaacgaatcagctttttttcactgatttttctctgttatttttctgtgttcagttttattgattctgcttttttatttattatttcctttcttctgcttgctttttttgcttctttttctagtttcttagggggaggacctcagattattggtttgagacctttaatttttttctaatataagcatttaatgttacaaattttcctaagccctgcttagctgcatcctacatattttgatatgttgtattttcatttgtgttacattattatttatttctccttgtattttttttcacagtttttttggatttcagattttgtttgactcatgagctatttagatgtatgttgtttaatttccaagtgtttggaattttttttgttgtcctcctgaaatgtattgctagtttgactccattatcgttagagaacatactcagtataataccattatattcagtatataccagtatagtttcagttcttttaaatttgttgaggtttgttttatggcccaggatttggtctatcttggtgaatattctataggaaccaggaaaaaaaagtgtgtgtggtgctgttctaggtggagtgttctgcgtatgtcattggttggtcattttgttcttttatatccttgccaattttctctctaggagttctatcagttgctgaatgtgggatattgaaatcctcaactataattgtgcatttgcctgtttctcttttcagcttaatttgacttcatgtatctttcagctctgctgttttggtgctgtttggtgttttggcagattgatctttttgtcattgtgcattgtccctcttttaactattaactttctttgctctgacatatacttggactaatattaatatagccagtcttgcttttttctttaataattgcctggtatatcttttatcatcctttcactctcagcctagctgtgtcatcatatttaaagtgttttgttttgttttttgtggagagcatattgttttttcaaactaccctgccaatcttacgattttaaatggtatatttaggccattatattgaaggtaattattgatattttttatttaacttttatctttttatctcctatttctagttccactgtttctcttattcagacatttctttaggattctgtatttgtttatgtatagtgttttttagtgtattgctttgtgtagcttcctggtggttgctctgggtatttacattgtacatagtaacttctcacagtctactggtatacaggtttaccagtttgaatgaagtatagaaattttacttacatttaagcttcttttcctactccacttttaagatattattgtcttagatatttcctctacatgccctaagcagcatatcagattgtattgcagttttcctttaaccatgaaatgtgatttatgaaatgcatgagaaataaaatagtatttatattcacccctattttaacctattctgatcttcctctttcctttctgttctagttccaagccttattctgctttttttttttttccttatgaactttctagccaccaatcttttaggttaagtctgctggtaacaggtgctcttagttttcgttagtctgagaatgtcttatctcctttccctttctgaaggatattttcactgagtatagaattctgggttgacagttcttttctttcagcacttgaaagataatgccactttcttctgatatccatggtttctgatgtttctctctgttgttcatatttcgtgaatgatactggttctcatcatgcttactgattctgtcttttgtcttttccactgtactgttcagcccatttggcaagttttgtatttcagctatttttccattccaaaatttttattttgctctttatatccatttttgttttgtttgtttttgctgagactcaatttttttgtttgtttcaagcatgtttgtaattgcttgttgaaacatttttatgatggctttgttaaaattcttgtcaggtaattccaacatctgattcatctcagtcttttcttattcaggctgcaattttcctggttcttggtataagtgattttttattgtatcattgtgtcttggacattttgagtattgtgttatgagactctgcatgtgatttaaatcttccattttagtacacctcctctttgacaccatgccagccaagtaggggtggaaagctaggttccgtctttggcctctgctgatagcctgagagggaagtgctttactactgctcccacctggcgtcccctgacaccatggagggagaccctgttatcattgggaagaaaacgaaagctctagctcttcactcagtcttctctgacaccaccccagcaagaatcagtggtagtgtctcattatagccaggcaagggtagaagtctagcatcctcattcagcctttgctgactaaggtagggatggggctgcagattgttccttggtgtttggcaggagtagagtggttattgtgtcacatttttctgcctttcaaggctacacctttcctggttctttggctaaagggaaaaggcttttcttgggatatatatatatatttttatagtctgtgactttcggcattaccaacagcttgggatatgttaagaacccagcttgtggtatcttaagcaaaaaagaaagctagactttcttctcacagtttttttggatttcagattttgtgtgactcatgagctatttaagtgtatgttgtttagtttccaagtgtgtggaatttattttgttgtcctcctgaaatgtattgctagtttgattccgttattgttagagaacatactcagtataataccattatactcagtatataccagtataatttcagttcttttaaatttgttgaggtttgttttatggcccatgatttggtctatcttggtgaatgttctataggaaccaggaaaaaaaaagtgtgtgtgttgtgctgttctaggtggtgtgttctgtgtatgtcatttaaatcctgttggttggtcagtttgttcttttatatccttgccaattttctctccaggagttccatcagttgctgaatgtgggactccttcagctaggctttcttttttggaaaagccatggaagctttcttttttggaaaagccattcctttttttcaggaaagccatgactcactgccatgccattccttaggccttgtagtccctagcctgcctatcttctctgtacctttcagagttttacgtttatttcctatgtaatatccagagttttagctgcacttagtggaagaataagatgtgcatctattcctgaattgagttttttaatgtatgcattactttatttagctagaatgtactaacactttttaaaaattatattaggaaaatcttgcagaagtagtatttgagtatcaaaaaaaagtaaaaaccagcacaaactatttacgtgggctctaatgaccagttttttagggattttctagagtggtagaaataaaattgtgccttaaatatttaatttgtggcatatttgtattttaatcaccaccttactttgatgaaattaatgcaatatcgtactgttttggctatagaaacctggcacagttgagttatagcacaacagttagtttttgctgttctaatgtgctttttttttttctctttcctccagggctggtggactaggcctcaattttgtcggtgccaatgttgttgtattatttgatcctacttggaatccagccaatgatcttcaagccattgacaggtataatactgacaaaatttaaagtgatctgcaaatacttttaatctaaaaatactcttgaacttttaaggttgcttatactatgactatgattagaagaaagggggaaactggtaaaaacgtacatttaatataatcctgaccttctcaatccaaataacagtccaaaaatagccatttttcatccatctcagaatcctattaatatgacagaaatgacttaagaagaaagaataaattcctaatactgtaggaaaataggatagttctgtactagtagatcagaagttttgagaaactcctggaagatagaaagcaagtagaatctgtgatcagggtatccgcagagaaatactacaatccaaagtctgcaggaaagagtacagaaattttaagcatgggcttgcaactacagtatgtgggagtagacagagtgcatcattctgggaaattgataatgtcctgactctaatacaaattcccctctgacaccctactttacagagagattggccgtaacaggtactctttgattaaagctgaaagaataattttacacattttataaacaaatggggaatctgactgtagaaagcttcctagaatggatgttggaaccagatcataaagccagagccaagcctgaagtacttccagatctccccaggacatgaaaaagggaaatacacgtgttacctgcatggaaacacagaccggctttccagtgatgcacctagtcgtcattttaattatgaatgggaaatgaagaattatgaaacattttaataaaattaacctagcaagaaagcaaaggacaaaggtgaaaaacagacattgaagggaataaaataagaataggatgccaaggaaaaaagtacataaaaaaacaaattagttcttataaattaaaactattgccaaaataaagtgactcagtagaaggtctgggaaaaaaaatggagagggctaatggaaggatatggaaaaaaatgaaggtctgaaaaaaaatggagagggctaatggaaaaatggagaaggatatggaagataaaaggaatgaatattttaaaacataaagtcaagtagcaaatagatgtgaaatatgagtaaagagaaattgaggaaaaatcccagaaatcatcatctgtgtattccagaaataatgaacagagactggaggacgggagataattgatgacatgattggagaaaattgttattaattttgaaggggcatttagtatgaagtaggaataatgactgagagagaaaacatacatgttagtaatatttctaagtttcaaagataaagagaagggctaaaaggttccaaagtgagaaacagggagagaatgatttataaaaactgcaacaaaaaggaaaagatacattgttaacaaagaaatgagaatcagactcaattcagcagatcagactttgaagaacatacatttcatcagcattataggattctagaatgacaacagaattgtcaaagtgaaaaaatttatatggctatatgtgaaagaaaattattttgagttgtatttacaatttgtggctaaaattttaagtctaaaaaattactgggagtgtggctgataggcttcatgcagttgtaaagaaagaattccctgaaatatgaagggatggtatgaaaaaattagtaacaagaactaaaatgttatataaattttgataattgtcagaataagggtagaggtgggtaaagttgtcttagaattgtttttttttcctcaggaaaggaccaggataccctggtcagttctcaaattgtatgccaacaaatgtttttaaatgctagcaaaaaatttaggggcaacaactaaaagagtgagttataataattacctggtacaattttcaaaaacacagatgctcaaactccaccctgcaggcattctgtttatgtagatgtagaatgggactcaacattctacgttttaaaaaacacccaggttgtggatcaaaggacactatcaacagagaaaaaaggcagtctacagaatgggagaaaatattttcaaatcacatatctgataaagtattaatatctagaatataaaaagaactcctaaaactcaacaacaacaaaaaacacaacccaatctaacaatgcataggacatttctccaaagaaggtatacaagatatataagtggccattaagcacatgaagagatgctcagcatcactaatcattagggaaatgcatatcggaactatagtgaggtacaacttcacacacgttggatgactattgtaaaaataaaagcaacaacagaaaacaagtcctagttgaggatatggagaaattagaacccagaacccttgtgcattgttgatggaaatgtcaagtggcacagctgctgtggaaaacagcatggtggttcctcaaaaaattaaacataaaattaccatgttatccagcaattacacttccactttgggtatataccaaaaagaattgaaagcagagacttgaagagatacttgtacactcatgttcatagcacctgtattcacaatagctaaaatgtggaagcaactcaaatgtccatcgatggatgaatggataaacaaaatacagtttatacataaaatggaatactattcagccttaaaaagaaatgaaattctgataaatgctacaacatagacaaaccttgaagacattatactacatgaaataagccagatatgaaaggacaaatattgtatgattctacttatatgaaatacctggaatagtcaaatccatagagatagaaagtagaatggtgcttattaggggatagggaggaatggggaattattgtgtaatgggcatggaatttcagtttaggataataaaaaagttgtagcaatggatagtggtgatggctggaaaactgaatttacttaatcccgttgcactgtactcttaaaaatagctaaaatggtaaatcgttttgtatgttttgccacaattaattttaaaagccacccacagtgattatgatacaattggttctcaactccactttgaaaaacactggatattaggtgtatcggggaaattcagccagatatcgggcgaaattcacccccaatattttacataggttttttttctattttccctaagtgtcggccggtctgagaaataaagagacagtacaaaagagagaaattttaaagctgggtgtctgggggagacatcacatgtcggcaggttccgtgatgccccctgagctgcaaaaccagcaagtttttattagcgattttcaaaaggggagggagtgtacgaatagggtgtgggtcacagagatcacatccttcacaaggtaataagatatcacaaggcaaatggaggcagggcgagatcacaggaccacaggaccggggcgaaattaaaattgctattgaagtttcgggcatgcattgtcattcataacatcttatcaggagacagggtttgagagcagacaactggtctgaccaaaatttattaggtgggaatttcctcgtcctaataagcctgggagcactacaggagactggggcttatttcatccctacagtagtgaccataaaagacggccgcacctgaagcggccatttcagaggcctaccctcagggatgcattctctttctcagggatgttccttgctgagaaaaagaattcagcgatatttctcccatttgcttttgaaagaagagaaatatggctctgttccacccggctcactggcagtcagagtttaaggttatctctcctgttccctgaactttgctgttatcctgttcttttttcaaggtgcccagatttcatattgtttaaacacacatgctgtacaaacaatttgtgcagttaacgcaatcatcacagggtcctgaggcaacactcatcctcctcagcttatgaagatgatgggattaagagattaaagtaaaacaggcataggaaatcacaagggtattgactggggaagtgataagtgtccatgaaatcttcacaatttatgttcagagattgaagtaaagacaggcgtaagaaattataaaagtgttaatttggggaactaataaatgtccatgaaatcttcacaatttatgttcttctgccatggcttcagccagtccctccgttcagggtccctgacttcccgcaacaggtgtaaaacttccaaaagaaataagagtaccaagaaaatgtaattattttagtacatgataggaaatatatagttgtgttgggaagatggaggaaactcagaaagcatgaccaatgaagtgtcagaactaaatccaaacataaatatgaatatgttgaaactttttttagaaagaaggagaaaagtggggctggcagaaaggaaaaattagactcaggtttatgcttattatgaaacatatatgtaaataaaaaagacacaggaagttgaaaataagataaaaaaatcaaatcagggagatggtaacaaaaattaagaatggatggcaatgctaatatcaaattattaatagaattcaagacaaaaggcattaagcaaaacaaagagggccacagtccactaggaagttgtaatagtcactacataacaaagccaaaactcttatatatgatgagaaacagacaaatccacaactataatgggaaactccatattcctctcttaaaaaataataaattggccgggtgcagtggctcacacctgtaatcccagcactttgggaggccaacgtgggcggatcacgaggtcaggtgatcgagaccatcctggctaacacggtgaaaccccgtctctagtaaaaatatcaaaaattagccaagcgtgatggcaggcgcttgtagtcccagctacttgggaggctgaggcaggagaatggcgtgaacctgggaggcggaacttgcagtgagctgagattgggccactgcattccagcctgggtgacagagcgagactccatctcaaaaaaataaaattaaataataataataaatccactaggctaaataaatatataaattacttgaataaaagttatctaccataatttaataattgtgtatacagatacatctcattttattgcacttcactttattgtgcttcacagataattgccttgtttacaaattgaaggtttgtagagatgttgagtcaagcaagtcttccagcaccatttttccgtggcatatgctcacttgtgtctctgtgagaatgtagttctcacattatttcagattttcattatcacatctgtgatggtgatctgtgatcactgatctttgaagttactattgtatttgtttcaggacaccatgaaccatgcccctataaaaagatgaacttaattggtagatgtgtgtgttctgactgctctgcttactggccattcccctgtctcattccctcccttgggcctccctcttccctgagacacagtatttaaattaggccaattagtaactctgcagtggcctttaagtggtcaagtgaaaggaagagttgcatgtctctcactttacatcgaaagctaaaaatgattaagcttagtgaggagggcatgttgaaagccaagatgggccaaaagctagcagttggccaagttgtgaatgcaaaggaaaagttcttgaaggaaattaaaagtgctactccagtgaacacatgaatgacaagagcaccaaacagccttattgctgatacgaagaaagttttagtggtctggatcaaagatcaaaccagccacagcattccattaaaccacagcctaatccagagcaagtctctaacacacttcagttctttgaaggcagagagacacaaggaagtagcagaagaaaagtttgaagctgcagggattggttcatgatgtttaaggaaagcagccacctccataacaaaaaagtgcaaggtgaagcagcaagtgttgatgtagaaaagctgcagcaagttatccagaagatctagctaagatcattgttgaaggtacctacattaaacaacagactttcaatgagaacaaaacaaccttatattggaagaagatgtcattgaggactgtagtcaataaagaggagagttaatacctggcttcaaaagataggctgactctcttgttagagactaatggagctggtgactttaagttaaagccagtgctcatttaccattccgaaaatcttagggcctttaaaagttatgctaactctactctgcctgtgctttgtaaaatggaacaacaaagcctggataacagcatatctctttacaggatggtttactgaatattttaatcccactgttgagacctactgctcagaaaaaaaaagatttctttccaaatattaactgcttactgacaatgcccctagtcacccaagtgttctgatggagatatacaaggagattaatgttgtttatgcagtaacacaacatccattctgtagcccatggatcaagttgtacttttgactttgaactcttattatttaagaaacacattttgtaaggctatagctgtcatatatagtgatttctctgatggatctggtcaaagtctgttaaaaaccttctggaaaggattcactattctagataccatttaagaacatttgtgattcatgagaagaggtcaaaatatcaaacaggagtttggaataagttgattccaaccctcatggatgactttgaggagttcgactttagtagaggaagtaattccagatgtggtggaaatagagaactagaattagaaacaaagcctgatgatgtgactaaattgttgcaatctcatgataaaactttaatgaggtcaggcacagtggctcatgcctgtaatcccaacattttgggaggccagggcgggtagatcacttgaggtcaggagtttgagaccagcctggccaacatggtcaaaccccatctctactaaaattactaaaattagccaggtgtggtggcgtgtgcctgtggtcccagctactcaggaggctgagaatcgtttgaacccgggaggtggaggctgcagttagccaagatggcagcatacccaggcaggatgtatacccagaaatgacctgagaagacttttagccttcaccccatgttgttcccaaggctcaagacacaccctgctaattagtgaaggtcttccttaccagtttgcaaagacttggggagttggctgtctttccaaatggtagttttcaagaaaagaccacaagacattagaaaaaaaaaaaaaaaaagaaaagaaaagaaagaaaatgaaaatacagctcattcagagtaacaaaataaatctctagaaactaactgtccctgaagcaaaacaggcattggagctactagacaaagactttacaacaagtgtcttaaatactccaagagtgaaagtaaaacacagagaaagaactagtgaggaaaaggatatatgagcaagatgagagtatcaacaaagagatagaaattaaaaaaagaaaaaaagagagagaaccaaacaaattctggacacgaaattcaattttggaattgaaaaattcactagaggagttcaacagcagaccaaaatagggagaaaaaatctgcaaacttgaagataggttatttaaaattatttaatctgaggagcaaaacaaaaaggggaagtgaacatataggacactatcaaatggacccaatatgtacgttatggaggcccagaagaaagggaaaaggacaaaagggtagattaagaaataatgaaaagctctccaaatttgagggaaaatatggatatacaaatacaagaagatcaaccaagtccagatagtataaacccagtgagatccacactgtggcacattataatcaaactgtccacaaagagagcatcttgaaagcagcaagagaaaagcaacatgtcatgtacaaggaatttccattaagattatcaagtggatttgtcagtagaaactttgcaatccagaaggcagtgggataatatatttaatgtattgggggaaaaaaaaacaaacaaactgtcaactgagaaacaaagaaaaagtgtttaccgagaattttatgttgggcaaaactgcccttcaaaaatgagggttaagatatttgcagacagacaaaagcttgagggagttcattaccactagaccagccctgtaaggaatcctatccctggtgcagtggctcacgcctgtaatcccagcactttgggaggccaagatgggtggatcatgaggtcaggagttcaagaccagtctggtcaagatggtgaaaccccgtctctactaaaaatacaaaaattagccaggcatggtggcaggcgcctataatcccagctacttgggaggctgaggcagagaattgcttgaacctgggagacggagcttgcagtgagccgagatgccgagattgtgccactacactccagcctgggagacagggtgagactccgtctcaaaaaaaaaaaaaaaaatcctaaagggagaacttcaagatgaaatgaaagtacactagacagtaactcaaagtcatacaaaaagataaagatctccagttaaggtaagtatcatggacaaatataaataccagtatcgtaattttggcttataactctgcttttttattttctacaggatttaaaagacacatgcataaaataattataaatctatgttgacaagtacattgatatcaatgtaaaatcaattgatttaaggttgttataactttaggatattatatgtaatccctgtggtaaccacaacaaaaatatctaaagtatatgtaaaaggaaatgagaaaggaataaaaatatgtcactaaaaaacatcaattaaacacaaaggaaggcagtaatggaggaatttaggggcaaaatagttataagacatatagaaaataaataaagtgggaaaaatgagttcttccctgttcttaattatttcaaatgtaaatggatcaaattccataattaaaagatgtagattggcagaacagatttaaaaaacagtgtccaaatatatgctatccataagagactcactttaggtccaagaatatacacaggttgaaaataaaagcatggaaaaagatatttcatgcaaatagtaaccaaaagagaacaggaatggttgtattaatgttagacaaaatagacttcaagtcgacaactgttagaagaaagacattatctgatggtaaaaagtggattcaccaagatttaacaattatatacataaattcaacaaacaatagagccccaaattgtatgaagcaaacattgacagaattgaagggagaaatagctctgcaataataatgggagacttcaacacctgactttcataataggtaaaacattcagacagaagatcaataagtaaggagaggatttgaacagcaatatagacaaattggacctaacagatatatagaattttccttccaacgacagcagaatacatacttttcttaagtacacaatgaacactctccaggataaatcatgtgttaggccacaaaacaagtttttaatacattttaaaagattgaaatcattcatttttttccagtcacagtacaatgaaactagaaatcaacagcggaagaaaaattgaaaaattcacaaatatgtagaagttaaacaacacacacttaacaaaagggttgaagaagaattcacaagggaagttagaaaatagcttgaaacaaatgaaaacacacaccacaacttacaggatgcagcaaaagtaatgctaagagggaaatttatagctgtaaatgcttacattaaaaaagaataaaggtctaaatcaacaattaactttccaccttaaggaactaggaaaaggaaaaacccccagagctagccagaggaaggaaataacaaatattagaacagagataagtaaaacaaagaatagaaaaacgacagaggcaatcaatgaaaccaagagttggttgtttgaaaagatcaagaaaatggtggataaatctttagctagattgactaagagaaagaagactcaaataattaacatcaaaaatgaaaggggacattgctactgattttacagaaataaaaaggagttcaagagagtactgtgaacatttgtataccaacaaattgaatagtctacgtgaaatggatgaattgctagaaatacacaacctaggaagaatgtcatgaagacatagaaacctgaatataactataactgtgtaaggagattgaatcagtaatcaaaaacctcccaataaagtaaagcccaggaccttaaggctttgctgattaattctaccaagcatttaaagaatttgcaccaatccagccaggcacggtggctcacacctgtaatcccagcattttaggaggtcaaggcaggcggatcacgagttcaggagttcaagaccatcctggccaacacactgaaaccccgtctctactaaaaatacaaaaattagctgggcgtggtggcgtgtgcctgtaatcccagctactcgggaggctgaggcaggagaatagcttaaacgagggagttggaggttgcagtgagccgagatcaagccattgcactccagcctggcaacagagtgagactccatcttaaaaaaaaaaaaaaaaaaagaatttgcaccaatccttctcaaatgcttccaaaaaactgaagaggaagaaacacattccaattaattctataaagccagcattaccccaataccaaaatcaaagactctacaagaaagaaaactacagaccaataatctttatgaatgttaatgcaaaaatactcagtaaaatgccagcaaactgaatttcagcagcatattgaaaggatgatacacagagtaggatttattcctggaattcaaaaacagttcaacatcccacaaaaatcagtgtaatatgccacattaacgaatgaaggaaaaaagacacataatcatttcattgatgcagaaaaagcatttgacaaaattcaacatctttttaaagatgacaaaaacaacacattaaaaataaaaggaaacaagccaggcacgttggctcgtgcctcttgaggtcaggagttcaaggcctgcctgaccaacatggtgaaaccacatctctacaaaaaaaaatataaaaattagccagcatggtggtacatgcctgtagttccagctgcttgcttgggtggccaaggcacgagaatcacttaagcctgggagacgaaggttgcagtttgctgagattgcaacactgtgctccagcctgggcaacagagtgactccgtctcaataaaaaaaaaaaaggaaactacttcaacatataaggtcatttatgaaaaacccagagctaacatcgtactcagtggtgtcatgattgaattgtttttcctgtaatatcagctacgaagaatggatacctgtttttgccagaaaaggacaaagattgtatgatttcatgttgtacctagagtcatcaaattcacaaagacagaaaagagaatggtagttgctagtagctgggggactggagaatggggagttattgtttaatgagtacagagtttcagtttggaaagtgcctgtagctatataggtgttatagttgcataacagtgtggatatacctaatgccacttaactgtacacttaaaaatgcttaaaatgattaaattttttgttttgtatattttgccacaataagaggaaatcaagagagaaaaatttgctatttagaaacaacaatgaggccggttgtggtggctcacgcctgtaatcccagcactttgggaggccgaggcaggcggatcatgagatcaggaggtcaagaccatcctagctaacacggtgaaaccctgtctctactaaaaatacaaaaaaatagctgggcgtggtggtgggcacctgtagtcccagctacttgggaggctgaggcaggagaatggtgtgaaccaggaggcggagcttgcagtgagcctagattgagccattgcactccagcctgggagacagagtgagactctgtctcaaaaaaaaaaaaaaacaatgaaattactgtggatcaatatttaaattctggtgctaatttcaatttttaaattcatttattaaaaaagaaaggccaaaagtaaaagaataatttagaaaactagaaaaggaacaaagtaaagaaaatagaattatacacattattacattattaagataaaaataagaacataatataaattgtaactaattcattgaaaagaataaaatagagacacttttgaaaagtctaatctgagggaaaaagtcaaatacatagaaacacttaagcagaaaggccatctaaccaataacaatgtttatttataatacttaatattttgtgtacaattttattcaagtacatttggaagaataaggacaaaggaataatggctgcacttattgagtgtttatggtaaggtaggaactgtcattcttggtgctttccatggattatctcatttaatactcagaatatccatatgtgataggcactattatacccattttacatatgagaaagctgaggcacagtgcacttaagtagcttgctcaaggtcatagccaataagtggcagggtcaggatctgaatccatgtggtcttactgcaaagcttacacttttaatcagcctctctccacagacagctgtcaaggaaattggtcaaaatgaaaaccacagaaaaatttcccccttttttttgatcttgttgtattttgtactttttcattaggtcatcgagacatattatttatcccagtattcttccaagcacagtgtactgtgctttggtattcactgaaagttagttcacaataaaactgaataaatggcattccttttcctctccctgtccttccactgactctgacagccggaactgagaacagaaataaagctaatgacctacctatcgtataacagttcctcaacacttgtctccacttggtgaaaactcatcacttacaaatccttgctttatggatcaagaaatgatgaagtataggcgcacagtaacaagtgtctaaaatttttgtctgtaaagattaaaggatgtgcatcctaatggaatctctcccattcaccaaacaactggcttaagcatacatccaaaggacattttcttagatccatttctggttttctttagaacccaaacacattgtaggagagaaagggatgctgagcccctctcctctgctcctgggttgcagaatggaagtgagaatgcagtaccttacccctggtggtgctgtgtcacaggagcctccatttcctgctggagatgtgagatttgcaggatccaagatgtcctcgagtaaaagtccattgtgaggagggacaggtaaaggaggcagagagaacatcaaatgtaacatatgggtgaccttataagttcaaagataaatttcccccaaattgtgacattttcaagcatataggcagtatggccttgccccggttcccctcagcaactgtaacaggcattgggtgctcatacagagcatcctataaagcctccatatgagagaagctgtggggaatagacctatagttaaaccactgtgatgaatcagtttagaattttaattagcactatggtctgtatggaaacaccttggatgccagtaaactgagtgattcagtcagatccacctcatctacggatgagaactgtagaccagcacttcatagactttacagttgattaattactttttgctaagttgtggttttttttactttttaacagttttaataaagtataattgacatgcaataaactgtacatacttcaagtatacaattgataagttttgacttatgtacatgtaaaaccatcaccacaattaacataataaacatacccatcatcccagaattttccttctgcccctttgtgacccacctctcccattcttccccatccccttatccccaagcaaccactagtctgctttctggcactatggattagttggcattttggggatttttatataaatgaaatctttggggaacaatctgtaagcttaaagctgctataaaagaaaaacctgaatttaggaaatgtttttagacagtggaaagtgatgtttataacaaaaatgaagttgatacttgtaggttttctgtaatattttttctccttaataagctttttatatgagtttgaatttttgaattattactaaatagagcatatttaaacataaaatgtttatttttaaattaattaaaaatttaatgattttccatttttatgtccccaagttacctcttcaacccaaagttgcttcacttgatttttgtttgtatttttaatccttttacagagcatataggattggacaatgtagagatgtcaaagtgcttaggctgatatccttgggaactgtggaggaaatcatgtatttacgacagatatacaagcaggtaaatatgtttccctttttctgtttcagaggtcaacatttatctgttttcaaaaattaggaacaaatttgtgtaaaatgtaagttttaaatcttactgtattgcggaatttaataagattataaaaattacccttgaatacacttttatgaaacagattctttggttcattgaatttttgagctgaaagttttctagagcagtacctcttaaactttagtgtacatgcgaattaccaagggatcttgtcaaaatactgattgtgatttagtaggtctgagttagagcccatgatgtggaatttttaactagctcccaggagtcctagtaaaactaatcagcccacattttgagtagcaaggtcacagctccccaaattacaggccaagatgtaatggtttaccacaaatgggctacaggtgcactgatatgttggtcccacagctttctggacagcaagagtacctaagccagtgtgttagttcattctcatgctgccataaagaactgcccaagactgggtaatttataaaggaaagaggtttaattgactcacagtttcacatggcgggggaggcctcaggaaacttaccatcatggtggaaggggaagcaagcatgcccttcttcacaggatggcaggaaggagaagtgctaagcaaagagggaaaaaccacttataaaaccatcagatctcttgagaactcaatatcctgagaacagcagcatgggtataactgcccccatgattcagttacccactggatccctgccacagcatgtggggattatgggaactgtaattcaagataaaattcgggtagggacacagtgaaaccatatcagctagctgccagcctttgagtaacctcttctttttacaccaggtagatattcatatgttaccattttctacatgtgccatcacatgaagattagggagcactaccttagaggtgcatgatgtacatgatgaaactgggaccccagagatcccccagtaaatgaaattataggaatagagcttaagtgtgctaactactttcctggtacttttagtattcgtccgaaattgcattaactctttaatatgcttgagatatcaattactacttcatttatgcctctaaacaaacaatatttatttagtttacaactggatacttgagacaatctggaataaggttcacgtgtaatcataaatattacatttgaattgcttcctatatgttcagttggcatctatttaagagcaaacatctgccacatgtgttggtagttaacctaagaatgatccaatcttaaatttatgctattttcttcattctaaaaatagaattgtacacagcagtttttgttttgtcttaaagcttttagctctgtaataaacagttcatttttttttttttttttggtatagcacaactacttgaaaattatttttttctaacctatttaaccaaccttgggaaaaagtgggaagttactcatcttaggagctgttcttttgagtactgtcttagactactctcaagtaagagtctttcctcaattatgtagtaatttttttcagtccattactatatacatttcctttttacctattcatgcgactcatttaatgaaatgtcttgttataaaatatacattgtgcagtagtatatgataaaacacgcttcagaagatgaggtaatttaagaactttatatgacacaaataaagataagatggcaatcatggaaggaaaaggcactaaatatggtttaaagatagtttggaattttaaccaatggagcacaccttctagcctcccaggttggctttcaatcttttggggaaaaaaaatccaaaaattatgtttttgtttttttttttaaattatactttaagttttgggatacatgtgcacaatgtgcaggttagttacatatgtatacatgtgccatgttggtgtgctgcacccattaactcatcatttaacattaggtatatctcctaatgctatccctcccccctccccccaccccacaacagtccccagagtgtggtgttccccttcctgtgtccatgtgttctcaatgttcaattcccacctatgagtgagaacatgcagtgtttggttttttgttcttgcgatagtttactgtgatgatttccaatgtcatccatgtccctacaaaggacatgaactcatcattttttatggctgcatagtattccatggtgtatatgtgccacattttcttaacccggtctatcattgttggacatttgggttggttccaagtctttgctattgtgaatagtgtgcatgtgtctttatagcagcatgattcatagtcctttgggtatatacccagtaatgggatggctgggtcaaatggtatttctagttctaggtccctgaggaattgccacactgacttccacaatggttgaactagtttacagtcccaccaacagtgtaaaagtgttcctgtttttccacatcctctccagcacctgttgtttcctgactttttaatgattgccattctaactggtgtgagatggtatctcattgtggttttgatttgcatttctctgatggccagtgatggtgagcattttttcatgagtttttcgctgcaaaaatctccttaagctgataagcaacttcagcaaagtctcaggatacaaaatcaatgtacaaaaatcacaagcattctcatacaccaataacagacaaacagagagccaaatcatgagtgaactcccattcacaattgcttcaaagagaataaaatacctaggaatcctacttacaagggacgtgaaggacctcttcaaggagaactgcaaaccactgctcaatgaaataaaagagggtaccaagaaatggaagaacattccatgctcacggataggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcgccaagtctcaatcctaagtcaaaagaacaaagctggaggcatcatgctacctgacttcaaactatactacaaggctacagtaaccaaaacagcatggtactggtaccaaaacagagatgtagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaatgctgaaactggatcccttccttacaccttatacaaaaattaattcaagatggattaaagacttaaacgttagacctaaaaccataaaaaccctagaagaaaacctaggcaataccattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcagcctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaaaaaaattatgttcttaaaaaaaaaataaacctgtaaaaatgttagaaagcaagaagagttttcttggtggccccaaaattgtaaggagtcctaaaagacaaaaggaagttgggatcagattgaaggaagaagccaagttaaactcagaagacgactactgaaaaggtaggtgcagcctctggatattccaagtttagagtcagcagatactaaaaaagaagggagccttagggtaactgtggagccctcttcagggtatcactgatggtgtaacaagacggtttagcccttataatcctatcccatttggaccaaattacagccagcagaggtgtctactgtcaagtgagaacaataagtagaagtactggaaacaaagaagcaagacagagctccaaatttttctaatattcagaagaaagtccctcctgttgcccagaagactaattacttgcaccctccactttatttcagataagcactgcagtagacagagataagcatgtgaagtatttaaaggcagatgaatagcccagccaaaaataattacccaacagtttaggaaaataaacactttgaaaaaggcactatagcgggctgaatactggccccgaaaaatatcaatttctaatccctggaaattgtaaatggtactttatatggaaaaaggatctttgcagatgtgattaaattatgggtcttgagattcggggattatcttggattatccacaagtgtccttataagaaagagctagaggacaatttgacacagacagaagaggagaagacaatgtaaccacagaggcattgattggagtggtgtgccagaagctaaggaatggtggcagccaccgcaagctggaagagtcaagaagtagattctttgctagagcctccagaaggagtgtggtcgtggtcctgccaacaccttgatttcagtttagtgatactgatttcagatttctggctcccagaactgtgagaggctcaaatgatcctcccacctcagcatcccaagtagctggaactataggtgcgtgctaccacaccaagccaattttttatttttatttttgtagagatagagtttcactctgttgcccaggctggttgaaactgtgttgttaattcagaactctcccacaaagatagattctagcccggatgacttcagtggtaaattctatcaaacacttaatattgtttttgaaaacagaagaagagggaacacttccaacttacttcacaaaaacagtagaatcctgataccaaacttgacaaagacattgcaagaagagaaaatgacagatgaatatctctcatgaacataaatatgaaaatctttaaccaagcatctgttttgagtccattgcaccccttcccctcaaaagataggttgaagtcctaacccttggtacctgtgaatgtgatcttatttgtaagtagggtctttgcagatgaggttaagatgcgatcacactggatgagagtggtccctaatccattgactgataccttataagaagggggaaatttggatacagacagccacagaggaagagcaccatgtgacaatggaggcagagattggagtgatgccaccacaagccaaagaatgctacggattaccagcaactaccagaagctagaaagaggcaaggaaggatcattccctaaaatcttcagacagagcatggccctatggacaccttgatttcagatttagctgcacaactatgagaaaataaatttctattgttgtaagacatccaatttgtagtactttgttacagcagaattgggaaactagtgcagcccctaaggcaaatacagagtattgtaaatttgactatatttttgtatgaaacttctgtatgacaaaggaactgcaaaccaaattcaaagacagactaggagcatatgtttgccatatatgtaataaaagagcagcatgtacaaaatataaagaactcccactgtattagtctgttttcatgctgctggtaaagacataccagagactgggttataaagaagaggtttaatggacttacagttctgcatggctggggaggcctcacaatcatggcagaaggcaaaaggcacatcttgcatggaggcaggcaaagagaatgagaatcaaacgaaaggggtttccccttataaaaccatcagatctcgtgagacttattcactaccacgagaacagtagggggtgaaccgcccacatgattcagttatctcccactggatccctcccacaacacatgggaattatgggagctgcaattcaagatgagatttgggtgggaacacagccaaaccgtatcacctacaaaccaatgaaaagaataataggcatttcactgaattaaaaatgcaagtggttaacacatgtgaaaaaatctttttaaccacactcataatctagagatagaaaataaaataagaccatttgcattgtatattctgcaaaagcttttttaaaaaatgcatattgaggtgttttgggggggttggggagattggtgctgttcattgttggttggggcatttgagagatgctcatatactactgttgagagtacaactggtataggtatatgtagagtctccatagctaactgacagaaatcctctcacatacgcacagtgaaggatgacaagggcttttacttagcattgcttgcatttgtttaaaaaacaaaggaaacaacctaaatgtctgacagtaacagaataaattctgatacctatattactttgtgacagcaaaatttaaaaaattatagtcagatcaaatgtactgatgtggcaagatgtctgaagacatttttaagtgagttgaaaaagcaatatacagaacaatatctacagtgtttcagtgtgtttagaaataaagctatttctgtgtgacagactgtccctgatttatgacatggttcaacttaatgtttttcagttttatgatggtgctaaaatgatacctatttatgtatgaagtatgttcctctacttacgatggggccacatccagataagcctatcgtaagtccaaaactcactttagacctaatggtgttttcaacttacaatgggtttatctagatatagccccatcataaattaaggagcatgtgtatgtataaatagctttaacttcattgaaagatacctagaaggatgcacctaaacgttacagcactggttagactaataaggagtgacctgtattgttcatgaggggcttttattttgataccttttgttgcatctgttgtgatgatgcattcagatattttatacattttaaaaatataaacatcacttttacagcagctgtgctccttcaggtttggagcatttaaacaatctaaagtttggcattcagaaagtcatctcgtctgtgtgtgtgtgtgtgtgtgtgtgtgtgtgtgtaaattttatttgtaagtgtttgcagaagaattgcaagaacagcagaaagaacccccagttagcttcactcaaatcactcaaattccctatttgctgacattttacacacttgctttctctttgtctcagccattatctttattctttttctgagccatttgagagagttagacttctcatcagtatgtatttccccaaagaagcaacactctcctaccaacactctaaattttccagtatgtatttccccaaaagaagtacactcctacttaaatatacataaaaaccagttttatgcattctaaacactcagttgtatatacggttctacaactcgctttccccaccctccacactcctctccaaaatgcagttattcacatgaagaaattaactttgataaaacatgatgctgtaatccataggacccattcagtttccccacctctctctttttcctttctggtccagggtttcatcaaggttcatggctccatttacttgtgtctcttcagttttcttcagcctggaatattatccaggctttgtctttcaagaccttgacagctttaaagaataaggcctttgtgtaggatgtccttcagtctaggtccatttgatgtttcctcatgtccagactcaggccaagcagtattggcaggaataccacagacatgatactgtgctcttctcgttgcatcagtcagaaggcacatgggggtgacctgccctactactgctcacgttaaccttgatcgcaggtcaagtttgtgtctgctaagtttctccactgcaaagttactatttttttctttgtaattgatatgtagtttatggggagatcctctgagactgccagttcctcatcagacctgcacgcataacccttagtgttcattcgtgattcctgcctgagtcagctaccactataatggttgtcaggtggtgatttttctatttccattatccttcttggttgttgtttggcactctaccatttaaaaaagagctttcccttctatttatttaatttgtgtggtctcatggcttcctattttagtaatagattacaacacattgaatatcactatttatttgatgttcacattgtcttatatttggccaatgggaacccattagggtggcttctgtgtcatttcgacttgctcccatcattctttttgcacttctttactgtggtaggctgaataatagtctcccaaagatgttcacattgtaatcccccaaaccacctgggttatccagatgggccaatgtaatcacaagggattttttataagggtcagatgtgcacatcttcatctctgctagctctgaccctactgcctaataacccgtggtaaggaagcaaagggtcagagagaaaaataatgaagatgccacactgctggccttgaagatggaagaacggccatgaacttcttaacatcataaatgttcttttctttttacttctttctttattttgtctattgttatgatgagatccaagcattttctcccttgtatgggtttttcataagctacgaactaagctacattttttagttactattttccccctaacttcttgaatttgaacatgatttcatttttagttagcctacagatggaagcacctggtttccacttttactggagccactttagtacaaaataatgtgctttttataaattttgtaataaaactttgctaggaagcttataaagactcaaattaaggcttacaaattaccttggtgattatagttacaggtcctgcagtctgacaatatcagtgtttaaggtagtttcagtaacaagggtaaaataggtaggtacccgggctatcacttgtatcaattgttattgtaattctgtactcccaggattacagcccatgttcattggtatcaaattgatcaagttggtatgttgatccataacttctttaaatgaaggtcccgagggttttttttaagagaggcatcttgaaagtgagaaattagttaatagtataaattttagattcagccaaaccaaggttcaaattctaggaatgacacttcttagctggcagctgtgagcaagtcacttaatttctctaaacttgagttactttatttttaaaatacagaaattttagttattttatttctaaaattgagatgatataaggttgtaaggattaaatgagagtatggaaataaaatgctatacatgtaataaatgttcagtaaatggcagctgttattaacaagaattttaattgcctagagtaacttattacagtgcaaatgaactctgatgataatctcaatagttaagcatttctctttttttgttttttgtgacggagtctttgtcacccaggctggagtgcagtggcgccacctcgggttgcttgcagattccactaggttcaagcaattctcctgcctcagcctcccgagtagctgggattacaggcacccaccaccatgcccagctaatttttgtattttagtagagaaggggtttcaccacgtcgaccaggttgggctctgactcctcaaatcaagtgttcctcctgcctccacctccacctcccaaagtgctgggattacaggcatgagccattgcacccggcccttaagcatcattttttactgatttctccgtcagtgggctgaagttattttccattctgtgcattctttgtttctttcaaggaattttaaagtacacatggggttaatcagattgtattttaattttacatatttatattacatttagtaaaatatccagcaaatagtgcatattaatgttgatactgaaatggtgtttttaaatgttccatgtcagtgttctttctgtattcaaaattatgtcaaagatgcagtgtttcttaaaacagtgatagggtttttgctgttagtaggcaatgtagtcaagccacaattagtttgacaccaaggtggttatcatatcattactttagattgtaatttaacttcagtgatgtagtaattacttctgccagttttagtagttgctattgtaataagagttttaaaaggagaaaagtatattcaaatgtatgcttttattattaaacatttatgtcaggtggatattctatagagatgtaatcttgactcagttgttagaaaacagataaaataggaaatataagatctctgtttcaataagactggccagattattattatttcaccataatggcaacatctgccagggaaattaaaacaaaatttcctccctaaggagattctgcctgctccagctaaagctgtgtatatacagggaatgccaggaaattctgacatattgttggagcaaacacttcaaaaatgtcttgtgttttttctgttttagcaacttcactgtgtggtggttggaagtgaaaatgccaaacgatattttgaagcagttcaaggatctaaagagcatcaaggagagctttttgggatccataacctcttcaaatttaggtcccaagggtcttgtcttacgaaggacatcctggaggtgtgaacttcttctctgaccttttcaataatattttaaatacagtttttcttcctcaggaaatctgaaatacaattgctgttgccttttcagagaaacttttggttttctttatcaaaaatgccttggaatttttacttttagagaataagaaatgaattattgtacctctaaactaagattttcccatgcataattacaaataatgcacacacacaaatgtatatgctgggtagtatgaactccaaggcaattttaaataggcagagagaagtttatagttttgaaaacagctgctgaagtcaggaactaaaaaaagaggttttcctaaataaacaaaaatataaaatgtgttttaattaaaagttaccaaatactccctgagatgtactctcatgtctcatggagatttttgttttctgttcccaataaaaattccacaccagtattttaaactctccctgttgtgttcatcctcagcatacagatgtttcttattcctcaaacaaaatattttatatccttttttaaaaaaatctttaagttcttttatataccggaatactaaggatattaacctattttctaattgatattcatataggtatcataaaatcctggagtatcatctttttcaacctcctcatggtatagatgaggaaactgagtcttagagaacttcaggatatttctcttgacttccaggactttgtagtaaaatcttaatgtacttcatttattcagtaagtaccataaaggcagttcaaggagcaattggttcctgtccttgaggaacttaaaccatcttgaccggaggtggaagagaacgtttacataataaccatgcaatgtcaggaatcgtatgctgaacaagttaaacagtagaccatggatggctgggggagaggaaggtatatattatttgaatcctataaatgttgttactattatacagtttctgatatatactgctgagtttctattttatagtaactatatttgattctgaattcagtggcccatttggagtcctactttttggggttttttccccttgctttttaaatacgctgtttctttcatgaatttgttctttccagtttcccttttcatatcaataactttgtttgccctccagctcccaaacccagctgctacctccatctcagagtactacttgacatgcctatattgatgttaaagtcaattgtctataaaaatattagcattttattatttatcctgttttctgtcatatatgacatagttacctgtttttatcagaataaccacctatttctttgttaaacaagtgttatataagacatatcaggatgacaggttattaagtagaaaaagttcccttgtttatcgtgccactgcactccagcctggggaacaaagcaagagacttgtctcaaaaacaaaaaacaaaaacaaaaaaaagttctcttgttcactggttattctaagaatatcttgtttcaccttcagaagtgtttattaatgacaggaccatccatgtcttacattttcttttttaaaaatatcttttaagttctttaatataccagaacactaagaatattaacctattttctaattgatattaataaggggtgacaaggccatccatgccctacatttgtcttgctaggcatatcattggcacttgattattaagttaaattttgaattaaaattactcatttgtcatcaatcagaatgtaaatttattcaggattggttagattcatgctgctttgggccaaaaggtgcttctaaatattattattagccccatataatgggagtacctatcataaagtaaaaggagtatttcacttcatgtgagacatttttaatttttaaaggttgtataaaatctcttttaaaatgttttaagatgtaaaaatttgaatatttacacttataatcttatgatttctgggcaatttcattctgttttgcattgactttccattatctatattatggtttctcttcaaagatagatattgagagttcattttacaagtatttgttgagcatctgctaaatgtcaggtactgttcatagagctttgcatacataaaagaacaaaataaacaaaacgatcctgtcta

SEQ ID NO: 2485 - DNA, 52218 bp, Homo sapiens
  source 1..52218: mol_type = genomic DNA
tttccggcgcggcgcccttcggcaagttccgcagtcgcctgtcggaaatggctgccggccggcagggggagcggcggatcaggcgcggcctggaaggcgggcggccggcagccagaacggcttctgggacgccgactttcgcgcaggcggcggcggcggcggcggcgggtccctgagctggaagccggtaggactgctggccgcgcgtgagcccgaggagcgggggccgcgcccggaagggctcatgggagggtgccggggctggccccgagcgctggggacgcggcgggagggaccgggtccgccgtgccccggggaggctgctgctgcccggcggcgggaggcatgcagcctccgagcggagtaggcctgcccggtggctcgggggcccggggagaggccgccaggccctcggccggcagccgggagggctaacgggtccctgggctggggcaccccctccccgcccccacacgccctctctcgtcccagtttgggctgctcgggacccgcctccacctttttttggacgctcggctgcagctgttgggcttcctctgctccctgaagccctccaccctctgtgacccgcggcgtttctctggctgctggcccggagcatcttctgtcggcggaggcgcagctccggactacccccaccccttcccgagcacaccttcccacatctgccccccgcttctacacgcagtcgcctgctgccctccccgctggctctttttgccgggctcgcctcctttcaggagccacagtcagaggagccgcttcctgtccgagggtccaggtgctgcaggaccctggctcccaggcccagctcccctagagccggcctcgcgctgcacgggctggaccggacaggggtgcgcggggcgtgtgtgcgcggcggagctccgagcccagcgacggggacagcacctattccgagcccctcggaggcgagccagggctgcccggctgctgatgggtgctgctttctcttccccacattgagcgagagcttcggctccttttattaataaaatctgtttggctctcagaagacttaaattttgtggattttgcccctcccccgccacccgcaccaccccacccccgcccttccccgcaacctggatttttcttccctttttaaaaactctaaaagcttcatcaagtcctcttggttcgactcctttggtggaggaggaagcgcagaacaccacaacatgtccattatttcccccatatgtgatttacttaagagtcgtctttagcatttcttgtcactttgtcctattctttgtccaatttaggtagcttcatttttactggcagagctccccgtgctttcttttgtttttaaaggctttgtgtgttgcagccatgcagactctgcagttttctgtattttgttcggcagtgagtcctgcattctgatacagtgactatcgctgtgacctgtgtgctgggatagtaactgcggggcacagagtctggagcgaagcgaagccttctcagcgacttgctatttagcagagggactttgaaatattttgtgatgaaagaaaaaccgttttcttaaactgttatttgatgtgttaaaaataccttatcctgtgggaatttcccattcgtttgcttgtggggagccggaggaatcataagaactcacgagcaagagagaatcgagcctaagtgctttctggaagagtcagaattgtggctcttcagacttccggaaacgtgcttaatgtccagagatgtgaggggcatacctacctaaaaaatgattgacaggcgtatgtctgtatccctccacttctcgcttttctagtgggggaaaaccctgttaatacttggtgtgtagttgggatctttcagtgattaggcctcaagagttttgacctcggagtaaaaagattttaagggaacagtttggagagaagtaagtcgggccaggccgagcatgggaaatgtatttctaggagagagggcaagtccagagggtggtttgaagccagcagaagactagagagagacctgttcttttccgcagggccctaggccagctgtggattggagggttatgggtgatgaggggctgcaggagtgatgcggagtccttgtctcagttgagactggtggtcttctggaggagggtgggagggattccctgatgtagactcaggtgttaggagaaaaatgaagtcccatcagacctactcttggtaaaggttcgagcgcctttgtatgttactctagagtgaggcgaggaatatgaaaccaggacgtttcataacgtcctaaaactgcctactccattcgctggttattaagtttagctcagaaaacttctattaacatatttctattttatttttgttaccccttcatttcggcaactatcatttcgaagactttcaatgatagggcagctgactgagagggaagaaaggatttttcacgtttggaggtttcatggaaatagcatagcccaggcagagagagtttgtgagctcaagagggacagaggtgggctcacctgtaagcttcatcttttcttttcttgcctgaaccagttgcacagtccttttaaattttcagtcattcagacctcttgggtgatgttactagggagaagagaagcaggatttaaaaaacctgtgatcttgaaaatagaagaggattggggagactcattactaacatacttccctctcccacagttaggccataaagtgcagtgtaggatactactcacatgcacccaaatgacccatcaaaagtctagaagtggagccataggaagatgaactgtagaatctgttggagagtgaaagcatcatatacataatatataagaatgcctactatacgcagccatacaaacggaatccataactgaatgagcaaagctgtattccagtgaaactttatctacaaaagcaggcagctgccgcttgcgggtgcctgccttagagtgccacccctcacacacatgcctttcctttggtatattccttcatttggctgtgtccaataccttttggactggtcaataatattaatggttaacgtcctggatgtttgcttttttgaccattttccctttaaagtctcttttccaacttgcttttaaatgttttttcagcaattttgacctactctttccagcatggcttcttttctttttcttttttttttcaatttttctattgagacggcgtctcgctcttttcgcccaggctagagtgcaatggcatgatctcaggtgactgcaaacttccgcctcccaggttcaagtaattctcctgcctcaacctcccaagtagctggcattacaggtgtgtgccaccacacccggctaattttgtattttcagtagagactgggtttcaccaagttggccaggctggtcttgaacttccacccacctcagcctcccaaagtgctgggatataggcttgagccgccgcatccggcttcctttgtttctgaagtagagctgtaaaatataaaagcacagtggcttcgaatggagaaaatagttgatgggatcccaaattattaatggagtctgtggaaaattaaggggggccttaaagccttatgcctgaaatcttggaggtgaaacgagaaggaggtcttgggaatggccttgctgccttgagtaggtagggtggtgaaattttccccacagcaaaacatgtttttgtgcttcctgggagcaaggcaattgtcagtgagggcctagagtctaaaaggatctttgaggtcatccggtctaaccccttaatttacgagttaacaaaggacaaggagcttatgagtcaagaacgaggaattgggaagttaggggacctgatgaatcagaaatatggtaatgatgatgggatggtaaagcgtctcaagctgaattcacccacaaagggtgaaggagaatgcccgagtcataagctgatttaaggctgggcacggtggctcacacctgtaatcccagcactttgggaggcggaggtgagaggatcaccttgagtccaggagttcaagaccagcttgagcaacattatagtaagaccctgtctcttaaaaaaaaaaaaaaaggaaaaacctgatttatgtatggcttagcaaacttgcttcactttctctatctcattcagggaggcccagggcactaacgatatcaattgtatgcctccacagcataaaataaaaatcatgtatgtttgagaagcgaaaaccgttagattagtttatattctaggcacttgcatactaagttgactgttctgagaataagttagcaaaatccatctgaagaccttatttgaaaaccttgtttctacatcgctacccagcccttatgaaaatgacgcatctcattttaggagggagagtgagaaagataggaagaatgcagaaatcacctataatttcacaatctagaagtgcctctgttggtgtttttgcttctgtttgtttttctattcagaaatatatacatatgcattttaaacatgttatactgcatatatggctttgaatctgtatttttccagctaacattgtgaacatgttttcattttatttaaaaccattgaaaagcttcctaatggtatcatagtcatatcagtgacagtcacactttgtttaaccttgctcctagtcttggacatttaatttatatattttatacagatgataaagaataatgaggtgattgcatctttacatacaaatcttgctcacctaaaatatattcctagaaagtgaaattgctgaatcagagataagaaaattttgaaggtttttttcttacaaatggcaaattacttttcagtttacctttctactaacacaagagtacctgccacattgtagcagccagcatagttcagagttgtactgtactttaatcactattttaatgttttagtatgagcattttggaagttaaatcttttttctcactcatgattctttaagaataatttctcggatagaattacagggaaagaggatagacacagtttcagtgtttttattactgccaaattgtgctccagaaaggtgtgccaatttgcaatcccagcagccaagtgtgggaatgtttaccctggatcctgcttagcaccagatattataattttacaatactttgatgatttattagtggaaaatatcacagtatcttgtttgaaatgtgtatttctttgatcgctaggaaggttaaacatataaacatgtttatcacttgaaccctttttttgtgtaacttcttatttatgtccgttgaccactgttgattgctttcttttaattctgtcatattgagcaggcttccccatttttaatcaaatttaagctttttttttttccttctgaatacatagaatcatttgattcttatatagtcaaacctgttgaacatttctggattttacttttgcttggattcctggaaaagtggctgtacttgagatgagattacatgtatattttccttttcttgttacggttcatttattataattaactcttgaatccacctggaacttatttttggatttggtttgtcatgcagtaatctgactttattttttttcccaaatagatgtgtcacattatttattgaaaaatgtaatgaggtgttctttaaaaagattgcaacaaggtaatatttttaattacaaaagtaatacataatgattgtaaaatgaattaagacaaaatgaatcctctaagtaaacaaatggtagataagcaagaagcagtatacagggctgtaggtcatacggacctggatttgtaacttggttgctgtattgccttgaacaagtttcctatccttggtgatacaccactgcttcatcggtgaagtggaaatgacagtactcccatgtggctgatgaaatgtatgtgtgaagtgtgttatctagagtactgtgcctagcacactgtaaatataaatcagtagcaattatgaaaaagccctctcctccccatcttccaagggtatgtggtgcattgaagtgcggactttctgcgttagctaagggatagtgctgtttgtcttccttagctgtctatgttgattgagctgccatcaatctgaatctccattactatcaattcttcattagaccaatagttttggagttagggttgtgtgctctgcattaaaatcacctgggaactttgtcaaactgcaggagttttcccccacacctaggaattctgatttagttaatgtagcacggtcccggtttgttatttgaaaaaattcttaagtggtgaatctgatttttacacataattaaactgactggtaaaacaatacgatttggatttgtgggacattagcgaactggtgggaagggaagcagataaggcaatggcataattttcaaattgaggacttatcctgggagttgagacttctgggcccaggtttgttgccaagtaaacagataacttggagtaatcaatagcctcattttccttgttaatatctatatattcagcagcggaaggaatgctcaccacttattgatgagttccttttgtattttgtgatttgtctgctagtggcatttgtggaacaccttgggatttagaaacctactcttaagcccaaagaataaattgttttccctttcaaacagccctgtaataagggcggctcaaactctggttctctggttgcatcataatcttcactcttcagtcagtaggtcaaggcacaaccagtttttcacacttcgttttgctttttaattgctgaggatgttctgtttcccttttttcatccaggctaggttacacagtaagaaaccactgtggtcgttggattgtgaaaaacatagggccttggtctcctgtaacttgggaagtgtctacatgtagttcttagagcttactctttatctacaattagtttccctgggaagtgccttttttttttttttttttttaaacagaagacaaatcagtgatagtgttgggaaatgtgttttagtgcttattaacatacttcctgacttcacgaactaggtactgtcttgccttgacaggctgtttgtcatgcctgtagttaggaaatcaggaaatgatgtttttttgggttgttagtacttaaaaacaaaacaatcctctgaaatactgctttcagtgacctcactgaaatggtttcctgtggagaactctctttacctaattggaagggctcctggtgatggcagcaatgacagcagcatgcagacagctctgtagaacccgcacctgggttgtcatggagttctgccacttgatgggcctattttgacctaaatgaaaaagagaaaatagtactacaagcacagatatacaggtgggccataggcacagtggcaaacatcttttgttctgagtctgctattctctttagcaggtaaatactttgaatatagtgttggttttgggttttagaggaatattatgtgtgtcaattgtaattattattcatggttacagcggagtagcagtgatatggagaatgtaaaaatgatacacatgataggcatgtgtgtgtgtgcctgctcgcactcttacttgaattaatatagacagtgtaacataataaaggcattaaaggtatgagctttacagccagcttgctttggtttgaattcaagttttaccacataacatgggtgacccatggctcattagcctctgtgctttggtttcctcgtgtacagaacaggaataacagtaaacccacttcacgggattgctgtgaggattaagtgagtgtgttgaggaatatatggtaataggtttaacccggcatacagtaagcattcaatacctgttagctattatcataattatttaagatattagaggccgttgaaggtttcattgggaacatctggaaagcgtctagcctctctctctgtttctcactctgttctcccttcataccttccacgtggaaggcataacagccagatggagcagtgactcccttcttccctgtcgcgcctcctgtctctcctgtctctccgggtgagtgttttagtgtagtttaactttttttctttcttttggagtagtctgataattttctgcatataaaaaaatttacagttttattaaaagatgcaaaagaagacctaaatagagacatatcccagatccgcaatgggaagtttcaatatcagtgttttagttttacaaggagaaaagtcgagtctgtaggatggttgttatatcaacaaactcttgaaagcaaggccgtgagtaatgttcctgcagataatcgcagtttgctattgtgataagggatgtgagaggaggagggccctggtacgtggaggtggaggggcgagaaggtgaaggggaacaccagcacgtgcacagttctggattggaactctgagccccgacttctcagcccaccgctcagactctcgaatggagtgattacattacagctttccagggctactgcttggttcagccctccaatgaggagctagcagatggcgacttctgctttgcatttgtcagcaaaaatgtctgattagggaaaagagtaaaaggtagaatgctggccacaatctgaatgataaatctctgtatacaactattttaattttttttcccctgggagaagacactgtcatgatcctgttctagtcatagaagatgtgcttgctgccattgaacgtctgaggtgtagatgtctgtgttgctgaccactggaaaaaggattatcaggagggaggtgaagatgggaaaagtaaatttgagagtcagccaatcagggggctaagcgaagctcattggcaagctctgggaggtgaaggcagaaaagaggttgaggacaagcctgcaggaacagctacatttggggagtggtgaaaaggggtcagagaaagagaagcaggagaggacatgggcaggaagtgtaaaatgcagactgacttaatatgaggtgcacagcatgggtgagaacgcaagacactttgataggagaaatgaaggtgtaagtggggagaatttttatgcttctggataggattaccctaatattgtgttaagtatttttatgtctatattcatgagagattttttttttgtagttttctttctttctttttttttttttttttgaggcaaggtcttgctctgtcacccaggtgtgatctcacctcccacctcagcctctagtagctgggaccatgcctggctaatttaaatttttttttttttggtagagatggggtctcactgtgttgccagggctggtctcaagtcatcctctcccctcagccttctggagtggtgtgattacaggcatgagccgcagcgcctggcttgtggtattctttattttggtactgtctttgtctggctttagtcagggcaatgctaggtttataaaatgaactgggaagtgttccttcctctggaagagacagtgtagagtaggtgtttatttttctttaaatgttcagtagaattcttcagtgaaccatctggggctggagatttcttttttgggattttcaaaagtatgaagtcagtttacttaatagttataaaactaattcagattattccctattggatgagttgtggtactttgtgttttccaaggagttggtctatttcactgaagtgtatagagttgtttgtagcctgcagggactgtggtgatagcccctgtttcattcctgctattggaaatttgtgtcttttcccttttttctttgtcattcttgtaggtttttcaaaccagtgacaaacctctttgttttcttgatttttctcttctgcttttctgttttcgatttcgttgatttctgctctttaggtttgttttgttttttttctgggttcttgaaggaggagcataggttattgattcgagacttttcttcaatgcaagaatttatgcataaattttcctcttagcactgttttagccatgttcccatttttttttcttccatctataatatcttacttaatttgtgcaataaccctggcggtaggtagagattttcagactcactttacaaaggaggaaatgagctcagggagattatgtaacattcccaaattctcaaggctgagctgcatcctgagccgggtagtctagctgcaggtccatatggccatccagctgcctcctggctctgaagttctctctctgtagtttataatgtattcaatacaatatattatttgttaatggattcattaacattatgttgagagccatggggaacactttcagtatgaggtaggaggactgggtcccagcaaagcagaaagggaggatgagtcagggaagtagatggaacactaaaaaagcacagcttcatggaagtccaggggagaattgagagtttgtaggatgaggaagtgatcagtgataggattcatttatttaacaaatatttatagagtgtttacagtgtgctggacactgggctgggtgctggccacgcagcagtgatccaaacacaaagggttcctcccctcgaggattaggctttggtggggaagggagggaattaataaattacaagatattaggaagtaaatcagtgggtcggtgccagagagcatcggggggtaagaaaggcaactttaaatggtaatgccaggaaagttgaggcctgaaggatgagaaagagtctgccaggcagaagcctggggaagaacatttcagacaaaacaggcataaagttttgagagcgagaagcttggcacagtcgaggaggtaagaggaggccagtgtggctgaagctgagagagcaaggggaagagcgatggtaactgagatgggtctggggagcccggcagtacagtgggcagccttgaaaatattgagaggggaggcgtggcctgactcatgtttcacgatggtcctggttgctgtgtatggagtgcattgtaggggcaggaatggaggccagctggcaagttaagcatgaaatgctgtggcaggtgactgagaatgaattagacatgtacattgtatatggaataaaaaaaatctgaagggctccttatcattgtttcagtgacatttatttctagaggctgatatgtttattgtcattttccagagaatgacagaagagattctgagggtatcctttttcttttgtgcttgaaataatttaattagctgtttaggaaggaatgctcatgctattggacatggatgatgcttttgcctggctccagtaaaagagatgggaatttagtggggatgcattcttttgaatcattgttgaattattggtttctgtgagaacatttgtttctgccctcagctctgcttatatgtaagttggtagcactagaaatattagactaactatagtcagtctccaaatgactttttaataacctctgtttagactctgtatgtagtatcttttagaatttttggtatgaaaaatttcaaacttagacaaaagagagcctgatataataagcccccatgggtacccatcattcagtgtcaacagcagtcagctcacggccgatcttgggttcatttctacccgcaaacattccccgccaccctcatcctgtttattttgaagcaaattccaggtatatcatttcatctgtaaatatctcagtatatactttcaacaagtaaggacttttccatattttagtgtttggttttattcccccttagagcacataaataggtaacgtctgtctggacggtttgcctgccagagtccccgtgtatacctcttgtcccagtgtatttattaatagtctccctttccacttcaaagagtctctgtttggacagtaaattatttggtgacctcatgtacataagagaaatcttttcataggggacagtaaataggttctttaatagcactttcagtattgagtatttttctaatagtatgtcactgttctatttttgttttttgtttttttttttaaatcaggagagcaagccctggaggttcactctttcaagaagtcgtgtgctgaggtgtaatgctacacaagtcagaggaaggaagggtcctgaaacacatggtgaggaaggaatgagtcagctggattgctgtgattacgccttcttttctttttcttccattctgttgtttctttgttacaatttggtcataagtgcaaagaagattcttttgaaagcaagagatttaaacatttgaatcacaaggataatgtaaatttgagtatttggtcagctgctaattatccaagtttagattatccaaatacttaaaccttttagtaatattatcatcaactttaggtctgatgtcttgtcaggtgttctttgtaatggacaaagtgactcacaccatcatttccctcctctcattctttgctgttagctgattctaatatcctcttttctttctttcttttttttttttttttttttgagatggtatttcactcttgttgcctgggctggagtgcaatggtgcgatctcggctcactgcaacctccacctcccgggttcaggcgattctcctgcctcagcctcctgagtagctgggattacagttgcgtgccaccacacccagctaattttgtatttttagtagagatggggttttgccatgttggccaggctggtctcaaactcctgacctcaggagatccgctcgcctcggcctctcaaagtgctgggattacaggtgtgagccaccatgcccagcctaatatccccttgtctttagaaattgttattataatttattgacagattaaaatttaatgtccaatgttacgatgaaataaaatgttacttgaaaaaatgttagaatgtttaaaggaatctttattctgaaacataattaaaattatgtttataaaaatggtaaaaaggagagaagactattacacctttaatagttaaacatctttgacagaggtagaagctagagaaagtggttgtgcctctgtgaagtcctactcattttatgctacgtgtacccttgtttgtttatatcttatctcttagggtaagggaagttccatgaggtcaaggattatacaccctagattctcccacagttatacttagcatgtcttagccctgttaagagtatggtgaatattttttggaagaattaaaaaaagaaaccgggaatattccctggcatagaatattatgatttgtttctagctgtgttgaatttgagggaaagcaagtggcaagcctctgcagccagtggcagtgaagcttggtgagagagcagggctgggagtgttgctgagggactgagtcgctacaagcgtcctcccatccactgcactttgtatcacagcaacgtggtgcattgccgtctccgtgcacctatctccattttagaagattaggaaaccaaggtctgatagcaaatctgtcagcaaagaaggagaacgaatgcctctcatttctaagtatagtgttctttctaaaagagcaagttactatttatattttaagaaagagcacatgatgtctgctaatggaagataaatgagaagcaaactgggaaatacattttgtctcaggattactgcatctactactggataaagatcaaaagagttctcttcaaccctttcaactctacatttaacaaattgagcttttcagagtctttttttgtaaagtatttccaaagaagacttataggttaggaataaacataaactacccaggttggctaggaaggtatttctgttcatctaaagatgatgcccaggtgtggaacaggataagaaaagaccatggacatctttgtcccatgaatttagttggtcatcgtgttacagggctataatgccgctctagatccagttaaataagaagtggggaggggttgtaaactgcagctttttggggcacttatccatttattaccccaagtaaaagacctataccaaacagcaaacaacatctctgcattgtcattataatgttctttgagacacagccagtgttccagccattgttccatctaagatttaagcattttctagaaatgtatggtggcaggggtgttgaacataacttcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaaggacgatgccggcctccctcccccgaaggccactcggggctgccggctacacaactgctttgattattctcgttgccctctcacctctggcttcccggtctacgtctatgacagtgaccagtttgtctttggcagctacctggatcccttggtcaagcaggcttttcaggcgacagcacgagctaacgtttatgttacagaaaatgcagacatcgcctgcctttacgtgatactagtgggagagatgcaggagccggtggtgctgcggcctgctgagctggagaagcagttgtattccctgccacactggcggacggatggacacaaccatgtcatcatcaatctgtcacgtaagtcagatacacagaaccttctctataacgtcagtactggccgtgccatggtggcccagtccaccttctacactgtccagtacagacctggctttgacttggtcgtatcaccgctggtccatgccatgtctgagcccaacttcatggaaatcccaccacaggtgccggtgaagcggaaatatctcttcaccttccagggcgagaagattgagtctctgaggtctagccttcaggaggcccgctccttcgaagaggaaatggagggcgaccctcccgccgactacgatgaccggatcattgccaccctgaaggcggtgcaggacagcaagctggatcaggtcctggtggaattcacctgcaaaaaccagcccaaacccagcctgccgactgagtgggcactgtgtggagagcgggaggaccgcttggaattgctgaagctctccaccttcgccctcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtaatagagaaacgaacagttcgttttggtgcatgaaatagtatttcactcttaatcccttttccaacttccttcactttagcaatcgtaacttctagcagaggagaatacatgcatactcatgaaaaacctgtatagattcctttcttcctgaagggtttgcttgctgctttttcaagccttggcagttctgtggctgttactcacttcctaaatcgaggatccccaaaactgaaactgattttatattcaatatacaaaaccttgtcggttatcccgtagacttccatgtcataacaagatgatgatgataatgataagctaccatttaggaagcacttagcctctaggcactataataagcattttgtgacatattatcgctgtttcttcagcttattcgtatgggagctgaagcttaggttaatgaatttgcccaagatcatggtgagtaatggagaagctgagctttagtatgtctgattccagaagcggcagctttagtcacctcccaaagggtttaggaaggcctgtgtcattttccaggtattcatagaagtcttttggaagactggagttggggtttgatattttggagttggagaaccaactccaattgaaccttccagggtgtcttgtaggttctttctcattctttactccatctcatggttaagtgctgtattttacaggaaaaataatagctaaatatgcaggacagggctttagttctgaggagtttaccatcttcagaattaaacttggcattctaggagagagatggcgaccatctctcttaaatgtgcagccttagagcaggtcttaagcagactgccacctatttaacctgctgcatatgtagttacttcctggcagaaggtagcaaaaagtctgatgggccacacgttgctagaagtctcggtttttaaaaaatgtacttcactgggaggccaattcatttgaattatttttctaagcagcagcatggtgtaataagtatgagatttggagtgatacagacctgggattaagtagtcatttcgtgatctttgataattagcttttttgatctcagcattaaagaggaaactacgataagacaactaaggattctagaaaggtgctcacttatttgattccttcttatcccttaatgttaaaggagatggaagccagtatgtttgtcttgcctatgctctgggcagctttaactgacttcactcataaaggcttcttgtatcctctctacatcatttctgtttgtgtcatagttgttactgcctacttccttctgtgcaaagtgcctctttgctttaaattttttcttactgctgctaatctttttttaaatttaattgaatttataattagaagctattcaaagactgtagggttataaatcctttttatcccagtgtattttgtatattaagttttgtaaatagggaatttttttaatagacttctcaaagttcactttttttctttctgttacaactttatgtcattgaaattaagaaagcatttgctctgtgaaagatagatgctcctcaaatagtagaataatagagcagccattgttttccatttttcctgagttttctttgattttgatagggatgtagagaagctggtgccataccagttaagttgactgaaattcatcaagaacttaccagaatgaatctttttttaaaaactctgatgggaaataagtagtcctgactattgggcagcccatcgcaataatacctaattggaaaatgccagaaactttacagataggctattctaaacagctttctcatattagcaatacaagttttttttctggtccttttaaaaaagaggaaatagcttcagatggagaatttcactccatcctgtaaatattgtggttgtgctttctatctaggagaggcgggtgttctggggaacagttgaagttgctgacatctcggatgtacccagctatcagagctagaaagagactggtagctctctctgctatagaaaaagggcactactgtgatacacctcagagtgggtttttcttctagatgtagacgtagccaattcaatacgctaaggttaatttttataaatttagcaccagggttgttcccaggcatcagtgaatctacccaggaacctccgtgccatttcagaaagtgctgggcaatacgggctcctcttatgtttaggttcccactaagcaacaggcataagtgctgggtgtttgtgggctgtgaagtgtattgagccccagctattttaagtggagaaggattgtcttaggggtgccccataggacttatatgttaaaattcctcattcttttaaataattatttgcataaaaagatctagcttagagtgaaggtgatctttattgccaccacccttgaacactcctgattgaaatgctctgtgtaaagagaacttcagcacaaatgggatggtggcggggcaaggagacaggacttgcagagagatgggagaagtgccaccagttgaagtgggtctcccgttgaatggggtaggactaccaaacagaggggcgatggtgagtgtctgctctctcccttgctcttgtatattttgtaaacacatggatcaggtcccttagctcctggagcataacaacaaagatatctaatgaaagccaactagagagtattattatgccaagggatttgaggtctagccttttgaaaaactctccactatgttggggaccaccactttcatggcacctgaaagatgttccactgtttccaggcctccgttgtttctgaggatatatcagtggttttcaaatttttgtttccttatatgtaaggtgtggttttctctggctacttttgaaattttttctttgtatttggttttcagcagtttgactgtggtatgccttagcatggttttctttgatttttattctggaaagtgttgatatttttgttttagtaggtggttagctgtattgactcagactgaaagccctgtctcgtgaatggccactctcatgttgagttcttttatatgtagctggtctgcttacagcctgcaccaagcatgcatggcttaggggtgggccagagacagagcagtttctacgcagaacttggagctccctctctctggctttctcctgtctggaattttctccattctttctacaggctgtggttaccttacacatttcctttacaggccagaaagaccatgggttttgtatgagagttttagctgtctttcttggtaccaactctggcctactctcagggtgaaagcaacagtaattctccctgtgtcagtaattccctccctctgaattttagcacccctccataattggttgtcttttgttcactctctagtgccttctggaaattctttttttggtatttttgtgcagaggttatagttgtcatctgagggaggactgggtctggcaggggcttactgaactcttctggaggcagaaatgccaagtaatcccttcttgatagatagtcccattaaaaattttggtttgagttactactttattctgaccagtttacacatcttccttactctgctttatactctggaaaatagtaagtagggtggctgttttagagtctgtccttttggagttgtaacatgtgggctgttaggaaagggacatctttcatttactaacagtgtagtctagctcactcaaggcatcacttcccttcacactgtatactcactgactgctgagacagtctcttggcagcccgtccctgagtcttaggttttcattctcttcttcataaagggtatggctaattgacgcagggtgccttggaagggggcttttagaaggggtgacatttgagcagaagcctgaatgaagcgagagaggaggccatgtaaattctggagggatgtatggggaatggcaagcaccagaagcgatgcccagtgcatccgggtggcgcgtttgaaggaggttggagaaggcagtgggaccagcaggtgcaggacagtgcaggtcgtggttaggaagtctgggttttatcctgtctgccttaggatgcccttggagggtgttgagcagaggaggcacatgatttttatggaactatggggaaaagagcagaagcaaaaagacttgcagtagcctaggcgaggagcggtggtagagagaaccagttcagagatcagcatagcacacatccttgcagactgcaaggtctctgtggaagtgatgaggtcagaatgcaccattttttttccaaatgaaaatgatagtgccgggcgcagtggctcacgcctgtaatcccagcactttgggagactgaggtgggtggactgcttgagcctaggggtttgagaccagcctgggcaacatagggagaccccatctctacaaaaaaatagaaaaaattagccaggcatcatgcatgtctgtaatccaggctcttgggaagccgaggtgaggggattgcttgagcctggtaagtcaaggctgcagtgagctgtgattgtgccaccgcgctccagcctgggtgatagagggagaccctgtctctaaaaaaaaaaaaaaaaaaaaaagagagatacaagattattatttttcaatgcccttttccctctgtcccagcccttgatattcaaattgaacagggagagttctttttttgggtaatataaatatcattccaggggagttattttcatcctctccccagtagtctattagggaaaagggaagactggaagagaagctgcatccgtagtgcactcttggcgtcaggaactttctggctggggactccgcctctcaggctaagaggcttggcttctggctagacctcaggcaagagagtggagatcattctcagggcttactccttaaagtgttggtaagctgtatttttttatttctgcccactctacttttaaaaatatcccttgaacgaatgagacgataatttcctaaaattgtgatagctaggtgaagccagcaggaaaaaccttgtccagcttctccaggtccaagactgtgcaaggtctggtgcacttcactaggagctggcacatctgggtggttcgtctttctctttgacaacattttacttaataacttggtggctatagctgtgggtttctgtttgcgaatgggctgtatggctgcaaaggaaaattatataaaacaaggctaccccgaaccaaaaatgaatactaagaaatacagaagttgaaagcaattgctggaaagtcatgttgcataatttactaattgcagcaaattgattcttgaggtaatgtcttcccctcttagtgtatgtgtactctttttactaattcaaagtaaggaatctgagactgtaagaattctgttgcttcaggtcacttgactaactgatacctgtattagaatgagggctcaggactgtttttttttttttttttttgagacagagtctcacgctgttgcccaggctggagcacagtggtgtgatcttggctcagtgcagtctccacctcccaggtttaagtgattcttgtacctcagcctcttttgtagctgggactacaggcgcataccaccacgcctggctaatttttgtatttttagtagagtcaggattttgccatggtggccaggctggtctcgaactcctgaccttaggtgatctgcccatttctgcctcccaaagtactgggattacaggtgtgagccaccaccagcaccaggtcttaggacttctgacaatagatatgtattttttttctttttttttttccacgtgtaaatttcttggagaagcacaaacttgtttttttaaataaagatatgtataaaatatagaaaatgtataaaaattaaaatacatacagaatatgaaatatacatgtaaaatgtatgaaaattaaaatagagactgctaatatcatgttataataattgttaacagtttttgggcattttctgtgtgctaggcactgtggatggtctttatctgcattctctcatttgttgacctgctaacctaggctttcttacctgcacttgcactgggatcattggcaactttttctcttataagttaaaacagacttgtctcatctaaaacatgtacaattttgtttgtactgtatgacatccctgtgtaaagttataaatggaaaaccaatgcactgttaccttcttattctcttttcttcctttgcgttttcttgctttctgccccatcacttgacgtttattgaatgaatcccttaaataatgtagtccttggctgggtgtggtggctcacgcctgtaatcccagcactttgggaggccgagatgggtggatcgcgaggtcaggagtttgagaccagcctggccaagatggtgaaaccctgtctctgctttaaaaaaaaaaaaagaagaagaaaaaaagaaaaaaaaatacaaaaattagccaggtgcagtggcggacgcctgtaatcccagctactcaggaggctgaggcaggagaatcgtttgaacccaggaggcagaggttgcagtgagccgagatcgtgccactgcactctagtctgggtgacagggcaagactccatctcaataataataatgatgatgatgatgtagtcctctttctatcatcttctctctgtcgctcacctccctcccatcgctcacctccctccccactcacttcaagctctgttacctaggtcctcctgagctgggtgggcatgactgtgtgcctcttcctggatctcattttcctcattcctgagttctctgatggttcctcttttaagttggaggaaggggatgatggagaactaaggtcagttgctgtttcctttcttgcctgtgtgatggcttgatgttaagtttcattctcagatatggatttgctatagggatgtattatgtacgtatatatgttttgttggaggatggagattgtcgggcttggctgggccggatgtaatctgaaaaggggcatttcaagtgtatttaaatggccaaatttcataggtggcaggttccaggccacgattgctgtcccttttcctttgtgataggagaaggtcaagggtcccgtgaatgatattgtgcagaagagctagcgaggcaccgtcagggagccctgtgtgtgagacaggccaagcaaagagtgggcattgctcctggcttgatggaggtggatgggttttttgctatagaaaactacactaaatactaagaggtttcctaattcctctctatcattctttaagattattaaagatattgaatgtttacctataattttgatctagaaacttctcaagtctttatttcatattctgtaaatagaatggcagggctaaattatgttctattttctgcccattcattcatttataaaacatttgttgaacatctgctatattgccaggcactgtggtctattcattttggttaatgtcataccagtaattaaagcaatcacttgaaagtgagtcttcctgtttgcaagttactaagatgtaatcataaggcatctaatagcaatatgctgtagtaacatgaagaaatagccagtattgtggggttgagggaagagtgttggtttgatttgaaacaaaacaacatcaacaaaaatgagaacctttcctaaatatgacacagtccctctggttgacttgtttcttttatgttcgatctgtcttttctcagattcttagaggccgtgctgatctgtgagtctgcatttagaagtgtttttttttttttttttccgagatggagtctcgctctctcacccaggctgtggtgcagtggcacaatctcggctcactgcagcctctgcctcccgggctcaagcaattctcctgcctcagcctcctgagtagctgggattacaggcgcacaccaccacgcccggctaatttttgtatttttagtaaaaactgggtttcactatgttggccaggatggtctggatctcttgaccttgtgatccgcccgcctcggcctcctaaagtgctgggattacaggcgtgagccactgcgcccggcctgcatttagaaatgtttgagcctttctgttcttctgattttggtgccagaatggataatagttggtttgctgagcttttgtttagccattaagcactgcagctttgaagcaaaactgttagaagaaaacttttactcttccacccatttagttttagttggcgtttgcaaagtttgtgagggcagaaatctttttgcggctatagggaaaaggggaacatcttaggtaatgaactatagttagtcttccaagtgctgttttggtttactgtcttcctgcaggttgactctaaatcagggtgtttcagcagtggcacagtgacattttgggtcagataattctctgttgtgggggctgtcttgtgcactataggatctggcagcatccctggcttctgcccactagatactagacgcaagtagcgcacccttttctccagttgtgacaaccaaaaatcccttcagacattgccacatgtagcccgaggcaaaattgttcctggttgagaaccactgctctgaattcttaaagctgacttactgactgcagttagttttgtcagctaactgacaaaactgtagtgcttggtgttgtgtttctgtgaatctttaacagcttttcttttctttttttttttttttttttttgagacggaatcactgttgcccagcgtggagtgcagtggtgcaatcttggctcactgtaacctccacttcctgggttcaagcgattctcctgcctcagcctcctgagtaactgggattacaggtgccctcccccatgcctggctagatttttaaaaaattatttttagtagagatggggttttgccatattagccaggctggtcttgaactcctgacctcaggtgatccacccgccttggcctcccaaagtgctgggattacaggtgtgagccaccatgcctggcccttttattctgattgctgttctgattgttaaaatgcagtttgctatacctgaacagctgttgtcatccagcccagagcagttgtgctcagagggtgagcagagatggcaggcgccctgtgttcctggagtccttagtagttgttctcttgttgcttcttgatatctaagtaatggactttaataaacttactaaaaaaaactagtgtgaaatctaggccaaaacactttgatatttgacctccagctgcatgaccccacctaagtcttctaaagcacaagtaggttctcttgatttggttgtttgtaaattagataattttggatatgatctagatatcaaatcattgtagtttttcttgtttttcgttttcaggtgcagagttaggttgtttataggattgtcaagtttggctgataagtaacttcagattttgcaaacagtgtggtgctatgttgatttagcagagagggtgctggcattcacacgtctagtaagaggaagagttggaatttgaacccaagcttttctgattggccccaaagccatgctttctccctctgtaccagtgcttctccccatttaatgtgcacaggaatcccccaggggcatgttaaaatgcagattctgactcagtgggcttggggtgtgcctgcactcctacaggctccggtggtgtgtgctgctggtcttcgcctcacactttgaactctgaagctccttgctatattcctggtttactaattgtgctgtagataatccacctgaaggttaacccacaaaactgataatctacaagccaatattcaagaactgaagtggtttttcttcattttaagctgtgtgagggggagctttgtttggctgaattggcagaatcagttctgtactgagtgaatgctaggtgtgttaggtaaagtgaatgttcgaggggagtttgttgagggagtttgtgaacagctaccatatgccgtcatttccaaggcggaccttattttacattttgtcatctctgaaattgagatgtgtcttacaatggatggcctcttaccattgctgagcttgccattcaagtccggccccttcttgccaccctcccgccctttggcgagtggaaccgacagctgctaaggtgagcacttggcatctgctctccttgctgctctctcgtctgacctaggcctcactcggtccttcgttttgtcattgtggactctgagcttaggataccctgggctgtacacttgggaatttttatgctggtcagacatgctgcagggcaaggtggatttctcggtctgttgcttggcttggacatctgttaactgtggtggcgaatctgttacagatccttctttgtcttgagttgggcaggacctcctctggggctgaggtgaagtcttaaagaaagctctggccaagagtgttgactcttgcctgtaatcctgtcactttttttggaaggctgagggagggggaatgcttgagaccaggagtttgaggccagtcaaggctacatagccagaacgtgtctctacaagttttttttgaaattacccaagtgtggtggtgcatgcctgtaggtcccagctacttggggagctgagacaagaggatcaatcacttgagctaatgagctctaggctgcagtgagctatgatagcaccattgcactccagcctaggtgacaactcaagactccatctcttaaaagaaaaaaaaatttaagttctgtaatcaagtaaacaagggatcatcaatttcacatgccttcttaattggcaacattgttttttcttgatggtacacagattaataatgcattttcaggccaggtgtggtgactcatgcctgtaatcccagcactttgagaggctgaggcaggcagatgccatgagatcaggagttcgagaccagcctaggcaatatggtgaaaccctgtctctacaaagataaaaaaattagctgggcatggtggtatctgcttgtagttccagctacttgggaggctgaggcaggaggatcacttgagcctggcaggtggaagttgtagtgagccgagatcacaccactgcattccagtctgggccacagtgagactctatctcaaaaaaaaaaaaaaaaaaaaatgtctgggtgcagtggctcgtgcctgtagtcccagcactttgggaggccaaggtgggcggatcatgaggtcaggatttcaagaccagcctggccaagatggtgaaaccccgtctctactaaaaatgcaaaaaaatagccaggcgtggtggtaggcgcctgtaatcccagctacttgggaggctgaggcaggagaatcacttgaactcagagggcagaggctgcagtgagccaagattgcgcgactgcactccagcctgggtgacagagtgagactccatctcaaaaaaaaaaaaaaaaaaaaaaaaaaaagcattttctatggtggctttggtttgaagaagtttataaagttaacaaaagtttatcaggaaaaggactgggtttggaatcaaagtatgagttaggaccgggcgtggtggctcatgcctgtaatccttgcactttcggagccgagataggaggatctcttgagctcaggagttcgagacgcctggggggaacatagtgatgagacttcgagaactcgctttttttttttttttaaagttatgaattagagttttggctcttgcaacttgccagttgtatgacatcactctgggcctcagtttctgcatgtgtaaagtgacagacgctatagtctccaaagcccttctagctctgaattaattggattttaagtgtgctagaatgaattaattgaagtatgagggctctgcattaagaatatagaataaatgattctcctggcaaggagggtgtggcaagaggcatctgaactggacctccagggggaggatggaagagaaggtatttgaagttgaagagacatgctagtaggtcacagagctccttggaaaccattcataaatttaagtcctcggatgcagttaattcatgccaggtagaggttgttctcagtacaagtaaaatagtctgttggaagtaaggtgatttttcgtggcattctaaaaagattattcttcatgagatgctctttgtttttggggtttgagaacaaaataatggttcccctttggttggactaattagacaaagacactctaagaataaaatgagccatccaagtactggctgtggtcatcatttatatgagtattaggtggcaaggtgaataacacagctactcacccacactgtaggtaaactatacttaactgagatatggttaaataaaaattgtttcattatgtagttgtactatttgaagcaccagtttctgttttatgaaggaaatactgctttgcatgtatgttgaatcacttagatgtgttttgaattgggatttgctgaagacgcagaagctgttgtacttgagtacatgataccttgaaaagaaggaaaaagtttgtgtacgagtagtcagcattgtaggtaggaatttcaaaggtgaagtaactaatctcgaccagatgggctgtgctcttttttgggatttatatcccaaaaaggcgttagaattgggagtcagaagtgacagactcatgaggtttctgagttgggttttaaaattaacaagcatgctgggaattccatagccattggaatctcagatccactctgccaccttgtgttctcttgggagagttgtttttaatttccctacatcgtgtttattgcgtgtataaaataatcttcagcttttgcttgattcacaagaaaattagctaactaatgaatgaagcttaaaaggtaaatctatatacatttattgaagtataaggcagcttttattcctgaaaggcatatgctagattttacaagcgcggagatcaggcaaaattattcagtaaatccagccatggtctccttggacctaaatacagattttgtttggcctttcataacacagccttaatttttaatgtttttccttcctcatcacaggtggtccgtactgagaagaacagtttgaacaaccgattcttaccctggaatgaaattgagacagaggccatcctgtccattgatgacgatgctcacctccgccatgacgaaatcatgtttgggttccggtgagagactaatttccaatcaaaactttaggttgcaagtgacagaaaacctggattaggctgcaaaatgaattttttggctgatggtaactgagaaccccttgcagatagtcagggctgatgtaggacgtggctggatgcaggctcgtagatggcgttggaggagtccatctctcttcatctgtaggctccgctctgtgttcccacaggcctttcctctgtggccaggaaggtggaattctttgattggctagaccctggttacctgcctgttcctggtgctgcaggtgtatcatccttaaatccaaaccacatgggcagagagtagaggcaacgggtagggtagttctctaaaggaaataggagggttttgtttttagaggaatgggaaggcaaaagtgacatgttgctgtgtgttggagcaatggaacagtgccaggatcctggacccaaaaagatttgggggaaggagggtgtcagaagcaatgatttaaaaggaaaaagaaggggaggaggaaaaggaggtggtggtaatgatgatgatgatgatgatggtaaacatatgttgaacccgtactgtgtgccagggactagcctaggactttgtcttatctcattcatccttctaaaatttgatgacataaattgtagctgtctccatttcatgtaggagtaaattgagatagaagagaacagaaccacgtagaagctagaaagtggcagcagagctctgggttcaaatgcaggtttgtcacactcccaacctgcacccggccttcaactctcctgccttcttgagtcttaggaattgctgaaggatcccacttgagggtcactgcagggaagaggatggagtagatgaaggctactccaggtatctcagggactgggatgttggtttagggacagtttgttacctgttaatggtgaggtaagtacaaaaattgagggtaagcattcagaaacttgtaaagcaatttgacatttactatgaaatccaagtatatgattatttttcttgcagttcttttttttacaacatttcttcaatataattcataccccataaaattcactcatttaagtgtacaattcagtggttttagtatattcagagttgtgcaaacatcaccatggttaattttagaaatcttcatcaccactgaaagaaaccctgtacctattaacagccactcccaatttttctccaaacccctcagtcctaggtagccactcaatctttgcatctctatagatttgcctattctggacatcttctataaatagaactgtacaacgatgcatggccttttgtgactctcttctttcacggaacatgatgttttcaaggttcatccatcttgtagcaggtaccagttcttttttattttgagatggagtctcactctgttgcgcaggctggagtgcagtggcttgatctcagctcattgcaacctctgcctcccaggttcaagcgattctttcatgtcagcctcccgagtagctgggattacaggtatggaccaccaccatgccaagctaattttattttttgtattttagtagagatggggtttcaccatgttgcccaggctgatcttgaactcctgagctcaggcaacctgcccgcctcggcctcccagagtgctgggattacaggcatgagccacggtgcccagcccaggtaccagttcttcattcattttctgttgatggatatttgggtcatttctatttcttggctattatgaataatgctgtgaaccttcatgcgcaagtttttgtatgaacatgtcattcctcttgagtggatacctaagagtaatgtgggtggatcatgatagctgctttaacattttgagccggtcaggctgtttttcacggtggcagccccatattgcattctcaccagcagtgtatgaaggttctagcttctccacatcttcgtcaatgcttgttattttccattttcaaaatttatagccgtcctagtcattgtaaagtgataactaattttatatataaatgtgtgtgtgtgtgtatgtgtgtatatatacacacacacacagatggggtctcacattgttgctgaggctggagtgcagtggtgcaatcttagcatgtggtaaccttgaactcctgggctcaagtgatcctcctgagtagcggggactacaggctcacattaccacacctggctaatctttacatttttttttttttttttgtacagatgggttctcactttattgttcaagctggtctgaaactcctggcctcgagcaagcctcccaagtgctgggattacaggcatgagccacagcacccggccatacagttgtgatttgcatttctctcaatgatgttgagcttcttttcatgcgcttattgatcagttagcctttgtatatcttctttggagaaacggcttttcacattctttgcccatttttgtttggattgtcgtctttttttttttttttctgacacagagtctcgctctgttacccaggctggagtgcagtggtgtgatcttggctcactgcaagctccacctcccgagttcacgccattctcctgcctcagcctcccaagtagctgggactacaggcgcctgccaccatgcctggctaatgtttgtatttttagtagagacagggtttcaccatgttggtcaggctggtctcgaactcctgacctcaggtgatctgcccgcctcggcctcccaaagtgctgggattacaggcatgagccaccgcaccaggccaggattgtctttttattatcacgttataagagttctttatatattctagatgcaagtccattatcagtgattggagttgcacaattttctcccattccatgggttattttcttgctttcttgatggtattatttgaagcacagggttcgtgttttgaagttcagtggatctattttctttggttgcttgtgctttggatgtcatatttaagaaaccaggcagttcatttttgttgtattttaccaaagtattaatctataataattttggggaaaaattagttcttccccacatcatttgaaaaccactggaggccgggtgtagtggcttacacctgtaatcccagcattttgggaggccaaggcaggtggatcacctgaggtcaggagtttgagaccagcctggccaacatggtgaaaccctgcctttactaaaaatataaaaattagcggggcgtgttggcgtgcgcctgtaatcccagctactcaggaggctgagacaggagaattgcttgaacccaggaggtggaggttgcagtgagccaagatcatgccacttctagcctgggcaacagagctaaaacaaaacaaaacaaaacaaaacaaaaaaaacactggagtagatttctttggcgatctttttcaaattaagtgtggatccaggatagagagagttctttctctgtgcttccattctgttcactgaaggcctaacctgacctacctggctctggagctgcctttggcttaggcttgtaagagcagatgctcagataaaaggagcagaggctttattgctcatctgtcttaaatccatctgtaaagaatgatttgacacatttctgaaaaattagaacatctgttcttattctcccccacccagcctctcacatttcctttgacctcttgcttagtgtattattgaaccaagtctattgacagctgtgattaaaaaaaaaatcctggtaaaccgaggtgtattttttttacacgataatagtagctgactctctccacttgtttttatgaaaggaaaaaagccatgcagtaactccaggcatgatctttgctgctgcaggtggtagtggtgggggtgggcggtagggagtgtgtttatgctgcagcgtgatgcagtttggagcgtgccgaaggactggcgtggtgagcatagtcgtggagtgttaacaggagaactgccaacccttagatccaagaatgattttgataaggagcccagctttaaggagtttgaagcctattaacatagctggcattaacatagcttccaagcccctgatttagggacttcttaccttgcccgtgctattttccagcagatttgcaggtggtgagagaataatgggaagccttttaatgtgtctcttaactgtcattcatgtttgagatttagcctctggtaatggagctggtgaattatcattgctgtctatacatcctaaccttttcctaccctgacccttttctcatgcatttgggcatcctttgatctaaaacctttctcttattaatctccccaatttgcttatttcaccttaatgggaatgaaacagacctaagttcaaaggaaagggtaagtctaagaattctttcttctggcaaagatagatcttgactcacttcaacttaggtagccaagaaagaggcagatacaatcaatcataagggacagaaaaggtataccaagagacttgagagcatgtgtccatacagaaaggaatacacaaatggccagagcagcgttattcgtaacagaagtgcaaacaactcagagggataaatactgtggttccattatgtgaggcccctaggtagtcattcatagagacggagagtagaataggggctgccgggctgtgggaaggtgggagtggggattagtgtttaatggggacagagtttccgtttgggaagatgaaagagttctggagatggatggcagggatggttgcacgacactgtgaatgtccgtaatgccactgaaccatacatttaaaaatgattaagatggtatattttatgtttgttttgccacaatttaaaaaaaatcagttgtctaaaaaaacccacctagaaggctgttacattgtgatagaagttgtgatttctcctcttttggattagattagatgcttctagacttattaggagaggaactctgttgaaataaaatcttctgtgtcttaggaactgaagttccatgtaagtgatgagggagtttgcaggcagtttaaatctctggcagcctttctgcaggcctgtcaggtcctgtggagcttaaacgctttcagttctccaatttatcctgtgaaactggggaccaattttatttgttctaatttacctataaatttggagatgatatagaagtttctactgaaacatactgaagtctccatttatttcttccatttaatgaaacctttcagttgtatggttctgtaggccacttctcatcatacatgtttctccgtcagccctgctcaaatttggaattaggagtggtgcagttcagtagtcttctgtggttaaaccagtgctctctaaacctttttattatgttccttctctgtaaaagaaaagtgtgcaatatatgtaaattacatacatgtccttctgaactaatatgtcatgcttattaaaaacaaagcctttcttagaaaatgcttgttcattcattcatttttagagccagatcttgctctgttgctcaggccaagggaggtggtgcaatcatagctaactgcagccttgaactcctagaatcaggcagtccttccacctcagcctcccaagtagctggtagtacaggtgtgctccaccatacccagctaattacaaacaaaaatttttttttgtagagacaggatcttgctatgttgcccaggctggtctccagctccttgcttcaagcaatcctcctgtgttggcctcccaagtgctgaggttacaggcatgagccatcccaccaagccctttcttggaaattaaataagctaaaaaaagaattgaaattgatatcatctttctgctgcttagtagattattgtatataccccattctggagccctccttagtagatattgtacataccccattctggagatcccctttccaaacttagggcttattctttctggaagggctggaggatgctgactgctagagggacaatgtgcaggtgcttattaaggaagctgaatatgataccttatttgcttttatcctgtttggcttgttgttgattttgttttattttgaaaggatacgagaagtaaaagcctaagggccagagcttgtaaggtggaggcaataactgtgaacacttctgatgaccctagagctctgtattcaggtctgtgtatgcacttgtgtttttcaagggtgtggagagaagctcgggaccgcatcgtgggcttccctggccgttaccacgcatgggacatcccccatcagtcctggctctacaactccaactactcctgtgagctgtccatggtgctgacaggtgctgccttctttcacaaggtaagaaaaagctggtaataatggcatcgacttggtgagagtttcacctttgtgtggtagcggaatgctgccctcagcttagctctcctaacgcttcttacatgtttcttttgtgctagaagtcagttttttctatttttacagacaatgatcaagatgcttagagcaactctgggataaaaagtcaagatgagagggctgcctgtacagttgcacataggccatttggaaaccactttatctttctgggcgttggctctccgtttgtaaaactgagggcactgggctaaagacacctcaaataccttccagttttaacactgccaccctagatatggcccagccatcagaaggtgacctgggcacttttctgacttagatataccatgcctgtcccgggccccacgatgagcctctgtgtggctctgccagttctttgtgatgctttagtgcttattactttcactgtgcctcctaatctgattttcactgaatatctgaagcttaggaccctgcagtctttcctcctctactgttctgtattctgtttttttctcctggcccatcttccctctctacctcttccatcctgtaaagtggcccctgaccacaagtggctgctgatcacctggtgcatgactggtcagaatggagacgtgctgttcagtgtaaagtgcacaacagctttcaaaaacttgtaacaaagggtgtcagatagctcagtaattgtttgtgttgattgcatcttgaaatgcagttagtttggattactgggttaaatacagttattgatttttactgtctctttttactttttaacgatgtagcttctagaaagtttacagtgctgtatgtggtttgccttctgtgtccgtgagtgccgctctctacctccctcctgaagtgttcccgggccctgaggagtccctgttctaagattaccctggcattacccccactgcccaccacacagagcacctcttctgtgccctgagtcttctctgaggacagtgctcccattagccttttcctgtagactttgaggcactcatttccccacatctgtgctttggcacagggcaggtgtagggaacattttcattgcttaccaatgacacttccctcccagctgtcacataaagtctcatttgcagctcctgtcgtctgtcttgctgccatcaaccagccttttcatcgtgccctgacagtcaccaaagacggtggcacctgcctccttctctttgtctgcatccatgccctccatggttctggtgcctccactgtcctcacggaagaccctcccaccactctctctgcatgaatggtgaagtgtcccggggtctagcctctgttgctcttcttattttccctaggcgttctgtctcacacacaaggttttgaggcttttcttagcatctgcaggctggtaatttcctcatctgtattccagccttggcctttcttgctgaggtctgcgtttgtatatttcattgtttccagcatatctcccgtttgtccctcagacacttcaggtaaacttttcccaggaaagctcaccgtctctccctagctccttgaagtcttttctcccttacatatctcccatctcagatggtggcatcttgccagtcacctcaaatagaacaataaaattcatttttatagggacttttttaattttttaagacagggtctcactgtcgcccaggttggagtgtaatggtggggtctcagctcattttagcctccacctcttgggcccaggtgaccctcctgcctctgtctcctgggtagctgggactacaggcacgcatcaccacacctggctaattttttttggtaatttttatagagatgcagtttcgccatgttgcttaggctggtctcgaactcctggactcaagcgatctgcccgccttagcctcccaaagtgttgggattacagatgtgaggaaccgtgcctgacatatagggacgtttgaaccagcctaagcagtcgttaaactttcagctgttctttttcttttaaaaacttaatgtgtgaagttgatacactcatcccattcttgcacttcacctcaggacttcctttccttcggtgggccttgtttggactgaggattgcaagtagagtcagaggattagggtgtcagcaactggccaagattttcacacttgctcagctaagaaggagccactgatcttagcagcgtctactcataccttgaggatgtacttatcttctgaattgccttcccagattcagactgttctttaaaaccatgaatggtcaggtacctctactttcaagaaatcatttacttaatgaaatttagtatttttcctgtgtgaaaatctataaagaagattacagactagcagcgcccaaacctcagttggcttacagagagatttttgggccctctagtgttgtcctatgcactgacaacttctaaaaatcacaagatttcacaaaaagacctgagctgcaatacaaatgaagatcaggtcctctgaggtcctgtctggggcgtcatggcggctgctcctgtagttgaggcccatgatggggccttcatgcgcttacctgcctgtggctcctcgtttttcttacacctatttctttttttatttttatgagactgagttttgctgtgtggcccaggctggagtgcagtggcaccatctcggctccctgcaacctccacctcctaggtttaggcaattctcctgcctcagcctcccgagtagctgggattacaggagcatgccaccacacctggctaatttttgtatttttagtagagatgggttttcaccatgttggtcaggctggtcttgaactcctgacctcatgatccgcccgctttggcctcccaaagtgttgggattacaggcgtgagccacagcacccggcctacacccatttctttacactcatttgtcttacttgcttggtccacgaaagcagttagattggtcctctctgatcaacagctgtcaagtttttttctttttttttaaaatcataagtgcctgtcaataacactttttagacctgtacctaatatatatgtatatttacttataaattttatgcatgtgtctattactgatagatattttttagaggttgaaataacgatgaaacaaaactttaaaataatgtgatcactcaattcttaaattttagtgaaagcagtaggattgaatatgttttattatttttgaaaatcttgattggatactgtgtgttatagcaagtcaggtctgtttctaaattaaacttttttttttctcttctttttgagatggagtcttctcgcttctttctccaggctggagtacagtagtgcaatcttggctcactgcagtctctgcctcctgggttcaagcaattcttctgcctcagcctccccagtagctgggattcaccctgttggccaggctggtctcgaactcctgacctcaagtgatccacccgccttggcctcccaaagtgctgggattataggcgtgagccactgcgcctggtcaacataaatcatttttgacagcaaaaccacatactgatggaaatacctctgaacagttattctgataatgctttcatcagttttttttaaattattattaaaaggcagttcttattgttaaaatgtcatttctttcaagacgtgttatgttaatatattctcatcagcatacgaaggacagtcactggccatttaaagggtcaataaatttgaattaccttttttaaaaagtgtatttattttattttatttattcttactctttttttttgagacggaatctcactgtcacccaggctggattgcagtggcacaaccatggctcagtgcagcctagaactcccaggctcaagtgatcttctcacctcagcctcctgagtagcaggcagtacaggcacatgccactacatctggccaattttttatttttttgtagctatggggtcttctccctgtgttgcccaggctggccttgaacttctgggctcaagcatttcaccgaccttggcctcccaaacaaagtgttgggattacaggcatgagccaccatgcccagcctggatcacctttttgttaaaaaaaaaattacaattcatttttttaagttcaccaactcttaagtactttgctataagataattagcacatttattctgtgttacaaaaaaattttatcattatttcactcaacatattatattgtaggtaatgcaatatgttcatcagttaatcagtttaactgggcacctcacctattcatttgttcattacagcaaattgcaacatatagcagttaacatgtgccctgtcttgtagtatttgctgatttctatggtataaatactcttaccttggctgatttgaagttatcaacatgagtcactgaacacggatttgggaagagatacacagttgtacaccattacatagtaatttcaacatcaacagtagatataggtaacctcaagttaatagtaaaatattaactaggaagtaatgagtttaaggtgtttattgcatggatttttaatataattttaatttatttaatttgaagtttatgtaattacatctttaataatggctatgtttaacaacaagctgacaacattctgaaaatgtagaaagcgccattcatgagcaggtgtgagtggctccaacacacccctctgtgggccttgtaggacagtctgagaactttgccttttactctgagtgagatgggaagtgttggaggctttggagcgaaggggtgatatgttcagttggtttgagtgttaacacaatcacctgctgcgctgggactagcacatggggaagagaatatggcagcagggagaatatttaggagctgatgtggagaatccaggcaagagacgaaggtggttggcagcagggagtagccagggccgatggcgagtactgaccagactcaagaatctgtacaggaggcagtgagggatcgtgtgtttcatggttctgtgatttattgaggtctgagaaaataaccaggcttttttctctcacttatctttttttttttttttggccattgttagagataaaatagtgttcaattgaaccagcatctgacctagtttgacaaatctttgtattgatttcaaaatcactgcggtaccagggagatgatatgacattctgttactaaagggggtgatgatggcagtttgaatgggataattcctcactgcagaagatccacacgacaggatgtctcgaatcccctgccccagtccctaagtgccagtaatacctcctagttactgccacacccaaacagcccctccatccatgcatattttggctgaaagccaacaacctgtgtcttgtaacagagcatgtggttctttttcttcccctgacagtattatgcctacctgtattcttatgtgatgccccaggccatccgggacatggtggatgaatacatcaactgtgaggacattgccatgaacttccttgtctcccacatcactcggaagccccccatcaaggtgaggtcccaccactggtggggctgtggatgcgtgcatgtttacttcacttgttttgcagtagtgcagcacgtaactgcactgtacctcagagtcctcatttgtacaatagggatgatactacctacctcatcaaaggattgtctgtgagcttaaatgagttgttactacaggggcccttcattcctaagggcaatggatagaaatcagaaggtttggaacttgggtgggaaagatgttgcatcattatttttattaatgtcttactggaataaagcattttcttcagttatgaaacaggctataattcataagagtatttgtagtaactgatttgtcaccagtagaaatcactgatatcttcatatcacaatacctttattgcaatatctgcaaaaagtattgtttgtatttgttactgctttgaattcacggcagttactccctttcccctagatgttgtgatttaatacattaagaaaagagcatgtatgtcactgtgttttactgtaactcgtttcctttgtcatcctgtgtattgtagtttatatacctaaaaacattactttgaggagtctacagtcttgaccagattgccaagccagaggcacaggcgatgtccatcaaacaaaaaacttaagaatttctgagttaatatatgtaaagctctaagaatagtgcctggcacataagtactatataaattatttgctcacaaccaaaaataccctcagaattctagaagttctgagggtattgttgtgtttttttcttggaggtattaacacatacactcagtgcacagaaagcctggttccacccacttcctgtcatctttgtgggctctgtcagcaagttagagcatgctggtaagggttaggatagctcagtcctcacagaagcagatgttattagaaccaataatgctatagaatctgtcactccaaatgaatatttgtgactgtgcttcgtctgtgtttgtctgtttcataattgaagaaaatgctaaattccagtaagagatttatacctgatgtccttagaagggtcaacaaactaatgaggtcttattttcattattatcaaaaaggcatattatttaattttatgaaataggtttaccttcatgggtgacattgccatgagtaaatagttgtgttcgactgggtgcggtggctcatgcctgtaatcccagcacttttggaggctgaggcaggcggatcacttgaggtcaggagttcgtgagcagcctggccaacatggtgaaaccccgactctactaaaaaatatacaaattaggctgggcgcagtggcttacgcctataatcccagcactttggaaggctgaggcaggtggatcacaaggtcaggagctcaagaccatcctggctaacacggtgaaaccttgtctctactaaaaatataaaaaattagccaggcgtggtggcacgcacctgtagtctcagctactcaggaggccaaggcaggagaatcacttgaacctggaggcggaggttgcagtaagccaagatcgcgccactgcactccagcctgggtgacagagcgagactccatctcaaaaaaaaaaaaaatacacacacacgcacacacagtagcatgcgcctgtaatcccagctactcagcaggctgaggcaggagaatcgcttgaatccaggaggcagagattgcagtgagctgagatcatgccagtgcactccagcctgggtgactgagtgagactccgtctcaaaaagaaaataataataataataattgtgttctagactaagtacccaccagcatgtactaataacgataatgaaatcatctttagaagctgggtgtagtggcacatgcctggtagtctcagctactcaggaggctgagccaggaggattgcttgaatccaggagttcaaggctgaatgtgccatgggcgtgtctgtgaatagccactgcactccagcctgggcattgtagtgagaaagaagtcgtagcttgagtgctaagcagggtggccaccagaggacgctggttccatgcagcaaagcataacaaagaaatgcatgtggaggccaactgtggcccctgcgtaggatgtcactcctgattgtcccagggtttcatctgttgccgagacttctgctaaagcctcacaagagaagaataattagcaacataatgtatcaatttttttaaattgtgaaaaatagtcacaagtatttatataaaaacagtatgttttccaggtacagtggtaggtctcatattaaacagtgaaaagattttgtagactttgaggtagggaggcaaaggttttagaaagcaattaatgatgggtgcaattttctcttccttatatatcctttcttatgtagccagggactggacttgagtcaagatgtatgcatcaatttatgcctctctagtagaccagaagacatggtccatgaaaatttaaagtatctgagtgattaggtacctaataatagcatcagttacctgagcaggcacagacatggggaatttttcatctttgttaaagtgtgtttgtctactgcattattaggccagtgtttcattagttaagccatctcttcagtgcaggtggaagtaatttagacatggtgcacatgattcttaccaagtgaaaacttcaaaactgagtattctctgtgaattttcttcatctttctggaatatatgaagaattcaagattgggatgacttttcaaattcaaaggctgaaattaagagtgttttctaactcttagtaattccttcaacttatgaatctaattatttacttcataataaagaaccagtttgaattaaatattttatttacctaattttaatggtatcaggtatatgtactattttatgttcaaaaatagtaatttttttgttgtgctttaaatacctcaaatttttactgtcaaactattccttgtttgagttagggaggtttgactgcttcgtatgattggcagtgttctttcaataatgttaatatcttaatattgactaacgaatggggagttaatgtcatattatttctttgaataatgtactacttttgcaaggagaacacagaatataaataggcttcattcaggataagagattgaaaagtcacctgtaaagttttgagaaaacagatggcttaggtggtaaggaagccgaaatgcaagtgaacgtcttggttctctggggtgatataggttcttggcagctatcaaggattttcctcattgttactaagcataaaacgaatatttttcttagattgagttacctggaatcttccatgtaaactgtgatccacgatattggttaaataagtaaatgtccagacttcagttaatattatagttgcttcattctttttaaattttttgcatgttttattatgtaacacagttatatatttacaaatatattggggatgcagtcttaaatggttttttgtttcttttttgagatggagtctcgctcttttgctaggctggagtgcagtggtgcaatctcggctcactgcaacctctgcctcccgggttcaagcgattttcctgcctcagtcttctgagtagctgggactataggcgtgtgccaccacgccccgctaatttttatatttttagtagagaaggggtttcaccatgttggccaggctggtctcgatctcttgacctcgtgatctgcccgccttggcctcccaaagtgctgggattacaggtgtgagccaccgcacccagcttaaatgttttttttactgatggattacatgattaaaacatttggaaaccactgcttccgtgaaaacaacagttataaagtcaccttttgtgtcacatggaataatgtgcaggttaaagggcatttctcctggggttggattctggtgtctggaatgatgagaaaggtttttagatccagtgagagccccatggaatactggacatagatgctgtttgagaacatccttccccagattcctgacccctacatcctgctccagtgggaaccgtggaagagcaataactcagtgctgacgtgatcccgaagggttctaagagagcagcagtgagtgaggggagaagtgaggagacaggtgggaccctggagggggacctgtggaggtcatgactgtccagagactcggttctgaggggagccaccctttgagcactggcctgtgtctcctcccagtttaaactctgggacctgggctctgacggcgcatactggctgtacacaatgattactcttccactattaagttatgggatgtgtctttcaattaaaaaatttccccttaatttataatggaaatttaaaaattatttgagaaaagatagacatgcagaaagaaatcaaaagtaccaaaacttttggcttatttcttttggttctctggtatcctgtctatcgtggtgacttatttatttatacatacatatatatatacacatatgtgtgtaaaaatacgtatatatgtattttttctttttcttttttttttttttttttgagatggagcctcgctctgtcacccaggctgcagtgcagtggcacgatctcaggtcactgcaacctctgcctcccgggttcaagtgattttcctgcttaagcctccacagcagctgggattacaggcatgtgtcgccatgcccagctaatttttttgtatttttagtagaaacagggtcttgccatgttggccaggctggcctcaaactgagctcaagtgatccgcccaccttggcctcccaaagtgctgggattacaggtgggaaccaccacatctggccttatttttatattttaaatttatatacttgatttgcagtctgctttttaaaaacttgacagtaggctgggcgctgtggctcatgcctgtaatcccaacacttggggaggctgaggcgggcagatcacgaggtcaggagatcgagaccatcctggctaacacagcaaaaccaatctctactaaaaatacaaaaaattagccaggtgtggtggcaggcgcctgtagtcccagctactcgggaggctgaggcaggagaatggcataaacctgggaggcggagttcgtagtgagccgagatcaccgcactgcactccagcctgggagacagagtgagactgtctcaaaaaaaaaaaaaacttgacagtaaatttttgggttttgtactatagtggattaggtagtttgaaaacctgatcactataagtaacaaacttattttttcagtgtatagttgagctaataaaaaggtaagagaattgccagaaaggaagcaggtgggaggactaaaacttagggtggcaagcgtggtggcatcactgaggccaccatggggggctgctctcaccttagttgtctagaggcttggattttatcactcatgtgaaggagtgtagagcctgttaagggtggagaattagaatggagatctcctacccgttgccccggggagatgacacataccttgtttattttaaccttgactctgacaggttgttggggaagtgtaggttgagaatgttaaatagtcttttgagcctccatgggcttagggactcattctgtatgaaatctagacccagggccacatgagatggctcaagtctgtaatcccaacatgttgagaggctgaggcaggaggatttcttgaggccaggagttccagaccagcctgggcaatatggggagtccccagggaaaaaacaaaaaagaaaactagacccagtcgtcgatacccttggactgtttgacaaaataaaaccaaaaatctgttataaggagaaattactctcagcagaggaagttcccacttaagaaaaagagaaatttcttcacctcaggtcacataggacacgcacaggtaaagcctcattgaagatgagcttgaaatgtaaagtcaacagtcagccaccaagaaaacagctgatcatgagcaggagtgaacacatataacaaacaggttatagttctccaaggatttcaaataataaagccattagatagactataaaacaagtaggcttaaaattagtaacctgaaaacataaaaaagcaacaaatcactccaaaaagaacaaacagattggaaagccctaaatggaactattgaaaatgagaatcatagttattaaatttcagtgaaatgggataaaaagatcagacttaggtgaaaagaaaaggaagtagaagataaatttaaagacacttcttccccatctttctttgtgaggcgtccacccctccctgctcccctccatggagccagtgtttccaaaggcccccagcccgctttgcaggtgtcacttctccagcccatttaaaacccaagttcatggctatcttgcaggatttgctttttcattgtttggcctctgaggatttcattcattcattcattcattcattcattcattcattcattattcattgtttattcatgcatgcatgtatgtatgtgagtgagtgacagggtctcactgtcacccaggctggagtgcagtggtaccatcatagctcattgcagcctcaaactcgtgggctcaagcagcctcccatctcagcctcccaagtagctgggactacaccagatagctggcctgctgccacacgcagctaatatttttatctcttgtggagatgaggttttgctttgttgcccaggctggttttgtactcctgggctcaagcgatcttcctgccttggcctcccaaagtgctggaattaatcaccaggtaatttcatttcttattacaggctctgccctgtatttaaagagatggtttatgtatttcttcttgcatgttcaggtgttctgaggggtttttatgccattcggcctgccacattgtaatgaagctgtccctcttcatacttttttagttagacattttctaattaataataatatgactagactgtagtatggccactttcccatggctttaaatgtagttaagcatcttttttatggacagtattcaagaatgatagcccctctttgactagcccctctttgggtagtcttcaatacccaaagcccctctttgggtagtcttcaatattttgattcaaaacattgatgaaacaaacaactcggtacctacctatggctctgcaaccaagtacatactaggagtagacttactgagacagctgacactacacacgttaaggcttttggcatctgagaagcgtaggccatctcaacagaatacctgacaatgttctggagacatctggtaggcaggaggcctggggccgggctctggttcctgccatgctctgcagggatgttgcccctgaggggatcagcgtcttcaccatggacatgggagtgtgggatcggctcagctgcaagggttctgtcagtattagctgggattcccactctgtctctctctcccgtttccaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatatatatgtgtgtgtatataaatacatgcacacacttgcatacatatatatttttggctgggggagtgtgagttttgcctttctaagggagggaccgcgcaggctcctttgttctgtattctggcggagatgggtcctggccttgtgtcactggcttatccttaaagatcatctcccatcctccccagcgccatctgtgtgcagcaaccagaaagggatgaacttggccctcttgcgggcctggacaaggtctcttccttaccctttctgttgccagtcagcaacctgtaactcacattctcttcccagtgaatccctgggagcgcctgaccctggtgggctgttcagcttcctgctgctggggccagcgatttttgaggatttatctttaggccaggcttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtcttacattggatttttgtaaaaaaataaaaataaatggagactttaactcaagca

SEQ ID NO: 2486 - DNA, 52218 bp, Homo sapiens; identical to SEQ ID NO: 2485
  source 1..52218: mol_type = genomic DNA

SEQ ID NO: 2487 - DNA, 52218 bp, Homo sapiens; identical to SEQ ID NO: 2485
  source 1..52218: mol_type = genomic DNA

SEQ ID NO: 2488 - DNA, 5280 bp, Homo sapiens
  source 1..5280: mol_type = genomic DNA
tgaaggactgggcgagcaccgagggcgtgaacccggaaggtggcgcggccaccagtaacatgatctctagactgggacggtggggttcctgccggctgtattcgggccttggactggactgagaagctacggtgcggatccagctggggtatcaggggctaggcacgtgatgaaaatgaaggacgcggacaccaggacaggaatctcctggttcttagagaatttatttcgccacaaataattggcaaacgggatctcgctgtattgctcaggctggtctcgaactcctgggcacaagcgatcctcacgcctcagccttgcccaatgttgggattacagacgtgagctaccatgcccagcccaggattcttttaaaacttaaatctgatcgtgcctctggccttattggaatccaatgccattaccacctccaccaccacacatcccgtctccagccaccctggccttcattcaggcctttgtgttttctttttcttttcttttttttttttttttttgagacgagtcttgctctgtcgcccaggctggagtgcagtggcgcgatctcggctcactgcaacctccgccttccggattcaagcaattctctgcctcagcctcccaagtggctgggattacaggtgcccaccaccaagcccggctaatttttttgtatttttagtagagacgcggtttcactatcttggccaggctggtcttgaactcctgaccttgtgatccacccgcctcgctcggcctcccaaagtgctgggattacaggtgtgagccaccgcgcccagcctgtgttttcttattagtaattataaagggaatcttatttgacagttctttgacaaataattcagtttgcagaggggatcctgccccagaggccctggcttggagtggaatgcagggccgtgtgcaggagagcctgctcaagtgccgcctggcttttccctccttaggtggagaccatccatggaaaagaacccccctgatgatacgggccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtgatggctccatcagtcattatcctgccctttcgctggtgaaaacgtcaacctagaggccaggcgtgatggctcatgcttgtaatcccagcactttgggaggcggaggcgggaggatcacttgaggccagcagttcgagaccagcctggccaacatggcaaaaccctgtctctactaaaaatacaaaaattagctgggcgtggtggtgggtgcatgtaatcccagctactccggaggctgaggcaggagaatcacctgaactgaggaggtggaggttgcagtgagtggagatgctccattgcactccagcctgagcaacaggagcgaaactttgtctcaaaaaaagaaagaaagaaagaaaatgttaactagaagctgctttgtctcatcccgtatttttgttaagcatcagcaccttgtgcaagttttttttttttcccttttttttgaggcggagtctcgctctgtcctacaggccagagtgcagtggtacaatcttggctcactgccatctccacctcccgggttcaagccattcttctgcctcagcctcccgagtagctgggactacaggcacgcaccaccacacccggctaatttttgtatttttagtagacagggtttcaccatattggccaggctggtctcaaactcctgacctcatgatccgcccaccttggcctcccaaagtgctgggattacaggtgtgagccaccatgcctgggcagtttttttttttttttagatagggtcttgctctgtcattccagctggagtgcagtggtgcaatcttggcttactgcaacctttgcctcctgggttcaagcgattctcctgcctcagcctccctagtacctgggattacaggcacccaccaccatgcccggctaatttttgtatttttagtagagataagagtttcaccatgttggccaggctagtctcaaactcctgacctcaggtgatctgcctgcctcagcctcccaaagttctgggccaccgcaccaaccaacacttttttttttttttttgagatggagtttcgctcttgttgctcaggttggagtgcaatgatgcagtctcggctcactgcaacctcctcctcctgagttcaagtgattctcctgcctcagcctcccgagtagctggaattacaggtgcccgccaccacgcccagctaatttgtattcttagtaaagacggggtttctccatgttggtcaggctggtctcgaactcccgacctcaggtgttgtgcccgcctcagcctcccaaagtgctgggattacagtcgtgagccatcgcgcccggccgccaacacttatttttaaaatcagtttagtagcttacgcctctgatcccagcatggggaacatcaattgtgtgtgtgtgttgtttgtttttttcacttttgttttctttgttatgtgtgtgttgtttttaaatcaccccctctgatgtggagctagagttgagagccacattgaagatgcaagcagccatgaatggttcacagatccctctctactatatcccttgcgtcaccgttcctaactttccttgatataacactgttgtctgccttagtataaccaccactaactagaccaggtttctcctttgaggcaggcttcctgcagctcctgcgtgaagtaggcctagtttaggtgtagccatcatttaatcctgcacaactgaaatgtttcttaatggaccaacagaaagtgtttgaattcatctgtgtgtttttctaaacattctgaaaacgcacatttttgtaaattaatgtcttaactcctttgtgtggttcacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaaaaaaaaaaaaaaaagaaaaaggattttctccagcagcaaccagtgaaagatgaggcgaggcttgaatggagcccgtgggtcgtcctgccttagcgtctgagttcagcttgtgaagttagtgggccgcagagggcactgccttcattctgctaagacgaaaagggctggtgggatcttcgcaagagagtcagggactcacactcagcaaaaagcattagggccgattttaatgtgcgaccttgacctgcatctgtcatggaaagtgccttctaaaaagcttcagtggtggatgtgaccatctgaaggaaacaaatgtacaaggaagcactgtgtatcctaagccctgggttcccagagtttcacctgctgttcatcaggtctggccttcatatacccgtactgcgagggctgtttccaatgtaaataaataactgcgcaaca

SEQ ID NO: 2489 - DNA, 4813 bp, Homo sapiens
  source 1..4813: mol_type = genomic DNA
gtgaacccggaaggtggcgcggccaccagtaacatgatctctagactgggacggtggggttcctgccggctgtattcgggccttggactggactgagaagctacggtgcggatccagctggggtatcaggggctaggcacgtgatgaaaatgaaggacgcggacaccaggacaggaatctcctggttcttagagaatttatttcgccacaaataattggcaaacgggatctcgctgtattgctcaggctggtctcgaactcctgggcacaagcgatcctcacgcctcagccttgcccaatgttgggattacagacgtgagctaccatgcccagcccaggattcttttaaaacttaaatctgatcgtgcctctggccttattggaatccaatgccattaccacctccaccaccacacatcccgtctccagccaccctggccttcattcaggcctttgtgttttctttttcttttcttttttttttttttttttgagacgagtcttgctctgtcgcccaggctggagtgcagtggcgcgatctcggctcactgcaacctccgccttccggattcaagcaattctctgcctcagcctcccaagtggctgggattacaggtgcccaccaccaagcccggctaatttttttgtatttttagtagagacgcggtttcactatcttggccaggctggtcttgaactcctgaccttgtgatccacccgcctcgctcggcctcccaaagtgctgggattacaggtgtgagccaccgcgcccagcctgtgttttcttattagtaattataaagggaatcttatttgacagttctttgacaaataattcagtttgcagaggggatcctgccccagaggccctggcttggagtggaatgcagggccgtgtgcaggagagcctgctcaagtgccgcctggcttttccctccttaggtggagaccatccatggaaaagaacccccctgatgatacgggccccgtgcacgtgcctttggggcatattgtggccaatgagaaatggcgcgggtcacagctggcgcaggagatgcaaggtcggtggcctgccctctgccagccctttcctcccctgacatattaaaaaaaaaaaatctgcctattattgccatcttttcatccaaagcttatggaactcattttcttctctgtattttaagggaaaattaagctcattttcgaggatggcttgacaccagacttttatctgtcgaacagatgctgcattctttatgtcaccgaagctgatttggtggcaggaaatggctacagaaagaggcttgttcgggttagaaatgtaagtattaggctgggtgctgtggctcacgccagtaatcccagcactttgggaggccaaggcgggtggatcacctgaggtcagtagttggagaccagcctggccaacatggtgaaaccctgtctctgctaaaaatacaaaaattagctgagtatggtggcgcacgcctgtaatcccagctactagggaggctgagacgggagaattgcttgagcctgggaggcagaggctgtagtgagccgagatcacgccactgcactccagcctgggcgacagagtgagattccaactcaaaaaacaaaaaacaaaaacaaaaaagaaatgtaagcattggattaaagaaactcgaacattgatttgtctcaccccacccttccctccatcccttggtatcatttatttaaaatcattggccaggtcaggcacgaagtgatagcattcttaacctgaaaagcaatttggttgcaaaatgacttactgtcttttttcctttcaagtccaataatcttaaaggaattgtagtcgttgaaaaaacccggatgagtgaacaatacttcccagccctacagaagtttactgtgctggaccttggaatggtgctgcttccagtggccagccagatggaagcatcctgcctcgtcatccagttggtgagtaccgattcctacaccttcgtggtagtcctgtcctcatggacactcagctgctctccagaagcaaccatcaatccaatctatgtcattctctgacttggtttataaaatctcttcgaggaatttaaatgcggaagctgcctctgcagccagctcagcttgtcacacactccaggcaagtgtatcacaaagtatacaagttggagacctgattttagattctcagggtgtgatggctccatcagtcattatcctgccctttcgctggtgaaaacgtcaacctagaggccaggcgtgatggctcatgcttgtaatcccagcactttgggaggcggaggcgggaggatcacttgaggccagcagttcgagaccagcctggccaacatggcaaaaccctgtctctactaaaaatacaaaaattagctgggcgtggtggtgggtgcatgtaatcccagctactccggaggctgaggcaggagaatcacctgaactgaggaggtggaggttgcagtgagtggagatgctccattgcactccagcctgagcaacaggagcgaaactttgtctcaaaaaaagaaagaaagaaagaaaatgttaactagaagctgctttgtctcatcccgtatttttgttaagcatcagcaccttgtgcaagttttttttttttcccttttttttgaggcggagtctcgctctgtcctacaggccagagtgcagtggtacaatcttggctcactgccatctccacctcccgggttcaagccattcttctgcctcagcctcccgagtagctgggactacaggcacgcaccaccacacccggctaatttttgtatttttagtagacagggtttcaccatattggccaggctggtctcaaactcctgacctcatgatccgcccaccttggcctcccaaagtgctgggattacaggtgtgagccaccatgcctgggcagtttttttttttttttagatagggtcttgctctgtcattccagctggagtgcagtggtgcaatcttggcttactgcaacctttgcctcctgggttcaagcgattctcctgcctcagcctccctagtacctgggattacaggcacccaccaccatgcccggctaatttttgtatttttagtagagataagagtttcaccatgttggccaggctagtctcaaactcctgacctcaggtgatctgcctgcctcagcctcccaaagttctgggccaccgcaccaaccaacacttttttttttttttttgagatggagtttcgctcttgttgctcaggttggagtgcaatgatgcagtctcggctcactgcaacctcctcctcctgagttcaagtgattctcctgcctcagcctcccgagtagctggaattacaggtgcccgccaccacgcccagctaatttgtattcttagtaaagacggggtttctccatgttggtcaggctggtctcgaactcccgacctcaggtgttgtgcccgcctcagcctcccaaagtgctgggattacagtcgtgagccatcgcgcccggccgccaacacttatttttaaaatcagtttagtagcttacgcctctgatcccagcatggggaacatcaattgtgtgtgtgtgttgtttgtttttttcacttttgttttctttgttatgtgtgtgttgtttttaaatcaccccctctgatgtggagctagagttgagagccacattgaagatgcaagcagccatgaatggttcacagatccctctctactatatcccttgcgtcaccgttcctaactttccttgatataacactgttgtctgccttagtataaccaccactaactagaccaggtttctcctttgaggcaggcttcctgcagctcctgcgtgaagtaggcctagtttaggtgtagccatcatttaatcctgcacaactgaaatgtttcttaatggaccaacagaaagtgtttgaattcatctgtgtgtttttctaaacattctgaaaacgcacatttttgtaaattaatgtcttaactcctttgtgtggttcacctttcaataattttactgatgtctgagaaattatattcatgatacatgaaaacatttgttcccttaagtcaagctgagccaaatggaaaaacgcaatttctacaaaacatattttaagaaaacggccagtcctccagagggcgctcacgtgctgttgctttcattgtggttcaggttcaagagcaaaccaaagagcccagtaagaaccctcttctcgggaagaaacgggccctgctgctgtctgagccttcgctccttcgaaccgtgcagcagatcccaggagttggaaaagttaaagctccccttctcctccagaagtttccaagcatccagcaactgagtaatgcttccattggggaactggagcaggtggtcggacaagcagtggcacagcagatccatgccttcttcacgcagcccaggtgagggctggcctcagggccacggcatcttctcctgagaccacaaacaccaggatcttgttttcagctttaaaaaccaagagaatgggccgggtgcactggctcacgcctctaatctcagcactttgggaggccgaagacagcggatcatctgaggtcaggagttcaagaccagcctggccaacatggagaaacccctaaaaataggaacaattagccaggcatggtgacaggtgcctgtaatcccagctacttgggaggccgaggcatgagaatcacttgaacccgggaggcggaggttgcagtgagctgagatcgtgccactgcactccagcctgggcaccagagcgagactccgtctcaaagaaaacaacaa

SEQ ID NO: 2490 - DNA, 4240 bp, Homo sapiens
  source 1..4240: mol_type = genomic DNA
gacgatacgccgggcgcaggcgcagaagccgcgcccgtccgcggcgccgccagccagggcggaaacggctgcggcttcgctagggacgcatgcgcgggtcccttagttttcgcgagataacggtcgaaaacgcgctcttgtcgatttcctgtagtgaatcaggcaccggagtgcaggttcgggggtggaatccttgggccgctgggcaagcggcgagacctggccagggccagcgagccgaggacagagggcgcacggagggccgggccgcagccccggccgcttgcagaccccgccatggacccgttcctggtgctgctgcactcggtgtcgtccagcctgtcgagcagcgagctgaccgagctcaagttcctatgcctcgggcgcgtgggcaagcgcaagctggagcgcgtgcagagcggcctagacctcttctccatgctgctggagcagaacgacctggagcccgggcacaccgagctcctgcgcgagctgctcgcctccctgcggcgccacgacctgctgcggcgcgtcgacgacttcgaggcgggggcggcggccggggccgcgcctggggaagaaggtgggcgcggggccgggccgggggagccagggcctggtcgcccggctgtaggtgctgcgaggctcctccggttggcctccaggcgcctcccctttgccgggtttgatttgcgtgggttttctccgtacagccctggttttgcagatgggagagccagaaacgcagaaaagttaacttattcgaggttgcagggcgtggacacgcacagtcctttttcctccacccacttctgcccgggtaaattagaaaactcactgaagaaaagatgagtcagagaaggtgtgggggaggggcagaggttgggtgagcctgcctcgcatcatttcctttctgtctcggaatatgcttttcacggctgtctgagagtaatactagcattcagtaactcctacccaggggcttacagtgtgccgcttacccttgtaactgccaaatacaattttcgcagtagccctgtggcttagatactgttagctatcactgttcccattttacagaggacaggactgtggctcacaggttaagtggctttgtcgaaatgcgcagccgataactgacggagctaggcttgagccaagcagtccggcctccggatgggtagtgttagccactacactgcctctctggtcaagttcattgtggagtggcttcctgtcctgctctcggtcactccctctccaccctcgcctgtggattgcagcagcttccaggataaaaaagaaaccctgagtacagcagagtttctcagccctaccccccttgttctcagagtcgggagaggcttgggagtgctctggggacgcctctcagaggcttcaagctgtagcttggaatcagccattcagtcaccaatcagatagggcctaaatgtgtcaccatgggtttcactctgtaaagactggtgcctgttggggacaggatggacagaacagctctctgcctgagagcagtcaagtccagattttaaaaaaaatcagtactgaacaaacaaaacaggacgtagaaaaatcgggttttatggatatttaatgtctggaaaaacactgataaattgcattttaaaggcggtctacgaaacatagctgacatttgagatgtatgtgtgcttggttttatttatatcgtcatgtagttactgtgtgctgggaaaagtacaccagaaggtgagcggtgggtatggacaggttggtagcgggcgactctgccttcctccccagaagttcagcatagcggttaagggtcgactctggcaccacactcttagggtttcagaacatggctctgccatcgtctagctacacgatctcaggaatgtccattagcttccctgtgcctcaatttcctcatctgtacagtcatggtaacacagtgcccagcccacagggctgtcagagctgcgggagctggtacacctgccaacggtgtctcagaattgccagtagtccaagcagcaccctgtcctgcctctcctttcctctcttcacattccagaagcggccttttatggtcttgtgaccagctccctgatctcagtggtgacgtcagcagatgaggagtatggtagccagggactgaagactggtggtcactcggggcagctttctaaataacaattggagtgcctactagtttcctgtgattgccataacaaatgatcacaaatctggtggcctgaagcaatagaaatctaccccctcaatctggaggccagaaatctgaataagcagggtgccacagaccggcacaccctcggaatgctgttggggaggctccttccgggtctcgtccgctttgtggtggctccaggcattctttgacttgtggccgcttcactccaggctcacacggccttccctgtgtgtctcctgcaaggatacctatcattggtgcatccaggtcatccaggatgatctcctctcaagaccctcagcttacctttgcaaagatgctttttccaaagaacattcatggtttcagcaatttcacgtgaacataccttggggtgacatcgttcagcctgctgtagggcaggatgtgggatcaaccctattttcttccctcccacaactccccagcccctccctcagtgtctcctgctctaagtaggtagctccactacaacttcctttggcacttgagtcttcagtgggccacgcctcctaggacagtattagagagcagggggtttggctgaggtggaatcaggccactcttgggcatttggtgcagcccctttgctgccaggcgactctagcctctacagaggacctcgtgtaggcacctctgtccactcagcacttggcgtctgtgctgaaaagccctagggaggattgtggggtcgcttgtctccaaacctatggtaaaccgttctgttctttccttcccagacctgtgtgcagcatttaacgtcatatgtgataatgtggggaaagattggagaaggctggctcgtcagctcaaagtctcagacaccaagatcgacagcatcgaggacagatacccccgcaacctgacagagcgtgtgcgggagtcactgagaatctggaagaacacagagaaggagaacgcaacagtggcccacctggtgggggctctcaggtcctgccagatgaacctggtggctgacctggtacaagaggttcagcaggcccgtgacctccagaacaggagtggggccatgtccccgatgtcatggaactcagacgcatctacctccgaagcgtcctgatgggccgctgctttgcgctggtggaccacaggcatctacacagcctggactttggttctctccaggaaggtagcccagcactgtgaagacccagcaggaagccaggctgagtgagccacagaccacctgcttctgaactcaagctgcgtttattaatgcctctcccgcaccaggccgggcttgggccctgcacagatatttccatttcttcctcactatgacactgagcaagatcttgtctccactaaatgagctcctgcgggagtagttggaaagttggaaccgtgtccagcacagaaggaatctgtgcagatgagcagtcacactgttactccacagcggaggagaccagctcagaggcccaggaatcggagcgaagcagagaggtggagaactgggatttgaacccccgccatccttcaccagagcccatgctcaaccactgtggcgttctgctgcccctgcagttggcagaaaggatgttttgtcccatttccttggaggccaccgggacagacctggacactagggtcaggcggggtgctgtggtggggagaggcatggctggggtgggggtggggagacctggttggccgtggtccagctcttggcccctgtgtgagttgagtctcctctctgagactgctaagtaggggcagtgatggttgccaggacgaattgagataatatctgtgaggtgctgatgagtgattgacacacagcactctctaaatcttccttgtgaggattatgggtcctgcaattctacagtttcttactgttttgtatcaaaatcactatctttctgataacagaattgccaaggcagcgggatctcgtatctttaaaaagcagtcctcttattcctaaggtaatcctattaaaacacagctttacaacttccatactacaaaaaattttctattcct

SEQ ID NO: 2491 - DNA, 176521 bp, Homo sapiens
  source 1..176521: mol_type = genomic DNA
atggacttagcaccagacagggctactggccgcccgtggctcccgttgcacactctatcagtatctcagctccttcgagtgttttggctactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccgcagtaccagctcctggttgaggtggaggacaagggtgagcctaagcggcggggctaccttcaggtaaacgtgactgtgcaagacattaatgacaaccccccggtttttggcagttctcactaccaggcgggggtgcctgaggacgcggttgtgggttccagcgtcctccaggtggcggcggcggacgcggacgagggcaccaacgcggacatccgctatcgcctgcaggacgaggggacccccttccaaatggaccctgagacgggacttatcacggtgcgggagcccctggacttcgaagctcggcgccaatactcgcttacggtgcaggcgatggacagaggcgtgccttccctcactgggcgcgccgaggcgctgattcagctgctggacgtgaatgacaatgacccggtagtgaagttccgctacttcccggccacctcgcgctacgcctcggtagatgagaatgctcaagtgggcaccgtggtggctctgctcaccgtgacggacgcagattctcccgcggccaacgggaacatctccgtgcaaattctcgggggcaatgagcagcgccactttgaagtgcaaagcagcaaagtgccgaacctgagcctaatcaaggtggccagcgccttggaccgcgagcgcatcccttcctacaacctcacagtttccgtctctgataactacggggcgccccctggcgcagcagtccaggcgcgctcttctgtggcaagcctggtgatttttgttaatgacatcaatgaccatcctcctgtcttttcacagcaagtgtacagagtgaacctgagcgaggaggcgcctccgggaagctatgtgagtgggatatctgccactgatggcgactctggtctcaatgctaatctgcgttacagcattgtctctggcaatggactgggatggttccatatcagtgaacatagcggcctcgtgaccactgggtcctctgggggcctggaccgtgaacttgcttcccagattgttctgaatataagtgcccgggaccagggagttcaccccaaggtgtcctatgcccagcttgtagtaactctcctagatgtgaatgatgaaaagccagtatttagccagccagaagggtatgatgtgtctgtggttgagaatgccccaacagggacagaactgttgatgctcagggcaactgacggggacctgggtgacaacggaacagtgcgcttctccttacaagaggcagagactgaccggaggtccttccgtctggatcctgtgtctgggaggttgagtactatttcctccttggacagagaagagcaagccttctactccctgttggttctggccacagatctgggctcccctccccagtcatcaatggctcgcataaatgtgagtcttctggatataaatgataacagccctgtcttctacccggtccaatactttgctcacattaaggagaatgagcctggaggtagctacatcaccactgtgtctgccactgacccagacttgggtaccaatggtactgtcaaatatagcatatctgctggggacaggtctcggtttcaggtcaatgctcagagtggggttatttctacaagaatggccctagacagagaagaaaaaacagcttatcagttgcaaatagtagctactgatggtggcaatttacaatctcccaaccaggcaatagtaaccatcactgtattggacactcaagacaacccacctgtattcagtcaggttgcctacagctttgtggtttttgagaacgtggcgctgggatatcatgtgggtagtgtgtctgcatccaccatggatctcaattccaacatcagttatctcattactactggggatcagaaaggtatgtttgctatcaaccaggtcactgggcagcttaccacagcaaatgtgattgatagagaagagcaatccttttatcagctgaaggtagtggccagtgggggcacagtgactggagacactatggttaacataacagttaaggatttgaatgacaactctccccatttccttcaggcaatagagagtgtaaatgtggtggagaattggcaggcaggtcacagcattttccaggccaaagctgtggaccctgatgaaggtgtcaatggcatggtactctatagtctgaagcaaaaccccaagaacctgtttgctatcaatgaaaagaatggcactattagtctgcttgggcccctggatgttcatgctggctcctaccaaatagagatcttggcatctgacatgggtgtcccacagctctcctctagtgtcatcttaacagtttatgtccatgatgtaaatgacaattcaccagtgtttgaccaactctcttatgaagtcaccctttctgagtcagaacctgtgaattctcgattctttaaagtacaagcttctgataaggattcaggagcaaatggtgaaattgcatacaccattgctgaaggaaatacaggggatgcttttggcatattcccagatggtcaattgtatataaaaagtgaactggaccgtgaacttcaagacagatatgttttaatggttgttgcttctgacagagcagtggaaccccttagtgctactgtgaatgttactgtaattttagaagatgtaaatgataacagacctctttttaacagtaccaattacacattttacttcgaagaagagcagagggctgggtcgtttgtgggcaaagtaagtgctgtagataaagactttgggccaaatggagaagtaaggtattcttttgaaatggtgcagccagattttgagttgcatgccatcagtggggaaattacaaatactcatcagtttgacagggagtctcttatgaggcggagagggactgctgtgtttagctttacagtcatagcaacagatcaggggatccctcagcctctcaaggatcaggccactgtacatgtttacatgaaggatataaatgataatgctcccaaatttttaaaagacttttaccaagctacaatatcagaatcagcagccaatctgacacaagtgttaagagtatctgcctcagatgttgatgaaggtaataatggacttattcactattctataataaaaggaaatgaagaaagacagtttgctatagacagtacctctggtcaggtaacactaattggcaaattagactatgaagcaacacctgcctattcccttgtaattcaagcagtggattcagggacaatccccctcaattcaacgtgtactttaaatattgatattttagatgaaaatgacaataccccttctttccctaaatcaacactctttgttgatgttttggaaaacatgagaattggtgaactcgtgtcctctgttactgcaactgattccgattcaggtgacaatgctgatttatattacagtattactgggactaacaaccacggaacttttagcattagcccaaacactgggagtatttttcttgccaaaaaactggactttgaaacacagtctttgtataaattaaatataacagcaaaagaccaaggaagacctcctcgttcatctacaatgtcagtggttattcacgtgagggactttaatgacaatcctcctagctttcctcctggagatattttcaagtctattgttgagaacattcccatcggtacatctgtcatttcagtgactgcacatgaccctgatgcagacattaatggtcaactatcctacacaatcattcaacagatgccaagaggcaaccactttaccatagatgaagtcaaagggactatatatactaatgctgaaatagatcgggaatttgctaatctctttgagttgactgtaaaagccaatgatcaagctgtgccaatagaaactagacggtatgctttgaagaacgtgaccattttggttacagacctcaatgacaatgtcccaatgtttatatcacaaaacgcccttgctgcagacccatcagctgtgattggttccgttctgacaacaattatggctgctgacccagatgaaggtgctaatggagaaatagagtatgagatcatcaatggggacacagacaccttcattgttgatcgttatagtggagacctgagagtggcttcagcgttggtgccttcacagttgatctacaatctcatagtttcagcaacagaccttgggcctgaaaggaggaaatcgaccactgaattgaccatcattcttcagggccttgatggacctgtttttactcaacccaaatatataactattttgaaggaaggagaacccattggcacaaacgtgatatcaatagaagcagctagccccagaggatctgaggccccagtggagtattatattgtttcagttcgttgtgaagaaaaaactgttggacgcctctttactattggacgacatactggtataattcagaccgcagccattctggaccgggagcaaggagcatgtctttacctggtggatgtttatgccatagaaaaatcaactgcttttcccagaacacagagagcagaggtaatgattttgtagtcatttattatttgttgatttgctttttagaaaaatcattctctttatatttactctctataattgtttaccttcattgtttattgttaaatttgtgaacaggaacacctaaaaatgttctgtcaaaggctaacagagagttacataaactttagttttaatcttggttgcaactaaacaacaaactttcttttcactttatattttactttatagcaatcacatatataaggttaaggagaaatctttagccatttcagaggggaaaaaatccatatatctaagctaaattgctgaggtaatctaaataccactcaataaggaaggctaccagaagatgggcactttcagaattaagaagacctattccaaaatgaagagctttggtaggaatcagcattgtaccatagctcttcaggaagagtggccatggaggatgggctgacagtgtacaccaggacagtattaactttcacatcctcagcagtcttggcagtttctttatagacagtgactaattttaatgtgctgagccaagttttggaagattcctgatttcatctgccttaacattttagacactgtcttctgacttaggataatccttccttttccctcttaaattaaggcatgcaatgggctgtgaataatcagagactagggattgtttcttgacaatactgagttcaatgccatgggatagatacactctgttctgtttgttggtgagtaagaaattagtgtttcatagcataagccaaaagaattccaagctcagccttccctggagtgtattttaggctactgcctccttgtatcgttgatttgctttttaattgaactactttcaatgttattttgataatcaactagaaatgatatagctatactccagaaaactcttgtttgctgtttctcagttcattctttccctccccaggcccctcaaagacattctagtgtcagtcagccaaaaacacaaacatcaaatgtggtttgtgatacttggcagtgacccagacacaacatgcaagtgaaattgaggctcatgtgcttgttttcttgcttcttttcttttttggggggaggaggtggggattttctttattttaaatgataatttattattattattatatatttttgtatcctctgtgattttttttcatagtagttggttatgtctatctatggatggggaagaatatttatggcttaaaggaccatattaattagagatataattctaaggggaattcaattttatctttacctacatagcactgaaaggatttctaagccaaataacctcttttacctaattatttaaaaaatattttaatatagggcttatatgttgagctatttggtgtagctcaggccatgatttatatgtaattgaattttgatttgaagttatccatcttctaaacccacaatcctctctctaactttcttctctggaatgaatacttacatgaaaatatttgattagtttgaaaaccaaaatattgattgaaggcaggaaattaagtcattccagactttagatgaatttgttaaactgtaaaacagattatgttattagatgctgttgtttggttcagtgtagtacattttattagaatactatggagaatgagaataaatgctcagttttatcattagatttattgtgtcttttttatttacccattagctatgcaaagattggcttagcatgaaagtattaaatagtgctgcctctgcaataggcaagaagattaaaaatgtttataagtaattttgttattaataggggatgatttgtttattactttttataagtcaagtaacaccaatatgaaaagttatcatatatactatgttctattcatttaaaaatctggggagaattcaatgtgatgatttttttaattaaaaaaaagtcagcatatcttctgtgaacttaagtgctgaaattgtaaacccaatttgagttctcaagatccaaccactttgaaaatgaaaagcaaatgtgtttctccaaagaatattgaaagcagtggttgtgagctagaatttcatattattattggttggatttttcaagtgtatacaataaagtgctgttttccttctgctcaaacaattaatttactgtgattctgcaaaaataagttatacatttcctcttgttatcaaaggcgatttttaaattgtttgtttaattggactttgtccagcgcattttaaaaaattattcatgtacactgataagagtctgggttgcttactcaggtttctggcagagtcatgctgatcacattccatgggcaggcagagagtcagcgggtaaaagagaaacaatttcatctgcattcttttcctagctctgacatttggggtaagaggctaatgactatgactctgatattgttcattccaaagatgtgtccagttatacacctttacttacgctacttgttatatccaaagatttggcattggtagtaatgtcattgaaagattgtgtttgggtttcagacacaagattaattacctttttattttgtctctttatgttctcagaagagcttagatagtcttgattatgttagaataggccatgtaaagtttgtggcatttttctaggttcaccaaaaaatagatatatgtacttcagtaagcatttatcctttaatgtgtattacataggaacatgcaacttaggaacgtggttagacctcatgatggtcaggggcttgttttattggtctttgttatttcagaccgtggcatattacctgatgtatagtaggtgctccatacatgtttgctgaataagatggtagaagacctaagatcagaacatatgtctttataacttgggaataaatcaccagagaaaagctgaggaaatgaaggaagttaataaatctgatgctgctcattaattgaactcaggtcagagcataataattatctctgctctacaaatgaattgataactgtcaggaaactcaacaaggaagaggaatttacgtgggtgttctgatatggagcttagtgtttaaatggaaggaagcaatcttatacattcaggtagtcaccaggccatagttcccaaacttgctacattcaggacccctttatgctcttaagaattgtcaaggacacccctggagactttgtgtaagcatgtcttgtctattgatatttaccacttttaacagtacaactgaggaaattaaaaatatttgttaattcattttaaaactacattatattttaaatatataacatgtttattttgttttaaaaaagtttattttttctaactaaaaattaaagagtggcattatcttacatctttacaaatctctttaatatctagctcaatagaatacagctggattctcaaatcttcttgggcaatatattgcaatatgttgtgtttttggctaaaatatacaagcagaatccatccttacacagatattttgagtgggataatagagaaatagtttgcctactgcatcagaagtccacagtggcagtttcttaagacttacttgcagtgtggaatatgaaaccctgtcagcaaacttttcatagtctgttacataaaaatacatttatctcgcattcgtaatgatttttttttacctattcctgatttagaaatatcaggcattgatcatttcaaaattattggtgtaactgataaggaatttatcataaaagtctttaatatatgactctcaacctgttggtgatggttagaagttttccaaatttgaatttttactcgaaagctcaaatttcactattagtaacatatattgttgttttcctggaagtgtcaggcttcctttgttcatgataaaaagaaaagattatgcatactcaaatatttaaaaagaaacagttgctctttcgagtaaaaatcgtattccacaaatcaagtggctagttcagcttacaattcaattacacatatgcatttctttgagaaaaccacaatacctaggtacagagtaatgggtctttgtgcacatattgctttgtgtcacacaggatattgaaaagacatcaaagttgagtctagatttgataaaattaatacgttttttgttttctcaagaaaacttatttacctttttaaatgaaatagttttgtttgtttgtttgttttactgtgagtatgtggtggtgaagaacacaattactgctaaagtactttggatctactgctttgatttgtgctaaagtaccaccagttttacccaccattgcttttgcacctctagcataaatgccaacacagtgaacaaaggcagaggatggtttgcattatcatgtaaacagtgttgatttcccaggactccttaaacaggtctctggtttgcatggaggtccatgcatactccacagtgagagaaccattggtgtgggtagtgagattttggcagttcagttaacaaccaggaaaaaaagagccactcgaaataatatattaaaagtatgtttggaatattaggtaaatggactatgattcattaatgattacaaatgagttttagcaatctgataataaattaatttattttcacaagaaactattaagatttccaagagaaatgatggagacatttgtgaggtcagttttggatacaaacgttagaaatgattttctttcacagggttttgaatcacagtagtgcaccttagattaaatgtctgtatatcttgtgtattgaacctcacaagcagaatacaggcaagagagctggatatataataactgttattattataaaatttattgaatattgctatgtttagacataatgataagtgcatagtgataagtgcatttttagggattttatttaacccatacaatactaatatcatttgcattttgtagctatggaaactgagtctcagataagttaataagtcgcttaagttcatatagatagaaagaaaaccatatccagacttgagtaacttcacaatgcatcctcataactactcttctatcaagctggatcagtctgtggttttggttaagagaaaagctctttgccctatagctatgatgatatatgtatgctttttaataactttgttttcactctctgatttgttgcttaaaaagcatttaaggccaggcaaagtggctcacaccttaaatgggaggccaaggcagacaattccttgaggccaggattttgagaccagcctgggcaacatggtaaaaccccatctctactaaaaatacaaaaatttgccgggcatggtggtgcacgcctgtagtcccagctacttgggaggctgagataggagaaccactcaaaccctgggagcagaggctgcagtgagctgagatcatgccattgcactccaggctgggtgacagaattagactttatctcaaaaaaaaattcataagtatttttatgtattgtgtaaaataaagggaaacaatttttgcctaccacagctaaggccctcagcagatcggttacatccctaggcatcattagtggtggtagcaaggagcctaaattgaattaggaagacttccaagggtttctagagcagggaagaagatgagaatttgagagaagggagctgaaggcaaatggagagcaaaggtagatgaggggcctcttctaacctacagcactattcactttggaagcagtcactggagtttaagaaggtggagaattatttttgaatttttaggtgataaatcatcttctttggaataatgatggggttggagtggatggagtgtgaagattattttaaataggaaaacattttactgcttcctatgtgtttgaagtcaagagtgtttctttaaaaaacagcctgggataaattttttgattttgtttcttccctattggtatgtttttaaatgtattgaacaaaatgctgtgaattaaagggctttataaatttttaagatgggtacaaatgtgtatgacaaacaggattattgatggctaattatgttcatgctgcatattttatatatatcttcaggatgcttgatttactcctgctgctagatttctatagacataactcatcttccaatgaatttacaatttattacttttttatctttattaaaaccctaatgattttaattcttttttgttttattcaattttgaggaatctgctctaggaatagttttgaaaaatagttatttacttagaattttgtggaatcaatttttcattgcattgtctgcagcttgcactttgtcatcattagagtgaaaaactgcctaagaacctcattagttgtgagggactgttgcattagtgactgtagcaaactgcataggccctgaggtgggttctgtatttcaagaattaataaatctaggcccagcgctttataaaacccataaaagtaggtggtattccgaattaggcactcgtgagtggaaataggaaaagaataactggcaggtaatgtgggtcaagatgaatataaagtgtccaatatagaatatggtaaatattttctaataatttcaagctttatgtagtctgtgacaaaagtagccattttaatagtatgttgactgagaaggagagtatagggaatgcagacaggtgaaaatattctattaaacaaacattctgtataaaatacacacatgtaattatatattaacacgtatgcccccattgtacaaagactgttggcttttctttgctcttaatatcctgagacaaaattggacaattaagtcatgaagaggaaacaatctaattggcagataatttatatgtggtaattaaacagtgattataggaccacaatcttcttcagtttccagacgtgtatgcatttttaagaaacgatcagtgagtaaaaaccaaagaattttaaggctttgaagaaatgttgaaagacatttagaaacatgctttgctactggcaggtgggagcaagtggcatttttgatgattgttacagattatttgacatttctctaaggctttttatcattcacagattctaacatatataaatcgtttatgttattgttagacactggtaaacagtcttgccaggtgctgtcttgcctttgcaatggttctggaggtagatacaacatatcatcatttgacaaatgagaatactgaggctcatggaggttgcttatggagttggtttatggtggaagcaggatttaaacccagcagtctgcctctgaagtctgtgcatttagttccaacacagcactaactaatgctacttgtaagaatgattatttctatacatttgtagacataattctcaccatgtaaaaagttgttttcatatttctatacttgttcatgttaatgatgaaaaaatataagataaaatgaaattttggtgatgaaccagtagtaggattactttaggtccctatcaatctttgtttaggtccctattaacctttataatctttattaacctataatctgttatttcttcattttgctttctaaatcccaaggcaggaatatatttccattctttcagttgctcatttattttcttccctttgcagcaaaactttttgaaagagttgcctgtacctgcattttttcttctcatgatctcttaaatctactcccatcagacttggcccctgccactccagtgaaattgctcttactgaggccactatgatggacacattgctagatccaatggcctttctcaatgctcattgtagctaatctaaagaatatttgacctagtggattttacttccattaaatgctttattcggttggcttccgagtcatcatattctgtgactttttacccttttttatttcttggaccaatcacttctcagcctcgttcgcaagcatctcaccatgtcctcaaactctaagtgttggaacatccctaaagccagttcttgcagtctttctctttttactctatactcattcccttgaggatctcaatctcatagcattaaatgacatatatacactgatgactccaaaattttgcctccagcccatatgtcttttctgaaccctacattcgtataaccaatcacttattcattgattagcttcctaactgatattttaaattaacatttttaaatctgagctgctgatattctccccaataaaaacatattccatcttcacccatcttcttttcagttgatggcaattccaaccttctgattgatcaggtcaaaaatcttagcgttatctttgactcctaactttctttctcaccctacttacaacctttcagttgatcttgttggctctgtcttcaaaatatttcatttcaatatgatcatttcatgataatttctcatcatgctcactgttagtaacttggtctaagacaccatcattcttcccttggattattgaagacatcttcttgttgatttctgacagtgttcctattgttctcttctcttacttggctttacctacactggcttctttctattctcggaacttgctaggcacacattagccttcgggcttttgccttggctcttccttctgcatagaacaccctttctccagacatcagcctggacaacaacctcccatacttcaagtatttttttttatctcacattgcaaattaggctaaatcttcctttaataacttattattgtaactatcccctcatgctgcctgatttccattgccttgcggcatttcttcatcttcctctcccataaggcttaccagcctccttcaccaatttctacttatctcctcacatgttaaatgttggaatgcccctggaactagttgttgaattttttctctttttaatcaatttcactgaggagctcaaccaatctcattcctttatataaaatatgaacactatatatgtataggggtgggtgtgagtgatataatttattgatttataatgttgattattgtttgatctgtcttcttcccactggaattaatttctacgagggcagatatattgatctgctatgttccttaacatatcttaagagtctagaacattacttggaacaaacatagtagacacaatataagtttctgttgaatgactaagtgaatgaatgaatgaactggcatctcagcctttgtccttgtccccttcagtttagtctagcaaccagagtgagagtgatcttttagatcatttcatttgcccaaaaacttcctatttcacttatagtaaaagtcaaattcttacaatgaccctgaagaccctagttgactgctcttattagttactgtttggacctcttttttcctgattccccttgcctgaacttgttcagcaaccatcagagctccaggccccagcctcaggcgcccctccttagggtctttgtggcagctctggcctggactgctcccttcctcactttccccacatcatttctgagagtcaccttgcaaagtccttcttccctccagttttcgtttttctctttccttccttttgtttctgcttttttcttatcatcacccgacataacacatatgttacttgtttattctgtttatggtgtgccttccctttagaatatatgtttcatgaggggaaagcttttcatctgtttctgctatatgcacagcacctacagtgtggctggctctaggcagatgctcagtaaatcattgataagctaaggatttactgttgataatgctgcaaatatgctgcttaagcttcaggagctcaaccagtgatgcatgctgaagtaggggagtcatttttcatctcttaagccaagactttagagcctcttctgaaattagggaagttaactgattggaaaagactggttttccttcataaaaagatagtggctacatgacttgattggctaagaacgtgtaacccaaacttcagaaacatttatggtgtctgtgaaggaaagtgggaccactaatgctatagatgttttggtaaagtagaacattttagaaaatatatatcacagtgtatgctacaccatctcatgtcttctcatctccttcaaccttatctaattttgctttagagagcagatcttaagttattgttatcgtaaaccatgttgttcatcagaaaacaggtgaatacatagaaactttgaaaacattactacttttaatattgataactttaattactgtcattccttttttctaatttaccatccttgttcaacatttcacatcaataatatcagtaaacttgattttaacacgcagcaaagaaaatactgctggacaatccctcttgccttaagtttagttgaaagaatgcaggcttttgatttaagagaagcttgattcagatgttgtcacagctactctcagaatcttattttcctcatttgtaaaatggtaaggatagcctacttcatagcttcttgtgagaaaaacaatggcactctataaagtttattagtgctcttcccctttttcctcaaaatatagatctgcacaggactattaacatttaagaaaatgtctttctatttttaaagtattttagagttccgttccattctttttttttttttttttcctttctcaatttcctcaacaagcctgtaaggaagtcaagcatttttatgttcattttaaggaaaagacacaaggaatttcattatttctgtgtggtcacaaatctagactagcacccaggtttatatgactttggtcaacatgcctgacattaaacaatactgcccagtctggtgttaatgctatttttcatccactattgtattgttgttgacataatttagtaatagttataaccccttaagtgaagttatttatgaattgtgaaacttttttaaaggtttagttgctcaggaaacaaacaagttagaatatttgaatattcagtgtttgtttcattttcatttgatttaatttgatttgatttcattcagtgttttgtttcattcagagagaagccttatctctgatttagatgagggatattcatctctcaatttttagtgatggtagtaaaatattgactattatggaattgtgtgtgtttgtttgtgagcctatttagaaatcgttttttgtccatgacttaatgcagttttcttaattgaggtcgacttggcttctccagtccaaaaaagggaaaactatctatctttcgaaactactctttaacaaaacatataaattctggtaactttttaagtgaagattttctaactaatgattaaaacgttttcctggacagaaaagtattttcttacttcataaaatattcaaaataagcaaatacacaaagaagatgggctttcttctgctcggggtagtgttttatggtatatacatttttgttctttggttaaaatacttactcttatttttatttatacattggcttcattctacaatagatttgaagcagtttacaaaagtatatatacaacaaagagatacaatatttaaatgaatctctaagtagtaaaaataagtgttactaaaaataatcctgaaatatataagattagcatacagatatatgtaatttaggtaactcattgagtttatgtttagctttctaaaggccaagtcaagcagagaagcaagatcagatatgtaagtcatggtgctcttatactaaacaaacacagggtaaacaaaggaaatacagattttctaaacccaaggaacttaatagaattcgtcccacagatgctcaaaacagacctattttaaagtgatgattttcttaatggcatcttcactagttcaatgacagatttttaacatcattttaatgtgacgtcttttcgtgtggatttgtggcaaattgtaaaagtgcagttctggcaaattatttatttatggatcaaaagagattccccattgataagtgcttttgtttagctttatttcatgaagtggattaatattttataaccaaagcaagaatatccctactgggttttttcacattagcatatctgtagcacatcacaggaaaaatctaactagagaggttttctgtaaaactgtagcttaatccttaaggagactttattttaagctatgctgcagtgattaaaatgcttagcaccaatttctagtaatctgtgtcttagattgtttccatttttcaagaaatagaaacaatcatcctgtgagataacaaaatttgctattgaaaacatcggtgctgtttaaaaatgtcatatattttcaaatattaaaaatataaaagaataactatcacatacactctaacttttcctctggtggagtcactaatatcctaaggctaggaaggtgaggaatcaataccaagtaaaggtcagagctctaggatgggaatgggagtctcaggtttttaattctaggacagtcatttgacacctcattttcaaatgataaactgaaacaatagggtttatgtggcccactcatataacacacttagttggcagaggagtcccagattagaatttcttacttactgagtatagtcaacctatactcagtgttgactccagtccttaaactcggagtgagaaaaggaggctacagcttcctcatgatcttcacatctccatcagcatcctcccaaagacatctcccaaaaacatggaatttaaagtaaaagaaagattttttgttatgcaaatgcggcttcaagatgaagcctttggaccccgattcttgctctttcccacatgccccctcacctcttcccatgcacctgtccccatcccatccatattgttgtccctaaatcccatttgcaaagatcctggatccaccaacagctataacctttcttttttcatgacactgcttctaaatcctttgcacaattctgagaaattgcttcctatcaggtgctaatggcatttaaccttttagggatctcctgtcttcaaattaaaaaataataaaatgtattcaattctattgtcatgttaatttcaaattttttaacaattttgagatgtttgacagtttcaggagatttgcttaaaacaagacatgtatttcatatattactttaataccaaaaccaattgtgattatgtctatctaatggcaaatttgaaacataattcagagttattaaatgttacttgaattgattatattatatggtcatagaattttcctcaccagtagctgtatggcaatcctttaattgcacaaaagttaacccatagtctcttttttttaagatagtactttaaaatttccactaaaaacattaaaataccaattcatgtatagtatagctatgtggaacagaacagcctgtgttgcaacgccagcttaatattttattacttcacataataaaatagggaacgtatttatccactgaggttgtaattagttacaagtaatgaatctttagtgttctaattccagagcctggcagatttagaacaccagttgaccctgtcttgctggaaaatgaaggaagtgggagtagaattttctctgtaggacaagacagctttggatgggagggacaatagaagcttgccaaaaacatgggtcaaactgaacacagatggctgtagctgatagaggtgtctattattgtgttttcttctcagcagttttctctttgtttgtcagtatttttatacttacatgaagaaattttgttgctcagcaaccaagagaaaatatactaatagaatccatttttgttggaaaaaaaatgttggtggtagatgttgatgatggggttgaggtagtgttgtgattgagcagtattaacgtaggagtagaggtgattttctcggagtgctgtttattataagtgtctaaaattaaatatatcacattatccatttactgcttagcttgcctctgtcttacacctccaatactatttgggaaaaaaatggcctaagtaaatgtattccattagttaataatataatttataatacacggaggaaacatttgaagaaataaaactataatttacatattttttataacttcagtgtttcctaaagtcaattttttaagcttcattaaaggatttcatgtgtatttcattttttttttctggaggagttctatttattattcttgagtacatctgttttctgcatggtgaaatattaaaataaatatatatttgaaagtcagaatagttttgttcaaatactggcttaacttttcatgctgtgtgactttaagggagaagccaaacttctctgaaccacagtacctttatctgttaaaaaaagagaattccaatcccttaataagtgttgtgaggaaaatgtgcagtacacatagcactgcatattttcctaaaagactgtttgatttacttttgttgatgctacattcagttatttacttcttgtgtggtccagaaggcaatgataaaaaaatgtaaacaactcctggtcatgtaaatagctactgttcatacaaaaattgtgatgacatttttaatgataccacataaagggaaatcaagaccaatcttacaaattctgtttcttggttttaaggaaattattaaggaactgcattaaaaataactctgtggtaattttcttcattgtactgtatcaggtagaaaaataatttttaaatgagtgactagtgagccgcaagacataaccaagaacagaagggttattagctaacaaagggaagcagatgtaatttttaaacattgattttgcatttatttattttaagtaaactacagaatttttaaattttaatataatgcaaaggtagagtagcattttccaatttatacactatgttttgataagtgtcagatactgaagttatattctaaatataatccacccgcctagggaaacgaataaaaatataacctttgttaaaagatagggtaagtgaattgttaatgactattccagaagtgagacttcagaacatagtttggctctaaaagacctttctttcattttaatattatatttgaaacacttagtaaagataaatttttaaatgttcaatgtctgatcattgtaagcaatgtcattttgtgagctctatttctggaactagaaaaattactttgaaaactgtccattctggttgtgcttttttgagtaagtggtcttagttgtattttaatagaggaaatgaaacaaggtaccactcttttaatgtatttattctgatgttgaggcgatatgttagaacaaatttaattatactatgactatgaaaacaaaattaggcagaactagagtgataggcgggaactcattgttgattttcaacttaaatatcatatacttattaatatatgcattacaaatatatcatttaattatctcaacaactctagaaggtaagtaatggtatttccattttgtagatggagtatcaaggatcatgaaattgtcagtatattgttttgtggtagagcgccatttgagttcatttggttccaaggctttagttctttccagtacacttcactggtcttcaattgttataaatcacagcctgctaatttcacagaaaggagattaaaagcaaaagccataaatataaatacgaagtatttgaatgctgatctatatcataactagatctttcttttttgtttggattatagtgaatttttaaactagaaaatataagcaaacagtatttttgaaggatgtaataaccacactccaaagtacatcaatgaatcatattaaattaaccattaattaatcacattaaaaggaaaagcatacttaggaaacacagaaaatttattttttaagggttgaacttataattaactgaattaaatgagatgttaaattaactttgaaaggcacatttcgatcactgatatacctaaacttgcctcctaattaaatacttaaaaataaatgaatcaacatttgcttttaataatgaccctgagagaaggaaaatatagaatatttaactacaagttaataactaataattagtgtagatttagtagtagaagaaaaggtaagatggagccaatactgtaactacattatatgttaaaacacttatgtaaacacagccagatataattatatggaggttgctttaaggattactgttattacatataaaattttccttacaagagtaggtgaacataaaaagactattgaattcaaatctagggaacttgggaagaaaaataaaactcttttagagagtctatgtaatacatgggaagagtaaggacttttgattcaaacacacttgggtacaatcatgacttggggaagctgtcttccccaagagtatcacagtatcagttgcctcttttgtgaaatctatttcacagagcagctttgagaaacaaaacttaaaaatgcacccatgatactcacccaaaataagtatccattcacttctctctcattttcttcatttgcatagatgctggttttgtcattcatcagacaagattgccaggatataacattgagaactatgtaaatgacactacatcttttcatccctgttcttagatgaagataagtttgagaattttcttggggtgtttcagtagagaattaaacctccttaggatttctggttttgttctgaaatgcaagatggacatggaagcagaagggacattaacctgtttctctgccatttgcctggatgtatatatttacattgctaagatcttggttctgcacactgtcatttagacaataactaaggatttccgaattagaagggataagtgttaactaggaccttgttcttatgttttattgtggataatgtgttggcctttgtactaccttcccatcctcaactatcattccagtattcaatatgcgagctacagtgtttcttactggggatttaaatatgcatagttcaggtcagatacacatatttcaaatatgcatggttcaaaggtaagcagttacctttaacaggatagcttctatttatagcttttatccatgccctcaagagactagcaatctaataggaagacaaacatcacataaactattatcagaaaatctaaaagattgctgtgatgaaaaagtttcaccagctgattacggtaactggtttctgtaatctcaacacaattgagattatttatcctgtctgagcttttggtttttgcatttcataaggctttgtctgcatattttaaactattggaaatgaattttttttaatctatgtgcagaaaaaatatcaggcaaattatacccacctttattcttctgtttttaaaatactgaatatgaaatattacattcctatgtaattaaatagcgtttgatttaaagcatgtggaccttgggcctcatccaagggatactctagtgtaccttggtctgaggctgcttatcagtcctgatgtgctttccctttccttcctgtttgaatacaggtccattctgtgctgttaccatctctgtccttaagagcttcctttgccctaagatgccccgatgtatgtttgtatttgatgacatatttttacatcctggtcaggaaatataattattcatctctctacaacattatcaacattatctccttttttttgagacggagtcttgccctgtcgcccaggctggagtacagtggcacgatcttggctcattacaacctctgcctcccgggttcaagcgattctcctgcctcagcctcccgggttcaagcgattctcctgcctcagcctcccgagtagctgggattacaggctcatgccaccacgcctggctaatttttttgtatttttagtagagacggggtttcaccgtgttagccaggatggtctcgatcttctgacctcgtgatccgcctgcctcggcctcccaaagtgctgggattataggagtgaaccaccgcacccagcctccaacattatttctatggtaatagttattaaacaataatagcatcattattaataattatggaacattaacagcaactacctctaaaacaactaaaactaacatttatttaaaacaaatggctatttatgctattttattcaaacctcaaaataatgctatgaaatagttatcgttgttattaccatttcactgatgagaaaactgaggctcagggaagattagttaactccctttggatcatacaattaggaagacctagagccaagatttcagcctaagcaaaattcatccttagcaatagcacatcctgacctggtcatatataagaatttaatagtagtttctgataaagatatcggtttggaaaatttaaaaaaataatattttattgtacatctataatataattgtatagttaattgtataattgtataattgtatatgtgtatatgagatagacagtttaaaaaatattactttaagtcctttttgaaatgaatcgtgaataaaaatagtttgaatatagaagcaggattttaatcaaatgaatatagaaaatattctttaaaatcactgacagaaaatacaagaatttcagaaaatgaacgttcaacatattttttcaagggctcttattcttttctattttgtggatattcaatataagcaaaattttaaattcaaaaaatatttaattttatatgttgatatattttagtttgattaattctcaaaacttaatgtacatgagactctcttaggtggatatttatttaaaatgcatattacttttcagaagatttcatgaaagttcttgaaacatattttaacaagtccctcaagggattctgatgcaaatgtctcgtagagcacattgtaagaaacaactctttttttttttttgagacggagcctcgctctgtcgcccaggctggagtgcagtggcgtgatctcggctagctgcaagctccgcctcccgggttcacgccattctcctcctgcctcagtctctggagaagctgggactacaggcgcccgccaccacgcccggctaattttttgtgtttttagtagagacggggtttcaccgtgttagccaggatggtctcgatctctttttaataggttaggtcatatataagaatttaattacacatttgcaaatttagaagctcttctctaaagttttccagtttcactagttctttgaagtagtagttgtgtagcagttgcggtggcaatagtagtagcagcagcagtagtagtattagcagtaatagtaacagcatagtaacagtagtagtagtaggataatcaacacatggaacactaagggatagttatcttttctaatgtggttgctactcaaacacattacaagattttggcattagttgacaagctattgcaagcaatcattgagataataaactataacttaagtaaaaatgtacactgtcctgtttattaagtttgtgtaaatgtgttatgtgttgttatgtagctttagaataccttcactgacttttcagcaattacctttaacagaatagtttttatttatttttacatttattatacatttagaaagaagatgagagcaatagttttttattagtataaggcaaacttaactgattaaaccttcttaggaaaagcaatagttctgaaagatatgcaagaaaaaaaatgacaaaagtgaaagaactctagtgtttcaagaacaaggaatggctctatgagctatccctaggaaagcatatttaaaatgaactaaaataaggatcttttgcttagcacagaatgtatgaggtgtttttaaaagaggtggcctgaggcagtggttatatgggaattcatacaaatgttagagatttgttagtttttacattatacttctattaactgtagaattactattagtatagagacctcaagtgtttcttatttctgaagtcttcttagtagtgaaatgatgaggggtatagtaatgtccatttgtaataaaaatgattaatgaaaaatagaattttttattttttaacttttaggattcatcatatgctgaacatctttttaaagttctgactgtattgtgcaatgtcttttaattcatgtgtgttcttccttatctaaaaatcatttacatttacaaataagaatatttttacctgcaccaatcaagatacaattagtagctataaatgtaacattctatatgtaacagaataagaaaacaagagaaaaaaattgtaacttagcataattgaaacatgtgcctagccatctggagcacttctgcataatataaagacatttgacattttaaataaaggattttgaaataaacaagaattcttttgtgtcttccaaagacattgatttattgagactatgtgtggcttttcatcatatacaaaagattaatgatttcctaaaagtccttgcatttcttcattttataaaatgtatacacacagttaagaaaaatgaatccttgaagtcctgtgaagaaaggtgacaggaaatagttcaaagtatttcattttaaataacatcaaatattataaaatataaattttctcaaagtaaaaaaatgagcttggcattattgaatgttggttgaatgataaatgcataagtttatgattatcccaatactatatatgtgatttttatcaaacatattaaagagtactataaaataattttaacttttgatctataaatttctaaaatttcagcacggtgattggtgttgataaatttaaagcatcaaacagatcttgtcttatcaataagaagtagtttaaataaacatttttgaaagtaaaatttttatcaagctcaaataatttcaaagcatagttcaagagattagaaagcttttatggtataaaatatgaaattgatactggttttgttcagaatcccttcattgacttttcagcacttacctttaacaggattgttttatttacatatttttacatttattatacatttagaaagaagatgagagcaatagctttttattagtatatggcaaacttaaactgattaaagcttcagttaaattttgccttatacactcatatttcctgttaaaaatacaatttaaatttagatatgtttacattaaaacactcagcacattataaacttaactattgacttaaaaattttgtagacgtcatcatatatgtttgaattttatttttttattacaataacaatatggtcaagaatgaaacacaattttatattactttatagctaagaatgttaaaatgagataaaaattcaggtgtaaaattttggttcattctttttcactactacttttatttcttagttattgcattaaatcaggattttagagaaatattccatccaatgtacagttcttttgagtaaatattccaatgcaaataaatcaatgcaatatcattttgaaattataaattgggttataattaactatattggctaatattagttttataagtgttttaataactacatagcaaaagttctgcccaattttaatgtaatttagaagctgtgtaaattttaagtaatcatttacgcttttaaaatcatattcatattcatatattttggtttccaaaatagtggtttttataaggcctcaatttttttcccatgtaaattgaggtatgctattgagttctctgaatctgctcttgtccataaagatagcttattctccttcagacagggcggatgatatttccagaagcaagtcagtgtattaacctagttacgttaaaccatatctctgctattttagaaacaatgatgaattaagcagcttcagttcttggggcagcatccagggctagaacccatagcaccaagtccatgggctcctcccacttcacctcctgtgcatgttaccagccatttaatctgttttggcccctaaatcagtcaggaatttccatatgatttacaactccatttgctaagaagaaaaaaaaaatgaagaaacttaaatttcatctcttaatatagttttaatagcacttaataattttatcttagaattttgaacacatttttaaaactctgagttcgagtattgactacctactatgtgaagaactttactgctcaagaatatacgttaaaaatacatattgacccagctctgagagaaaatttgagaatccacactacagaataaaagaaatacagtagaaattgtggaagaggatacaaagtaaattagttaagcatattattaggcaggttgattcgaaagggctttctgaaaaaaagtttgatcttagatttacatgaattgttaaatataaataaaaagagataaagcatgagatatttccaaaagcatatttaatccaggcctgtgcaaaaggagggtgaagaacagtaatgaattggtctctggatcatgttgtgttctaatagatgatttgataaagacttggtatgggatgtgagttagaggaattgagcaggaggagtgtattaggagagagagcctttattgctaggttaagtaatttacatttttgaagttgtgggaacatcttataactcaattactagaatgcaaaaagttgctgatgaatgttgagcaatgctgtaagttttccaaagcatatccaagagagattgcatttggatttcgaataagattatctcctttatacatctattcttttaatgtattctactatattctactcttgattccccttttctgtggtgtatggatttcccaactaccttgaagaattgagaagcaaatttattaggtgaattattccaatttcctagtaattaaacagcatgaacatagttagtctaggaggcctggtgttattttaattcacttttccttgtgagtttactgaagtggagattatccattacagccagaggctttaacgaccagaaaattcttcagcataccttaaacaccaattccccatgttgaaatacttaatcaccactcttgcttctttgggtgctgaaaagaagtttgatcttagattacctgaattgctaaatataaataaaaagagagaaaacgagatattttcataaccaaatagtatctgtgatgccaatgggcgttattctgctttcctatgtggaagattccttctcatcattcactgttttggtcaagaacaccctgatgaaaaaaatctttggttgccttccaggtagagttagtctcttctaagttccaccatttttattcacaccataattgtaatgcttaccccattgataaattacttgcatttctaactgtcccccctgccccccaccaccatgactatgatctctttgtgcctggtgtatttctcactcatccctgggtcctccatgtcttacagtggtgcctggcacatggcaataatcaataaatgccaagagaatgaatacattgaaatgaatttgtgaatggatgagttttgctttctttggtactgtagtgattgttatttgcagattatttctgtcttttacctaatttagaaggtccatgtgtaatttggtcatggtttgaactgctagtaaaaacaaaggtcatcctttatttaaattcccacagtagctgctgcttccatttacacattgtagatggtcaacgattgtttaaaattggtgagcagatgaatatccaggtgcttcctggaggaaaagtgaatggagcagatcatcctccaacttaatcactgcaatgtaatttttcatatgggaatagaacagcgaaaatattctctgcaaacgaaaaatattggacaattaaggtgctaagattgccttttttgtgtttttggtttggggtctctgtttgaaatgacactagtgagcttcaggtttctttccttgttaacttttgctgaaggccaaagaggaatgattaaggacttctaaagaagtattgaaaaaaaaaacacacaaaaagtggtgacaaaaatacttattattttcctttaatttttttctgcaattttgttgatgttgttattactaccatttaaatatagttaatattaatgattacttttagtagcatttaaggattttcatctttcaaattactactctggcatgtattatttatgcactttgaattgctttgcatgttgaaattttcttttggcctctaattcaattagaatgcccttagagttttgaaggttgcagtttatataacttaccttattagctataaatggaatacagatttacccttaaaatgatctagttgtctatattttaatcacatatatacatgtagtgctataaatgttaaccaggtagatttttcccagctgcctagccaaagagaacggtattagtgtcacagttcagttgagctgttgttatctgtatgagatcaatcttttggagaaggcagtgaaggttttcttatttaatttgctttcagcaagtcctccccctctttttttttatatataattttaagtactgctcttagtgggtcattagactttgagaattattcactttgttagcccaaacactaaaaccttgtgtcttttaactctgattagtgacactttaataaagtcatttgaagttcagtggactgaattttccaacttttctgatgtttctatggtcacggtagagcaacctgtattgaagcttgtacacaaacttttaaatgcaaatcttggaaagctgtgtgtaattttgtatatctgacttcaacagggactgcaaaatgtgagggattaaaaataaaagcggtagcagtgttttccttctttttgtttttcaagttggggtacagtaagctttgggaaatagagaagttgtcacttgactaaacttgattctctgagaaaaaaaaacttgcagattaaaacttttatggctatactttttttttgacaaaccaatgagcacaaaacctcattttcttccacatgattagacaataagggtaatgcaaactattgaatcataaatttcttagagatagagccttgaatttttttttgaaaaagtaaagaaaaagtatattcaatggctataattaaatcatgcacggtgaacccactttggaggaattacttcattttgtattgcattgcgacttgagtgaacatttacaacacgtgagaatggaaaggatgaaaaattatggttgtctttcggttcacaagaattcaaggaggcaggtcattgagttaattttcatgggaagactaactctggcctgctcgcatattcagaggccaaacaacctggtattgacagcctcaatttgggaggggaacatgcagcagcattgtgccatggtttgttgaggaaaaacaagggaagatttaaaacaaagctgtgaataggaacagtagcccttgtgtcttgaagctgattgacttttcctttttagacctttgtgaaagtgttaccctctcctttaaataagggctatactgtggtaagagaaatatttaagatataattcagtgactctaggaatgggagcatttacacttcttgaaagaaatcaggtgagagctattaattgcaaatgccatatgaaagcatcagcctgagcggtaggctcagtgctaggcaaggcatatataagaatactaatactaataggcattttttccaaaccatagatatatattaccaatcatatgttataaattatatattatcataatatataatatatggcatatattatgtctatgtatttcaatcatataacctatttacatattttatatacagaaacatacacatgtagataaaaagaccaatcaattaatggtactaacaaaagaaagaagataagaaaaatctgtatagtcatatttacagatatttttagaagtaaaaataaatgtcaacagtacatccagtggaaaaatagttttctagaactgcccttctttttccagtacctcttcagtttattgacctttgaagagatggctgctaacacttaactaccaacatttgtttaaaaaagaaaaattagtttgtacttttgaatatatatttgatatataatttgaatattgtatttaaaatataaagcataaatataaatcataaataaaaattactaataaattacaatttgtaagtgtgctcactgtgttatatttccatttggatttgaatccacttatcagactacaatagaaattacatttatttttaaaaattaatacagattacataaaatactaagatgatttcagtacatacttactaaaattttaagaagacccaagactttatagtaggacctctgagttatatgtctgaaaattaattgacttttggatttgaatatattactaattcacttagccagtttaattggatttatcagttgttaagagttagcagtttatcataataatcatattgatgcttaataccctctgcatctattatttgggatgtctggagttgaaaaactccagacacaatttaaatgaactagaaaaaatcataaggtttaggatcagaaggcccagagttcaaatttcacatcactcagtccctgaactagctcatgatgctgtaaaagttgcacaatatttctgaacctcgatttctttatccataaaacaatgatgttaatatttacattgtttagttattgtgtgtcctaattagttaatgtaccaaaacacctaacattgtagtttctatacgaagcatatttaaggaaataatgtttatcacataaattggaacgtattcttttatatataaaatgcccaattaatatacaactttagagttcagagaacacaacaaaatagtagggtgcccacatctgcaatatgaagaacaatgaagttttttatgtagggtgtaaacttcagaaagttgaaggatcctttctgatctcatgtgtcctgctcatcagtgtatccccagcgctgatcctgatgcctgatacctagagagcaatcaataattaatgctatattgaggaagtgaaccaacacccaggattagagtggagaaaactaatttttctccactctaggtatgaccactcaaggtagtacactagagtagttcttctttttttaatatgaatacacaaattaataatcctggaaaatatgttcagattaagtaaatagtcaaacttggagcaattatccaagacagccatataaggctgtctgcatggataatagccataataatgttgataattctatgtttaattgtgatcgaagccgacatctttttcctaaaagggtgtgctgagtttattatgaaattaaatttaggataatttatattttagtgatcacatcttagagaaaactgcaggcatattttatgatgctaaggttggagaaatctaagagttctctatagttaatttcctgaaaatagaagttagttttcaaaagtccaaacaaatcaggaagattagaaactaaaataaattgtcatataagaaataatgaatctatgcattggggatgttgcatttagttttcgttaccacgattaggaaagattctgaaaaaggattaaattatccagaggggtttagaagagtatactaaaaatatgaaaattaggactcttaagtctatggaagaaaatataaaaggcatttttgttgaagtttattaaatgatgtaaattattactgaaactgcatttgttttgaattttccagtatattaaaacaatggctaacaattatagttgagagaaatatatttaggaaaagtaatgcattattcagcattctattatctatactatattaacacatgtgttatgggctgaaattacaccagtatcacatgagggtaaatgggttgaaagtgtaagtttaaaagagtttcaaatgagtttgtgaatggatatcatacccttccacaaatgacagagatggactattaaatcagagttggtagtttttgcttttgtttactgtgtttctcattcaccctaaatggtcctatctataacaagctttggaaaagcaccatgcacctgaaattcttgcattctgatgttcatacctagagagatttatggtgacataagcagccaaatagcacaagtgaaattttatatgaagtatatgacatgcatgattcaatatatatgcccacttttaaatataccaatagtatatttggactataataatgaattcatttcaaatattgtcattttgcttgacattcgtatcatcacataagctagattcccgttatataaagatgcacaaaggctcatttcagaaataaaaacaaataactgttattattttttacaaaggtgaaggacaataaaaattgactaaaatcctgaaaaaacaattcagagtgcttcagttgggccctaaactcaatgcgcaatcttgacacatatattgagttataattatttactacattatatttattttgtaactgtcgtcagttttttatgtatggatctattaatttcaatgaaatttggatccagtaaatttctatacaatggagtttggttatttggcacttcataaaaatgtacctttcacataatgaatgaataatttatattatgatttctcttgtgtaggacagttcttgcaggaatacaaagtaatggtaaattttgatttaaagtgcagcaattcatgcactttagagccagttggatgccaaagtaacttggttggtgtttatttctagttacagtcagtgttttctttctttctaccaatgagatgagatatttgaaggctttttttcttcttaggccatatcaattcaaagaaaatgagaaaccatagattttgggttggccttacaatgtgctgtcatttcatctttccaaatataaaaatcaaaacttcatcctacttcacttaatcttttcaaagctgtgttccttaatgctgatttttttaaatcaatttcaatgacttcgtttcttgtatacagcagaaagaatccagtttggtctttgtaaggagtgaaagactaggaaggaagtatgtgttgtatagtcagtgcttcagagttggtagattttgcttttgtttactgagtttctcattcagtccgaatgttcctatctataacaagctttggagaagcacctttgtccccagagctggcctccaggaaggcttggatccttacaagtttggaaaaatggttactggcggtcatccataggaaaacagagcaagtttacaaagttcctgctgatttccttgaaagtactccctcctcattctctacagtaagccattgaatgttactagggatggacactaagcagaaagatttctgagtatctattcatcttccccaatcagacagtcctttaaatttaaagaagaatgcctgacccttaagacagggaggttcatcatatttcccattctgacagtttggaatgaaaggacacataaattattattattattattgaattagaggtatgggtatgatgactgaggtttctcagcagaagatttctgattccatgctttgcatcattagacagccaacagaagctgcacttagtggccgcgtgatgtgattgattggttagattggaataaaacttttttgttgttttttaaatccaatattactttatttttatttaattaacttacattcaaatgcaattgatcatatgattttctaattttaggattaaaatatatatgaagataagtttggtgccaccaatttgaaattaaatgtacagataaaacaatagaacaattactgatacaggccatcactgatacagtaactactttagaatgcatcataaatttcattttcatatggatttggtaaatgtgcttttagttacagaattgttagtcataaatcaactagcaaaacagaatttcaaatttttgagaaaccatgaaccatgtgatgcatgttattttgttatcctctgctgtctcttaagaaattatttttttctagtcacattatttgtatcagcctgtctgcaaaactgagtctgtgcatttctctctgtcttcacaataaattcagttccattgtatgtgcaagagttcttgttcataccataagctttttagctgtttcatgatagcttagttttgttaatatatagaaccaaactcccatatgaagtgaggaaataaatgtgtaatgagtaagaaggcagaattttgttttgatttttcaaaacttgttactgaaagtcagaaatgtttgtacacatgttctcctgattatgatcagtgattaaacttttgtattaagaactcttcctaccagaaatactcatcctaagaaagatgaattcttcagaattttcccatttattactaaattctagacacttccaactcagaacaaacttggttttgaggaataccaagtaggcacaggatttaaggcagaaattcagctaattccagaacggttgatgctacctgttgaagcattttatagtggaatttcaataaacagtagatatattatgccctttgatttattgtagtataacttttattttccccaacaaatcctttttttaaaaagggatttaggttgtttcaagtatatactaatttaattgtcatgatttgtctagcttatagaatactacttatgaagactattatacattgaagttctgtgcttaaatagaatatagctctaagtaattacgttagtggtaattaaaatattctggaaacattttttggtcacctggtgctgtgattttcaaactagagctgaaaaaaacctcaagggccagggaaaactttgtcactagtacttctcaccctcttcaccatttcaatcagtatagctccaagtgtaacagctttaaatgatttcttccatgtaacattagttatttttaatataataatttattgttctcaaaaaaatgtttacacagaataggtaatcactaaatgttttgtctgaaaatgcactagcatgcaggccaccaacatatttgggaaatacatctcctgtgcttgactgttcctcttttaagtaaaaacttctttttccattgttactttttaagcctattgatcagtgttttctgcacttcatttgtgtacatcacaatgaggacatttaaaaaatgggcttccctaatttcagagacaagttcttcagattgcttccccatatgtgcaatactttcctctctgagagctgccagtcttctttgtagggctagcacgcatacattgcccttttctgaaatgaaactagggctttcttctgcttcttcagcatattgcagccttggctttaaaagaaaaaatgccagagtcaactgtataagccataagactacactgaattctactggatgcagtgatgtattaaaaaaatgatttatttccatattgctgtttcctcagcagaatgccttggacataataggaccttgatgaatgtgtttttaattcctggttagccctcttctgtatggaaatcttaaaaatattatttcactctaatttgaagatattgtcaaatctttgtgaaattttagcagattgtaaattttagaaagatccaaaggaaacattgttaatactaataaagattttatgtgaccaaaatcggatcttatttttcaagaaatactcagttctatagaaagtttggccttcagtcagaatgacttcttcattcaatcagttttataataatttgaaaatgaaaaccagccagcatttactgatgatagtttacagaagtttcaccaaaacattacttcatcacaaacaaagaaactattcattgcctgttaggcatcatctcaacatctgtccactattggcttgtccatttttatattgttttagaatatgatataaataattttttattattttctctttagtttaaaattgtactgtgccccaaattggtattggctcagaaatgagatgaatatgttttaaagtaagtccttttcataatatgtttagtattctttgtcaatcttttagttggcttagagcttgatattatctttaaaaacagaaattaatacttgtcattagagtaaaacagtgctgtagcagagctcacggttacattgataaactatacatacatatatgtattatatatttatcttaagtagaaactatcagtgctggtattgttgtaagggagatctgtggtttctataatatgacttatatgcatacatactttattaaaagtgaacatttgttacattttaatcgttagagtaaaatatttagtgactgaaaaattccaaatgaagactaagtaaaatatgttttggttgaattgtgaagtttgagaatttgcaaagccataatgatagaatcaacccaaaggtcccagaaattttcaataatctatcatccttatttaaaattattatacaataaaaaattgtgttttaatcgcatgagtagacagatgtttatgctgttattcagcgaatcttgcaaaagtgagtgtaattcatagaataaaacaatgttggaaatatgctttcttaaaggcaataaaagttgaagtctatgtatcaaagacaaaggtgggaaattgtattgcattttataatattttggaaaaattctgtaaactgctattactaagattattttataagattttaccccagattttcataggtaataaatgggcaaataacttatcgttttccctagtcagatcgctggtgttaaattaatataaagttttaatataagggatttttattaataaagtattttggtaacactcaacatgtactttatttgcttttggatatgtttttgattcaaatatagaaaagaataactaagatactttggtgttatatatggatatagtcaacttagaaaattatacacattgaatctttttattgtgcttactcaaaaatgaattggtttcatttctttgctgatggaatattgaacacgctctcactctgatgtacagttatagtgtatactaggtaagaaaagagagtcccaggccaatttaaacaatgatagggtttgcttttctgaattctgagaagctagttcaggggaagaaatgaaaccacagtgtagagggtcgaatggtgaaggtgaaaaattagtatcaagcctcagttcaacaggaaaatgtgtgtggaaatggaagaatgaaggtaatattggtagatgggagaatagtaaacaagcctttcagagtttaatgaaaaaaaaaaaaaaaactggttagaacagttgggtaagaaggaaaataaatctaaagtttagtttttaacttgatcagagtcctggatcaaacagtggacctcaaaggaactgttcaaagcagtactcctagtatggtttctgagactttctgaattttaagattcagaaacgtgggaggaagtcatactagcttagcttcaactgcacatttatattatgacagtttttcctgttatccacatattttttaaatttagacatgaatatagagaaatttagtatagcctctacttattaaaatgttagtactttacttttaccaaataattccctgcatatcatcaaaaatttatatttttagccaatttaattttagagaaccttcatatgaggtattgacaccggatagaaaattaaaggaattttaaaatatatatttctttccaagaaaatgatttatacattcatgtaataatttgtattaccctaaaacatatttacatctctaaagtaaaattagtttctaaggtggatatgagagttggctagttataacagaaaatttggatatcctccacatattttaatgtaacaaaaaaacaaattcttttgatccatctcattacagaatgtgttccagatataattccaaatgcatgtaggtaaatggaaagaaaaattggatcctggagttgtactgatctgatggaaataatattacgaacttggtttgagtgtcagctctttttactagctttgtgcccttggtcaagttacttgatttttgttaacttacgctttcttatctgtgaatgaggaaacacctatgtttggggttttgtaaagattagagaatgtaatttatgcatggtacacatgccttttatgatacaggtaaaatatttcacatcttcatctcatttgtttctggtgatgtagaggtggtaggtcaatctttttttcttttttttcctccaataatcagtggactcaattgaattggagaaggggttgcttggtggaagagaaaaaacatatggcactgatgatgatgatgatgacaaagttgatttgcaattttttaacagattatctttctatagggccagaagccatattgtctcttccttccccagatattcttacattagaggattttttctatcacagttgcaccccttgattgacatagcaatatcctataagtagcagccctgctgtttggatcatgttttttttctgtcggcagtgtatcacaagtattttcctcagtggcctaaacagaccctgagtggaaggctggtaaaagcaacctcgtctgcatgcatcactttgaatgatttcaaagaggaaagaagcagctgtgacaatgttcacatgaaccactcagagtggccttatctttgtagtctaacaataatagtacaccctggctgcattcctctgcttgagaagagcaaagttgcctaagagccatccatacatttgtattccttgacatgtcttaaagttggatgtatgataaagctaatgacatctttacatccctgagtaatttgtcttgaaagtaaatgtagagaaatgctctttatggatttattgcatgtgtggtcaatatttattttatgcagatatatgaactaatatgtaacagattgttatttacaaaagaaatttgaagttttatttatttgactagctaaagaaatataaaaagaagttttctacatatgcagatcattatagaaataatattcttctctaaatttgtagatatagggtgttttgttttttgttttttttttttttttgccatttataggttacaagctatgtttaggtatttcagagtgccccatatatgagttattttaaaaagtgacaatattacaggtgacaagactaatataagtagaatatagttgagttacagaatatgttgtaatagtctttacaatgcacatccaatgaacatcatatagacagatattaatatcaatatatctacacataattgatatatagtatatattataataaatataagatatgataatataacagataatataatagaaatcatagatatctgtatatcaatagatacagactataagtcaatggcgggatactgcacattgcattaaatctccactagttctttgttgaacattcatgaatctaaaaatgtaaaaattaagtcccctgagggagtaactatgtctttgcatgccttctattttaatatctcagtatagctcccccaacacttcccattatgtgcttttatacaaagcaaccagtaataatgctgaatgaataaaagtgaacatagcatataatgtattccatatgtataaaacaatattcacatgaatgaaattgatccatcagtgtgttcaactatgagtctgtgtttctgagtacctgtaaacaaaaagaagcgttgaaaccttttagggagttatgagaaataatagagtaaaatgataaatacatttttactgaataaatatacctgaatgagttattccagttttttcatgaatttaggcaaatgtacagtctctcgattgataataaaatttgtcattttctcagttaaattgatacagattcttgtagagcaaaaagacctaaagataagatttgggatagatttataccttaacccaggtaataaatagattattcgggtactttaatagtaacaaaggaatcaaatggaattttaattgaaatgattttactaatatggtcattagcattaagtaaatgagatacatttgccatttcagctgtatttgttaacattagattttcatacaaatacaagagatgttattttaactgctcattcttatggattttactgctttcactaaagagaaacaaaatattttatctcctcattgcaatttaggcttagggagtaacaactaagcatatacattgttgaacactgctggcatgtgctttgtgaatatgtttgaatcaagggcctttacaaagggctcagaccttcctcctagggggttgtcatttaccgtggatgctctcgtttgttgtggtaaacagcctcagaaaacgtcttgacattgtcaattccaacagattaatgaagtaactgggccatacatcccttcccctttacatatgaaaggaaaagctaactacttcatagagctgtaagattgtttccttttaccccttggtattagtttcctttgtagtcagttaagtatggttcttttaagtaagccagaccagaattcttttaagtaagccagcttgggcgggggaactccagtgtgattataagtgagtatataggaaaaaaagaaatgaaattaacctttttttctttagaaatcttgtgtttaattttatgttccagtgttttaaataactgaaaccttattatggacaaatttacctgttatgttaggagaaatgagtttcatttaccatcttcatcagcgatccccaacctttttggcaccagggaccggtttcatggaagacaatttttccatggacccaggtggagggatagtttcaggatgattcaagtgcattacatttatcgtgcactttatttctattattattatattgtaatatctaatgaaatagttatacaactcatcataatgcagaattagtgggagtcctgaactcgttttcctgcaactagatgttcccatctgggtataaagggatacagtgacagatcatcaccattggattctcataaggagcgtgcaacttagatccctcacatgcgcacttcacaatagggtttgtgctcctatgagaatctaatgctgtggctgatctgacaggaggcagagctcaggtgataaagtgagtgatgggaagatgggaagcggctataaatagagatgaagcttcactcccttgctcactgctcaccgctcacctcctgctgtgtggcccagttcatatcaggccggtttcctatcaggtaatggtctgtggcccaggggttggggaccccttatctacatccacgttttctatgtttgtgaagatttgatgtggggttatgggtttgaggagctaaaaattatagttagtagaaggaaagacagctagaagtggaaagtaaaatcacttacattgtacttttactaggacctatattgtaggtattataaatcatacaaacaagtttgttatacaaaacatgattaccttatcattgttttattaagtatttaattgtgcatgagtaatcattgccattattgatttgtccatattaaacttatgatcagacttagtggacaaattttcaacaaataatagaagcagcagcataaatatctatatagaattagccaggttctagtctggcacatcatcacatagtagcacatttaatgcccccaattattctatgatatagatactactagtttccccattttcctaatgagaaaagtgagtcatagtcaggtggagataattcaccccacgtcttaaggccaaatggaaaaaatcttcttactctggaattaggtggttaagtatcttgattttaatggatgttgttgttttcctaataattgagttatttgtattaaaatgctaaactggcaatatatgccgatggccaatttacctccaaatatattgagttcatacatattcattaagtgggatattttggagaatatactgcttatatgttcaaatgcaaataatttaattcgctgtgatttataatactgttactcagtaaatggactaaaggcagggtaagatttatcagtcttaaaaatgtaactatgagatcattataatcctattatcttctaattatccttttaaatcaaaaacatactttcatgttggtatgagtatcataaccaaaagagaagagaaacttcaaagagaaaactgaattagtggagagtaacttaatttcagaagaaaatcgtactttcatataaattcatagtgaaaggtaactatgtgataccagcattcagggaacaaatgcccttacgtttttgcctgtgtgtttgtggggagggaggttgtttcattttgtttttatttcttgcctgtttaaatttcttttactcacaggctccagcctggatctctgggagggagaagtagttccaaagattacagtgcttaatcttaactctgaaaacactacttattgactctccactggattccactcgcccaaattccctagatggattttccctcaggatgaaacaacctaaattcaagtgtcctaaactgtcttcctctccctcctgccattgcctttccttgtttctctagtctaatccatcttatcttttgttcttttctgttaatctattaatcaggtctctgacattctaaaagctctcatgccccttcgcaatatttcctcctttacgcattgctagcaccagcacttccactactccaggaattaacacctctttctctctttcctcaatggctaagagatctggagtcatcatgtctgggttcatattccactttcccaatttactgacttcgtgaccttaccaagtcagttaacttcattaaattttcatttcttcattttcaaaacattttcatcacgtttcccacacaggcttgtaaggaggacacaattatgtcatgaatataaagttcttagcggggagtttggcacatagatcacagattagccgttcttattattgctccctcggtagagtcccactgtgaagtcattatttctcacataactcactaattcaggaactctttaatcaaacctattatgtctaaggacctgagtaaacagttactgttctcaaggaactcactgtctagaagaagaagaggctgaccagcaaagccataattacaataaacctatgctatttgtactgaacaataatacatatgcacttaattgtagtcatccccctgactatactcacaaaacttaacatgtctttaggggaggaggatggattgcagatatgctattagaggcatagccatctttacttcattaaaagtttagtttactaaaatttgcaaatgtttaaaatatggtcttgcttaatttcacaaattctgggataaatatttaaggatttaatatttattaaattttttatttatttattatttattttatttatttattttattatttttattttattttatttatatttttattattatttattttatttatttattatttataaatatttattaaatatttattaaatgagtgcactgatgtgtattgtttcaaatacattttattaaatttagtgtcaaattgctagctactgtatggctaaatattacatttttccccagtggggcaaagttcaattcaattagctgcaatgaatatgtattagatctcaattctctcctgtgataagtgttggagggaattcagaaataataaaaatatatctctgttctttgggatttcagtctattattaactaagcatctggagcagttacacctatgaaacagtttggtatggcatgacagtgaaagcagtaacaaggtacaaggggaataaaaagaatgagatccatcaaattgttaatccggaaggcacagggagtgagatggcatgtgacagtcaatggttagtgatggggtagaggcccatatgctcatgagagatttgagaaatataaagtcattgtctttgtttaaaaggatggtgtgcaggtggtaaatactgagaggtgatctgacaagtgttcattcaaactctgcaaccttgattgagactgtgctagatgatataaaaatacatatgccctaacagggaggataggcaaccaaacaattaattttaaaattgtgaatttacaaactgtgggttattatatgctacagaagccacacagagaaagagttatttgctctgtttcagaaaatagaatagaggagatgtgggaaggcaagatagtccttatagaaaagtggtcgttttattacctgcaaccgttctgacccgcttgtcattctatgtcttcctacgtcagtcatgagctctatttgttctcatgtgcaaatcccagcctcactaggatgcactccagttatccattaagcacggagattcccatgagcaatgggacaaaatgactattggacttctatctcaactgcttgtgtagaatgttgccttgtttattttaagtcccagattctattattttccctactaaccatgggtagactctggatcagacttctcattgaaagacctttgaaatttgcttatactcaattgccatttcagtcccctctctcactagatgttcttgactgctgtaccactcttcagattcatgatgtgctgataatacaatgtttccttgcattgttattttgttatatttacccttatattatcatggtttttgattaaaagcgtatgtgtgtgtttacacataaacatttttttttcctttctcaactttttagggatatgcagactatatatttcttttcaagagggcaagactgtaaatagattgagggcaagcatcatgttctgtccagtgtaagagaacattctgagaacctagccggacatcaggtatacattgaaagatattagttgaaattataggtagagctgtcatgatgacatgagtaggtaatattttgagaagtttggtggtatgatattagaagagaaatgattcttctcttctgatgcagggaaaaagattcccaaaatctgcaagcgaagaattgggtagaggaattattcagtttaggatctggtctagagatatacagatttacatttactgtttggccttttttacatggttgaataccatatgaattttaaatattagtaaaatatccaaaattacttttgatagaggaaaatgtattgcactatatattcttctttgaatagagaactttgtcaagtaagagaataaaaaatacaggatgatttctattaaacatacagtattcaaaagctatgtgagggaatccagctagtgtgattatgtcaaaagggaagatagctggtctgaaggtaatgagttatctcaactgattggtcatggccaattacagacagaactccttattttacttccccaccccccgactactgcacttgactagtcaaaaaataaaacaaacaccaaaaccaaactaaagggaagacagtcttttcctagcttggcattagttggatggtttatataaatgtgaaacttttagaactcatttgaaaaaaaaaatttagtaaagcaaaaagaagtttttcaaatagttaaaaaatttaaaagactgaaattatcaaatcatttttcacaacaataaaaattgtatacaaggcaaactatgtacatatatgtgggtgtccttaggaataaatgcataatttcaaagacatggaatttgtaagtgttagtcatgttctcacctgtaataaagcaatgtgttaatgaaattgggtgcttatatatatttatatataatttcttagtttgagagaagcaaatagaagtgaatatatgtagccactttttaatatttgtattcagctataattcctcctgatttgctcctcgttttagagtgatgtactgggaatggaatcctaaaattaaacttattttagattaaatcataccatgttagtttaattttttttattttttcaattctatatcaatatagcttttttttaatttatatatatatttttttgagaaagaatcttgctgtattgccagcctggagtgcagtggtatgatctcggctcactaaaacctccgcctcctgggttcaagcgattcccctgcctcagcctcccaagtagctgggacaacaggcgcatgccaccactcctggctaattttttgtattttagtagagacggggtttcactatgttggccaggatgggctcgatctcctgacctcatgatccgtccaccttggcctctcaaagtactgggattgcaggtgtgagccaccgtgcctggcctgtagcttattttttaaaactagatttgattttggaattgcaacgattatggattattatattcactacttattatctcatcactgtttagtttgcagaaaggcttacttaatatttcatttatatgttcccctattgatagttcctggaaaacttttaatgctggccattaatttaacatatatttgcttagagtctactgtgcattacaatcattctagatttcaaggatgcaaaagtgagcagaaacagttgtccgttgttgatggactgatggaggttcttgaaacttgcttattttttgcttacttttgtggatgttcctattccttctctctctctctctctctttctctcttctctccaccccatgtgtgccctcactctagcttcccctctttcatcctccctcttgctacaaattaaatgtagtttttttcaaataccttttcttggacttttttctctctatagtgattcttgtagtaatcttatagcatcatctgtcacatttatgttgatctctttttacttctgtctcttcttcagcatcacaatctgtttatgtgctggacctagaaatttagccccccgtgaatttcaacttcaccctgtctattaagaaagccagttattaataacgtattttaataaattatgataagcatatgataaggagaaagaataggggactttcagaatatattagaagggaacccaaactagactgtggatcaccagaggagtcactaaaggagtctcggtggaagtgatatttaaactgcgatacgaaggatcgcttgaattaactaggccatcttcagtggtcaggagtcagttttctgagcagaaagagtagtatgcataaatgccatgagctggaaacgcatacaactctgtataactgaaggaagtgaggttttttcagctggtgcatggagtgctgaaaggaaactgagaagagaccctggaaggtcagcttgggtgtgagagtgaagagcacccaaagtaagactaaaagtttggtagttctcataccaaaatgagaagccatcaagagtttttatcaaattattgactttatcttatttgtgtttcataaaaagctttctggctacatgaaaagaaaacagttagaggttgggggcattgcggatttagaaattgagcatggagaacttggggccctggactaacagttgatagtagagttggaggtacatgcattgagtggagatgtgttgaagatgtggtcctggtatttcttgatgacgaattgaatgtagatgtggaagatgatggaagaaccaaggaagatggcttagtttctgccttgagcaactaagtggatgatgagttagggaataccggatgaggagtcataacaagaagacaataaattagttcaggaccttgttaaatgtgaggtcactctgagataccagtggaaatatccagcaggcagatggatatgtgaactggagcacaacagagaagtctagattaaaatttgcatttggagtgtagtatccatgaaagtagccacgagcttggatatgttgtccaaaagaatgtggactctcttctcatcattcaagctgaaaacctcaactttattccttgactcctctttctctttttttcttgcttcctatatgtaaataaatggtgaagtcttatcagttttgctctctattgtctttcctattcataccaccatttctgtttccaatagtctaattaggttcttgttatttctgacgagagagctattatatacttgaggatagcaagactggttgccaggagattcatagactattgcagtaagctggagagttatgactgctgtttaaacaagatcattagctgtaggaaaagaggaaagtatatttaagaaataaagtatatgataaagtaatagaaaatgaatatttgactaaaactagtatgggaaacagaaacgccttgaatataactaaattagaattatcctcctttatagatttaacttttattttaagttcagagctaaatgtacaggttcgttatataggtcaggagttcccaaccccggggccactgaccagtacgggtctgtggtctgttaggaaccgggacgcacagcaggaggtgagcggcaggctaacgagcattaccacctgagctctgccttctgtcagatcagcccctgctttggattctcgtgggagcgtgaaccctattgtgaagtgagcatgtgagagatctagattgcgtgcccttatgagacctgccccaccctgctctgtggaacaattgtcttccacaaaactggtccctggtgccaaaaaggttggggactgctgatataggtaaacttctgtcatggggtttgttgtacagattatttcatcacccaggtattaattaaggctagtacccattagttatttttcctgatgctctccctcctcccatcctctgccctctaatagaccccagtatgtgttgttcccttctatgtgtttatatgttctcctcatttagctcccacttattagtaagaacatggaatatttggttttctgttcccaggttagttgggtaaggaaatggtctccagctccatccatgttcctgcaaaggacatgatcttgttcttttaatggctgcgtagtattccatggtgtgtatgtactatatatatatttttaatctggtctaccattgatgggtatttgggttgattccacgtctttgccattgtgaatagtgttgcaatgaacataacatgtgcatctttacaatagaatgatgcatattcctttgggtatatacccagtaatgggattgctgggttgaatggtatttctgttttaggtcttggaagaattgccacactgtctttcacaatggttgaactaatttacagtcccacctacggtgtacacatgttattttttctctgaaagcttgccagcatctgttatttttttgactttttagtaatagccattctgcttgtatgagatggtatctcattgtggttttgacttgcatttctctaatgatcagtgatattgagctttttgtcatatgcttgttggccatatgtatgtcttttttttgaaaagtgtctgttcatgtcctttgcccactttttaatggtatttgttatttttatgtgtaaatgtgtttaagttccttgtagatgctggatattagacctttgtcagatgcatagtttgcaaattttttttgcattctgtaggatgtttgttcactctgttgatagtttcttttgccatacagaagcttttctttagtttagttagaatataaataaaccagaagtttcccttttaattttagcatcgcaaatatgcatcaaatgttatcaatttattttaccacattgctccacaaagtctcatccaccaattataattcttccaggtaaaatttactggaagcaattattggtagagctggaaatagcatttgccagacatttttctacacactgtacatatattaaatcatttaatatttataaacattctatgaaacatcacattttacaggtgaggaaatgaagaacacaaaggttatagagggtatttttcaaggtcatacaatttgtaactgtcagcaatagacttgaacccaagtattctggttccagaatctacacactaatccaggaaagtaaaggactgcgtatgttttaagcacctattaacgtgccaagaactgtggaatatatgaaaaatacataggagtcaatatgtaaatacacatagtttaaatagcaggttgggggaaaaaataacatactctgtaactagttttttcaaccgtatatcatagaaagttaagttattcagttgttcaaagtcagtcagtttccatgagagatggttaaaatgaaaaaccttccttataggtgaaatttagggtgaccattgccatttttaatcagatatccccaaaattcacctttccttgactagcatttaagaaagtactgcaaaatagtatatgcaaacattggctttggtaacttttgccaactaacttaccatagttttaatcagggaaaatggtgagttcatgtgtggaagttctactctgactcaggtaggtagagattatgaacaaaaagggaaaaggcaatttcctacctgatggtgtggaactctctaaatctgccagtccagtttttttcccccttccgtttaaggttttataagactttctaaataggcaatttagtatttgttactagtttggaaattatttttctggagccatatgaagtactaagtatttatagacaaaaatgttggcaaagaatatagaggttcttgaaatggcctttcactgtggcagaagaacttgaatacattcaagtgcaaatccagatttgtagagagtactgtgggtttatggaaataaagcatttgattgaaaaagtcattttttccagtatgacttagtgattattaaataaccatgtttttaatctgactcactggagggaagctccatagcattagtggtaaacagtttatgcagttagaatatgaaaaagacaaagaaaagcaaactaaaaagacattttagagtagagtgggaattgagccaatgtgcctgactggtaaagtctttggagggaagccaggaagtctgtgatatttctctagttaggatatatatatatatgtatgtatatattatatatatgtatatatatatatatataaaaatcatattggataaaaaatgttaaccctttctatcaaatttcagactttcctgattctgaaactcaaaactgaatgcaaattaagatttttaaaaagtatgattaaaaaaaataccgcatacacacatgacatctggcaatgccttagatctctctaaaatgtcaagatgggaaaatatccaaaactttttttttttgagagagagagagagaaagagaaagttggcttctagccataagcctgccgaggaattcttacgagaatttctggaaactgtactttttaaggcaatcatgttctccatgctttcgtggcctcagatgttacttgaaggaatttaaagtttcatctatttgtgctttgttgctgtacaccctttagacttcagtggtcaagtttcactttggagaactgacaaaagaaaaatattgtgtttggcactacacaatcttagaatactttaagaatgaatatgccaagggagagtcatattatatagcttgaattgtatttttcatgcatgatatgtacatcaccttatgtcacacaaatctctatcagccttttgcttttccattaaaataaatacccatcagatacttgatatagatattctgtggttggagggcttaagtgagatgcagtttcaggtaaataacataaaatcagcagacctctaatctgaattgaatgtgttaaatcttatcaacctagagttttaaggaagagggaacaactgtcttcagtgagtaatggcgcgtgcattaataccagttactcaggaggctgaggcaggagaatcactttaacccaggagatggaggttgcagtgagctgagattgcctcattgcactccatcctgcctgggtgatacagtgagactccatctcacaaaacaagcaaacaaataaataaaaaaacaaaagaaatggccaagaagaaaaatgcctagctttcctgcaacaatttgggagattaccatcatctgtattaattcattcattctgttgtttaatgaaaatggctaaagtctggccttgccattgaggtttttaaaaattctggtaaaatatgcataacatataatttgccattttaatatttttaagtgtattattctgagtcattgaataatttcaaattgctctgcaactgtagccgtcatctatctccagaatgtttttgtttcccaaactgaaactctctacccattaaacactaactttccatttcctccaatcggcaagctccaggccaccactgttctgctttctgttcccatgaagttgactacttttgctaactgatataaatggaatcatacatatttgtttttctgtgtctggcttattttacttagcataatgtcctccaggtagatccaagttgtagtaaatgtcagaatttcctttttttttaaagaccgaatagtattccattgtatgtatatactacattttgtttatcaaaaatggacacttgggttcctttctcctttttccattgggcgtattgggttttaatattacacgtttgttataaaggcagatatagggtgatagaattcatactagatttggaaataatcaaactaggctttgttctgccacaactaggtaaaaatgttacttctttctgactttttgtaaaatcaggatggaaatatatttcatatcattgttatagctaatagctattaagcacttgtatgtttcatactgtgttaagggcttttatatatttctcattgtattccgacaggaaccctacaaagtagagacagttccaaatttccagaatgaatgtgagattgtgatacatatgacaaactgcttattaaactgtacagcacctaacaacatgagggattatgcctaattccctacacagtgcatggcatacacaaggactcatgagatgctgttgaagaataaaagcagctctactttacagccataggaagcacatacatattcagccatttgaaaacagtgtgtcttgatgaaagaggattgcagttggattaatatgaacagtcactaaaaaataaatgaaaaccaaacctctaaatcacgtatacagacaatattcgcaatattgataatattcaaattgtgtaaggtaaacctgattactcagcagaattaaagtttcactggtgatatggggtgcaggcagtgtcatctctctgacaaaatttttcaaattttcaaaattttcaaagtttgaaaatttcaaattgacaaaaattttcaaaaaatttcaaaattttatagaaatcatcacagttctctttattaatcagagtttaaatgttaggccagcctgggtggctcacgcctgtaatcccagcactttgggaggccaaggcaggcgggtcacctgaggtcaggagttcgaaaccagcctggccaacgtggtgaaacctcgtctctactaaaactacaaaaaaattagccaggcctggtggtgcatgcctgtaatcccagctacttgggagactgaggcaggcaaatcgcttaaatctgggaggcagaggttgcagtgagctgagatcgcgccattgcacttcagcctgggcaatgagagctaaactccatctcaaaaaaaaaaaaaaaaaagaagaagtttaaatgtctactgataggcattattttatagggttattttatagggacttaaaaatttctacatatcaaatatctaacataaatattggatcacatggatatatattaattctgcaaataattatacaaataatattaaatatacaaataattagttatacaaataatattatactgtgtatgcctttttatagaatttcttccaaaaagcaacagtggataagttggagagagccatgaaattccccaggagagtggctgtgaagggtggccagggattgagacatagggtatcttcctagagtctatccatgagaaactgacatgatttcatgccatctgctataagtgctataagtaataatatagaaatagttgacctcacagttaatttattaagcaaatagtggagaagatgctagtaatttctagaccttgcctcaggggctgtgaatataggaggggataagataaaaagtggctctttcattggagtatcaattgtggggagagattgaatatcctcaataatatcttaattaatatataaatatatataagaaatatataaattgaataattacagatagagttttttgtgaataaaactgaacaaagtgatgtaatggagaatgatagcagtatatggggcatattctttagatggggtcatttagggaatgtcttcctgtgacgggggcatcataaacaacaattgttcaactgctctattccatcagggtgggaatcacatactcattgttggctagcgtgtctgcagtgcctaggacagaacctggcacttgataggcatttactgaatattttttgaataaaagaagaacgaaatggatgacagtaaataagtcttttaaaaacgttgaatcaaggctgggcatagtggctcatacctgtaatcccaacactttggaaggcagaggtgggagggttgcatgtgcttaggagttcaaaaccatcctgagcaatgtagtgagacctcgtctccaccaaaaaaaagaaaaaagaaaaaaggaaaattatccagctgtggtggtacacacctgcagttccagctaatcaggaggctgaggtgggaggatcgcttgaacccagaagattcagaatgcaatgagttatgcttatgccactgccctccagcctggatggcatagagtgagaccctgtttcaaaaaaaaaaaaaaaagatggatcaacaaaagtgatatcaatagtaatgacactaataacaaaaaaaatagtgaaatcatgacttgcaagtataaatcactttaaaagattattttaatagaaaacatgttaatctttagaactacctgaggtagtgtgataggaactattaactacatttgatgaatttgaggtacttagaacatattactggtgaatggggaagctggcttaaaaaaaagggagggtcttctcagacagttctctttttacatacgtggcacaatgattcatgatttgttatattgtgaatgttgaatgtggaatatttataggaatgcaaatcacatttcctttacacaatagtattaaactgatttcaaagtgttttgatatatgcttctatccttacaatggtccagtgagaaagaaaatatgatattcatcattgtagacatggaaataaaagttaagaaaagttgtcttgatcaatatcatatgcaatagcaagtggaaaacccatgtttttaatttagaatttaatactaacagtctatgctctcatggatgttttatgtagtttaatgtttttaaaaaactctaagcccgacaacttcgctgtttaaaatatttgaaataaaaatagctttgccattttttaaataaaacattaccttttattataacaaaattcagaaaatacacaaaataacaaaacaggaatgaccaccagttatcatttaatgtgaatcattgaactcctttctttctataaaattacaaagttgaaatatgttttaaaatttgtgtaaaagttagaggatgatttgatttaaatctattatttaaatttatttttagtcaagtaataataattcagtgaattgttcaaatcagaattgccatgatgcaggtttcacatacatgaaacaagttaatatgaggaatattctttcctatactttcctttttatgttgtttttatcttaattactctaacagagacaaatttcatctaaagaggtgatatctaaaggaaatgtagagatcagaatataggacagattgttttaaaaagtttgatatttattattaggtgcctaataaatgctccttctagtttatgaagctttatttctaaaactataatctatgtttatgtgtgtttattgaatatttgtgttccgttggtaacaaatgaaatttaagtgtactattaagtaatgctaatactaatatcagttctattttgacaaacactgtgctggccactattccatgtgcctcacacacttttatctcatttaaatttcataaaaaccctatgactgaggtacttttcttatctagagattacttgattgaagaaacaggggcacagggaggcaaaacaattttccagggtcatacaggtgaacatgaaaaagccaaaagtaacacccatcaatagggctacggcattcatgccttcctttaaaaattaattgagggcaagaaaccattgtttaatatgtaatttcaaacatctagatgaagaaaatatctgtattagaaaataataaggactatgtatatatgatttcagacgatttcctatttaaataaattaggataaatgacatatttgttatagggtgaaatgttagggaaaatctcagttttagtcacagatctctactaaccttgaaatcagatataccaatttaactctttggcttgggatttttttattcaaaggcatcagatgaaatgagctcaacagtctgccggttctaaagttctttgtcaccttctgtgttatcacgtggtggtctgtgaatcttacagagattgatggcttcagtcttctccaaatatttctcctacatccctcgttgtaaaaggaaactgagtgtaaggaaagaatgtaaatccgtaatcacatttggatatctttgaagttgcaacactccagaaatttggtgacaagcaaatgcccctatttttaaaatgatgaagcatcagtgtattagtgtaagttgataagcttggagatattccataagagattattatattctttggaaaaaactcaggaggagaggtgctatcaataagaagccatcttggcttcaacagaaataaattatttgaataggattcacgtccttattctacagacattaattgcaaaacgacccttacttatttttaaagaaatttgaaaaatataattcacatgccacaaagttttccctttaaagggtacaatgtagttgtcccacgtatattcacagagctgttcagattgtcccttattgaatcattttgcttattcaagagcatctaacccagtgaagtatgcagtgatagtattgcatcaatatttgctgaattctccactcaatgaatacaaggtacagcaaaagagaccagataattctagctaaactcagatgaaataattgtaaaatccagaataattaagtattcagatatattcagataaagattccagaaggatacaagtaaatgataaaaagagcacatttatttctaatattagctgtcatattaacacatagaaaaaaatgtaggcttgttagcatcaagtaagttgccaaatatgatattgccccttatataacttgaataactttaggtgttacttaaattcataggcacatattggcatcttcagagcaagatgaattaacactctggagtttttattttatttatttaaaaatagattatcacttgagaaaagacagcatcataacatttagtgacaaagtgtgaaattttcctacaggtcttagtgatttagcaaccacaaaaccaaagaaaggagagtttaatcattattttaggttccctcatggtgactctaaattgtaagtaagaatagcaagaacgttttcactggcaaccttctttatcttaaaatttaatgtcataacacgtttggtaaagcagctaaattatttctaatgtatatgtttggctgaggcagttaatacaaagtaaaaggcaaaaagtcatgaagcttttattttctatcttgtttcacttgtgcctccaatgagcattggcttggagtgcttatcgtcatgtcactgacattcttgcccaggccttggcaaactacttggataccctggtgagagaggtttctgggactttggcctggaaatatgcattttgaaaattatatccagtgattctaatttgtaactagttagacatcactgcactaagagtaaactttcagctctctggcctagttcagtaattttctttatcacaaacacgtctttcataacttggttccaaaggcattcatgacttttgatgtcatccgtaaatgcattttaaggaattaatttctgcttttaaccaattacaagattttattaacaatctgtttactgtttgacaagtattagtcagcttttattttatgtcattactgagatttgaagtcacctgcactacgtttaaacaaaacctattcttatgattacaatatatttacctgacattatgcaaaactgcattttttttgcatttgggaacaccattttatatatgaagttgttgaggcttataaaaggtcacaagtaactgactaatagcgtcaagactagaacccatgtagtgttggcatctgtttaggaacctgtgtcagatcccacacttgtaatggagagcttaatttcagagaacattagccatatctagctattgctgtgaatttaaattgttttgagtgtgcatttaatttgcaaatttgtattggtttgttatttgtgtaagaattatacacctacaaagattttaccaagtttatatttttacattttaaagtagtgttttaaaacaaataaattaaattgacacttggtgatgcaagattttatttttccttttagaaaaggtctttacaatatttaaatttaaatcaaacagttctcactgaaataattaggggtaaaatggacctctgttgatgctatttgaaaaaactatttgaacaatgagaacacttggacacagggtgggaaacatcacacaccggggcctgtcgtgaccggggcctgtcgtggggtgaggggaggggagaggaatagcattaggagaaatacctaatgtaaatgacgagttaatgggtgcagtaaaccaacatggcatatgtatacatatgtaacaaacctgcacgttgtgcacgtgaaccctagatcttaagtataattaaaaataaataaataaataggcctggcgcggtggctcatgcctgtaatcccagtactttgggaggctgagataggcggatcacctgaggtcgggagttcgaaaccagactgaccaacatagagaaacccggtctctactaaaaatacaaaattagtggggcgtggtggcgcatgcctgcaatgggctgaggcaggagaatcacttgaacccaggaggtggaggttccggtgagccgagatcatgccattgcactccagcctgggcaacaagagtgaaactctatctcaaaaataaataaataaataacaataaaataacaaaatagaagaaattggttggatgccacgattaaatatagatttgtttttgcatttgtaggcagtcagagcaaaatgggagcatagtaaattttctcttatcataagggaagaaaaatctggctcctgaggtggttgttattttctttgtgtttttcttcttctaaattctaaaagaaagtgtcatgtggggtttcatataaatgacacagatgtcatagaccttttttcaatatttttatggcaattacaggcacaaattaccaacgactatttgttatagaactttttgatcaaaaacttacttcattttttctctagaggattttcaatgaggaaaagaagcctttactatttacttttatatttcatatgtagctacaaagttgcttaaataaaatgagcattctttatcaaaaaaaaacaaaaagctattcactgaaactttggggatactcatcttcatgtacagtttccaactctgattagaccacagctcctccctatatttatgatttgcttgctttataatcaatattatttctgaaactagaccccaaacaagtcagttttggttttgctaagatttgcttaaatgtaaacctttagaaaatcttatgtatattattttatgactcttaactgagtacatacttgagtggttattctgctgttacatttgttctgaagaatcatgcacattttaataggcaagttattaatgcaaccaaacctttaagttttggagttttataggtaaaatatgtttttctagaggtctgtttctaaagttaaaagctgttctaataaataataaacagattcaaaaaccttggcaaactctcacaaaccaaaacaaaattaggacattttgattgattttaatattactttatctaataaaaaataagttagatgctataaaaatatttttaaatgtggaggtaatttagttcagttatcacacaaacattctctccaatatacacttgagtgtaaattatatgttgttatttactttaataacagtttgctcaagcagaaaacctgaaaaaactattgcacgtatgcccagggttgtattgcatattaacacctgcaaaataaggcacaattacctttctatttagacaattaaaaacttcgataacataagcttagttattgcctgataaaaaatatgccaatcctgctccagattaacagatgtcttattgattctatgtatgtaccaagttagacatataaaccaatgggtttaggaatggttagtcttctaaaatctaaactgtttgtagcaaaatgtcattgtaaaagcccaatataaagaatagctttaagaattcattaaaatgtaaggtacatgaaagcggagtacgtggttggttttgttcattgctatatatttatcacctataacagacacatagtaactcctatagaaatatttattggataagttaatgaagtataattatggaggcatagttatttttcagaaaagtaactatacatcacatatcaaccattgtttatataaaaatcagatgtaatttcatatgatttggtgagctaagtatggtcaagaagcatgtgttcttatcacagataatcataaaactaatttgaaaattatagaaaatctcaaattatatcccaaaatggacaattattacttgtactatattttctcttagtaagataatatttgttttgttatagaatatttgttgtcattcctactcatcaatgttagtacaatttctcaaatagatgtaagcataacttctaaatttaacaatcaaaatatggtctaataaactaagatgaattccatactcaatatttgtctttgtaacctagaatattttctcaattgctactatgaaaattaagaataaaaagaaaattttaaatgtaggaagtgcactgaactgagaagattattttcctaaagggaaattccactggctatggagtaactgggaactctgtcctttattgtaaaacatttatgaaaattgcttgacttgcaacttcattggttgccttggagagttcattctataaaaaaaggtgcatcacgtgaacaagaaatgtatctacacaatgctcaacagaaaacccttgattaattgaagtatagtaaatggttattggtccattccaatttcctttaatttgcagttgcttggaagcataaagctttttaatgtctttgttttgacaaagaattcacttaaaagtgagaacaaatttaatttattaatataatttaaaaacatgttaaagcaaattaaaaaattaacatgcggaacaatcttttaaaaagtttttttttttttaaagtaggaagtacactgaactgagaagattattttcctaaagggaaattccattggctattgactaactgggaactctgtcttttattgtaacacatttatgaaaattgcttgacttgcaacttcattggttgccttggagagtttataaaaaagttatttattaagttagaactttaataaaagactttttatttttatttatttattttttttgagatggagtcttgctctgtcacccaggctggagtacagttgtgcaatctcggctcactgtaaccttggcctcctggcttcaagcaattcttttgcctcagactacccagtagctgggattacaggctcatgccaccatgtccagctaatttttgtatttttagtggagacatggtttcaccatgttggccaggctggtattgaactcgtgacctcaggtaatccacccacctcggcctcccaaagtgcttggattacaggtatgagccaccgcgcttggccagacattgatatttaactctttcttaatcaaattttgaacttatttcataccttgtatattctaaaaaaaaaaacacacacatatatatgtatacatatttctagcttatatgcccacgtgtttatggagttcactcttttgttttgttttgagatggagttttgctcttgttgcccaggctggagtgcagtggcgcgatctgggctcaccgcaacctccacctccagagttcaagtgattctcctgcctcagcctcctgagtagctgggattacaggcatatgccaccacatccggctaattttgtatttttagtagagacagggtttctccatgttggtcaggatggtctcgaactcccaacatcaggtgatccacctgcctcggcctcccaaagtgctgggattacaggcgtgagccaccgcgcctggtgttcactcttagggaatttaggtgaatgcagatagttacctactaaaaagatataaatcgaaagagataaactttggctgttgggaaaatggttgaatcaatcaagcagcaatattaacctgcgaagggtaagtcacttttgtcaaaataaaaaggctatgttgaggttcttacagaaaatacttttaaaaatagggacctacacaatgtaatgtagaggtgttttggcagtttaagggaaatgtaatgtaaaaatttgcataatgcttttacatatgtaatccatacaatattaaaaaccgtcaataaaaacatgttgaaagtccttaatctctctttagtattagtttaacagttaacagagactattaagattgtaatttattctcttattaaaaattattatctgatttactgaaaaaacaatcacaggttttgaatatctaaaaacaaccactagaggaaagcaattgatttcctgtaacatttattaatgtaagcagactgcgagaattctattaatctagacaggagaactgtaatgtttctgttgtcttctttattaaatttgacaaatttgaaatgcttgcaattctgcactaacaggatttcataaatactctttgctgacacattttaatttttgtgcatttactggatattcttaaaatgcaatcatttattatatttcagggcaggaaaacctaattagtagtaaacgattatatcaaacatttgcttttttaataaacttggctttatattaccttatttagatatcatgaattcatattagtacagacttctgattacctattacagaaacattccaatttcaataaaactaacgttagtagtcaagtagtttctctaagcaactgaaataaatttgcaagtgatggactatgcattcttagtattaactgcagtcatataaggccatcagtaacatggtattaagagaaaaccaataaatttacccagttagtcagtctcttggtatgtgagtagaagagacaaaaagaaaaaactaataatacagttgtcacatattattgaccattttctgcccttctatacttttctaagcccataggctgtggttatattgctatgatcagtttgggtagctacttgaatttttgatctttaaatgcaggtatacctctgagacatttcagatttagttctagacaactgcaataaagtgaatatcacaataaagcaagtcatacagtttttttggtgtttcattgcatataaaattatgtttattctatactgtagtctgttaagtgtgcaataacattacatttttaaaaaacaatgtatataccttaatttaaaaatactttatgctaatacatgctaacagctacctgagccttcagcaagttgtcctcttcttgctggtggaggatcctaccttaatgttgatggctgctgactgatcagggtggtaattgctgaaggttgtggtggctgtggcaattttgtgaaataagacaacaatgaagtttgcggctttgattgagtctgactgtcatgaaagatttctctgtagcattcaatactgtttgagagcattttacacatagtagaatgtcattcaaaactggagtcaatcctctcaaaccctgccactcttttatcagctaagttgatttattattctaaatattttgttgtcatttcaacggtatttacagcatcttcaccaggaataggttccatctcaagaaaccactttctttgctaatccataagaagcaaatcttcatctgttctagttttatcttgtgactgtggaaattcagtcacatcttttggctctacttctaattctagttttcttgctatgtctaccacatccgtggttactttcagtactgaagttttgaacccttcaaagtcatccttaagggttggaaacaatttcttccaaactcctgttgacgttggtatttttacctcctcccatgaatcacaaatgtctttaatggcatctagaatggtgaattctttccaagttttcaattactttgcccagattcatcagagaaatcactatctatggcagctatagccttacaagatgtatttcttcgatcataagacttgaaagtttagattactccttgatccattggctgcagaatggatgctgtgttaccaggaatgtaaacattaatctctttgcacatctttttcagagctcttggatgaccaggtagattgtcaatgatcagtaatattttgaaaataatcttttttactgagcagtaattgtcaacagcgggcttaagatattcagcaaatcatgctgtaaacatttgctgtcatccagggtttgttgtttcattggtagggagcaggtagagtagacatagcatacttctgtggggcttcaggattttcagaatggtaaaagatcagtggcttcagcttaaagtcaccaactgtactagtccctgacaagaaactcaacctgtcctttgaagcttcaaagccaggcattgatttctcctctatagctatgaatgtctcatgtggcatctaccagtagaaggctgttcatctacattgaaaatctgttttttaatgaagccacctttatcaattatctttgctagatcttctggatatcttcttgcagcttgtacatcagcatttgctgcttcaccttgtgcttttatgttatggagatgccttcttcccttaaaccttatgaaccaagccctgctagcttccaacttttcttctgtggcttcctcagctctctcagccttcaaagaattgcagaattagggtcttgctctgtattaggctttgctttaagggaatgttgtggttagttttcttcgtgtcagcaataaggctgttttgttttcttatcttttgtgtgttctctggagcagcacttttaatttccttcagtatcatttcctttgcatttacaacttggctagctatttggcacaagagacctagcttttgatttaccttggctttcaacttatctacttcactaagcttaattatttatagcttttgatttaaaataagagatgtgcagctactcctttcacatgaacacttagaggccattggagggttatttcaatattgtgcttcaggtcttgtttccatattgttgttctcaggaatagggaggccctaggagaaggtgagaaatggaagaatggctggacagtagaggactctgaacacacacaatatttatccatccagttcactgtcttatatgggtgcagcttgtaattctcccaagaaaatagtaacctcagtaatcgctgatcatagatcaccttaataatgaaaaagtttgatgtattgtaagaattaccaaaatgtgacacagacacaaagggagcacatgctactggaaaaataatgctgatagaaacttgctcaatgcagggatgtcacaaacttctaatttgtaacaatatgcaaatatctgtgaagcatgataaaggcaagtgcaatgaaacatggttttccagtacgtgatattaaaccatatcatgaaattctagactctgagatttacaagggactgacaactcaatcagttcagcttctcatttccactcttaagaggtacctctttaaataaaaaagcctattaagatcattaaaataaatccatggaaatcctttttattaagcaaaatgtgacaaaattgttggaataaccagaatgaaaaagtctatcattgtcactgccctatcagactgacatacttcattgagcataagagggatactataaactgtactaatatgactttatttctttttactgctgaatatgattccattgtatgaatatatcacattttgtgtattcatgcatcagctgatggacatttgggttgttttcaccttttgaatattataaataatgctgctctgaacatttgtgtacaagtttttgtgcaaacatgtttcatttctctatggtagaattcctatgactggaattacaagtcatgtgatagctatatttaacatattgaggaactgccaaagtattttccaaagtggttgcaccatcttatattctcaccaacaacatatgagtgttttgatttttgtatgtactcaccaacacttgttattatctgttgtttttaatatagccatttttatgtgtgacatattgtatttttaattttcatatctcaaatgactaatgaatttaacatctttttatgtgttgtttaactattcttacattttctttggaggattgtatattcaaattcttttcccattttaaattgggttatttatttttattattgaattgtattagttctttatatattttggatataagtccctttcagatatatgacttgcaaatgttttctcccattctgtgaggttttctttcacttaataatgtccttcaaagcaaaaaaggtttaaattgtgatgaagtctaaatttccagtcttctatcacttgtgcttttcctttagactctctgtaattttttacttagagcaacatgtagtgtaattttggtttaggtgactgtgcttctactagacagtaaatgtgaacacctgggtattttgtatcctaagcaacaagcaaagggcctgagctctagtaagatatcaatgaatgtttgttggattcattaatggattttttgatactccttttcaataagtaaatttaacactactcagtaacaaaataatttttactaaggaatgacaatatttgatctttgaataattaattttagaaacacacacatatatatatatacatatatatatatatatatatatattttttttttttttgagatggagtgttgctcttgatgcccaggctggagtgcaatggcatgatctccactcactgcaacctctgcttcccgggttcaagcaattcttctgcctcagcctcctgagtagctggaactacaggctcccgccaccacacctggctaattttttgtatatttagtagagatggagtttcaccatgttggtcaggctggtctcaaattcctgacctcaggtgatctacctgcctcggcctcccaaagtgctgggattacaggcatgagccactgcgccctgccaattttagaaacttcttggtcatcctcacacaaaattcagatattgattccttaaattaaattttagtgtgcatatttaaaagcatgtttcaatgataatattaagtagttaattgccttattttatcttggaaaaagcagaatgagtgatgaagtgtcatctgttttatttttccagtttttttccatagaacatacctttatttgaaaactaaaatcaaagtatcccttgatgtcataggatactttgaaattatagataatcatagttatatagtcataaattgaggaagagtgagagagtagtagaaaaaaatcatcaaaccgtattatttcatggagatggttagttgtagtcagtatttataattgatggctttttccattactctggagtctaatttcaaatctttcataagtgtacagatgttttatctgattttgcacattattttctttctacatttccatagtagttcagacttcttaaaagtcaatttttaaaaaaaattcagcttttcgtccagctttttgtcatactcttattccactaaaaatgttggtactttggttttgacaatgaaaaatagaaaacaaatagccttttatgctgaaacatcttattaaagaaaatttattttgtgatttatttctttatttttcatattgaaaaatttttccttctgttaattagttttaactctgatgatcatcaggggataattcttaggactttcattactcaatgtaattgtaatagttggttcacctccttcttaatttgcgtgtgtgtgtaacaataaaatgtactagtgcaatgaacaaactggtttttacatcattgaataaatgtacattaaatgccttctgtaccctaggcgttatattgaaactgatctaaatgtttcactgtttgaaacttagaaaagaagcaggctttctgagttttgttttgttttgttttgatttttttgaggcggattctcactctgttgcccaggcttgagtgcagtggcaccatctcggcttactgcaacctccacctctggggttcaagtgattctcctgcctcagcctcctgagtagctgggattacaggtgcacacctggctaatttttgtatttttagtagagacagggtttcatcatgttggcctggctggtctcaaactcctgacctcaagtaatccacctaccttggcctcccaaagtgctgggattataggtgtgagccactgcacctggccctgagtttagaaaaataggatgtctaaatagaattaaagaacaatgcatttccaaaaaattgattttgataagttgaatttctttagaacatatactttacaatttatatcacataaaattttattcattactgtttattagtgagctaaagctgtttcatataaattaaatttgttattgttttgaagtaaaaatacaacacaagactctagaaagagactttaattttatagtttaagatagctgtttaaaagatataaggacatataactattatagaccagtggtccccaaactttttggtaccagggaccagtttggtgaaagacatttttccacatactgggtgggagggtggttttgggatgaaagtgttccacctcaggccatcaggcattagattctcataaagagcgtgcaacctagatccttcgcatgcaccattcacaatagggtccacccttctttgagaatctaatgccgcagctgatctgacaggaggcagagctcaggcagtaacgctcacttgcccgcccctcacctgctgctatgggccgggttcctaacaggccacaaaccagtaccggtctgtgcccaggggttggagacccctgttatagactaataaccaactgaaatagaatagcatagctatgagtcaaaggtttgtgtcttttgcatcaaagaatagaaatgtctgcaaaggtgaagactactatgcaaatgtgaaatgaggaagagtgattattttgacattgcagtcattccataaaagaactatagccaagtctcgtgtaggttctagaaaaccactaaagatggcgaccatgttatcatgggggctgcattgtttcttattgtacttgtgccattattttgttcttgcaatgttctttgtgtttttgttttgtttttgtttgtttaaattttctattcttaaaaaaacacaatctgatgaactctccccaatctatgattcgttcctcttggatcatgtattcccaccactcctctaatctttggattgttggagggggaggaagaacttgatatgtattattttgagttgcccctgacagatagcagtatggcatggtaagtgagaatgtgtagctatatagggtaggaaaaggtattaatagattcagagaaataaaactcccagtacaagccatacaacagatcaatatacattagctttttactcttctttgtgctgctcatgttagaccagtaattatttagaacatggaaacaaagtaaaataaccagttaatgaattcattgttttggcttttgtatctgttagctactgccagaataatgttgcataataaagagccacaaaaatctcaaaggcctacaaaaattcacttttatcctcacacatttctggataactgcagttgggcttctctaggctagactcaactaggaagcttggcttcagtctaaaaaccttccagctgagattcctctactcagtatctctagtctttctggtagtagtgggctagcagaaacatactgttctagtgaccatggcagaggtagaaaagaataagtgtattttaagccccttcttgtgctatttttatagatagcccattgtccaatccaaatattatgaaagagcccaaaaaaggcaaggagaaaaatctcacctttagtgggagggactgcaaagttgtttatggggaggggtaacgggaccaataattcagtctaccgtagtttgtacctttaatagaaatcaaaccacttctttatttttcagtagtttgaatagaagccttctttatttcatagtatccagtacacattaggcaaaaaaagagaagaaaaaatttagtggcattttttgtttgtttgttttatactaaaatttccctttgatatgtgtctaccacattcagattaacatctattgaaaaatatactacaggacgcatttgtagggtgtttgttttgaagaatagtataaaaatttccataagtttcttatgcaaccacacatattttaacttgatgttttattctgcatttacttttgagcatccttaagaatttgttaaaatgcagaaattatgcagtattgatttcaggaaaaattgaagtggttacacatggttgcctttgccttaaaataaatccttatttggttctaacttgaacaatattgaaagcacaacaaaactagctttttattatgtcaccacacatttagtgagttatggaaagcattttgttttaagaatggagttaactatgtgttatccacgcttctagccattcttgtcactcctggctactctccaagcctgcctgttattcatacatatttcttcttagtaagaaatgcatcaaaatcccaggaacatgtgctgctgactgttagaagagttttagtggtgagagattaatgtaattacttttgtttgagaaatataattggtcacagttatatacatgtagcttatatgagaagtacattcagttttaaaactcattatgattaattttactttccttaaaaaatgaaaccaaagagaatctaaaatgtgtatgcttctttcattcctaatattccagaatacttagatatttttatgtgaagtaaatgcccagatatctaaatagatataatattatttaaatttaaggtataaacttttacatgacaaaatgcttaatagcctataatcttaaaaacagaattattccaattcccatattgtatgttacttcatcaaatattaccattatatcatgtttcttgtactaaagtgtttcctgtgaaataacgtaataaaatggcctttagtatgcatgataatatttaaatacgcattttctagtaaaatataatgcttattcatttttttcttctagttctaaagaaaaaaatgcaccaaatgcatacacttactttatgataatttctgaaacttaagtagagtttgggcctgcaacagacttgtgttttctagtagttatgtttcattcatgcaggtggtagtggtcctattagttttccttaataagtcccatatagctctggccagtctttcatagaatgagttggtaggtctttcctccaaagtttgatttctcccatttttttcacattgcaatttcaaactttcagtaataccatcaagatgagacagtaaactattattagagttaccacaagtttgaacaaagttgattatacatcgcaaacaaataaatacttaaaaccttgttcatagagatcaggccttgcatacctacatagtccaaacattacattcctgacatttagaacatttaaatgcaaactgttctttgttagggctttctcataactgaaatatgagtcacttgcaaaccataatagattttggctctgctacatgatgaagtgttctggatgtcgtgaaacatttcacccagacttatggcagtagaattcccagtggtcacccaaaatagggaaaaaaatgaagaacaaacttaaaggaaatatgcagactctggcaccatcctttcgtggcaatacagctctttattgttgttaagaaatggaaatatttagagcctaaacccataaactatagtacaattaggcgttgaattttttttttgttcctaattacgaaatttaactctatacttgattctcatgtttaaggtcaggtcatagagtgtttctttacacatcaccctgatgcggtcatactgagttgtctcccagcactgagcttctcactgcattgtgggcaaactcatattccacactctacactcatctcaggcaggaaaggtggagttttccttttcagggccaaaggaagcaacagctgaggcgtgatggttgtactgatattggtgtgggtttcaatttggttagtttgctttcaatttcaactcctcacttgagattccatacagaaaagtaaatggtaggcttccagcatcttgtttcactctggtgaataaaaattgttttgaatgtaagattagagtttttccttgcttaattttagtagtacctacacagcataaactgaggcatcatttagcaaaatgttattgagttgacatcataatgacctattaagggcaatacacatttgaatgagctcagttattcttccaggtttacacgtgcctttcatggtgtttagtgtagcagcttttgaagcagagatgggcaatgtgtaggaccttttattccagtctcctaagtgggagatattctgaacaaaacatattaaggatattttttctgaagtttttgaaattttaagtcatgattcacttttcaaaagaagacatttatgtggccaacaaacatgaaaaaaagctcaacatcactgataatcagagagatgcaaatcaaaaccacatggagataccatctcatgccagtcagaatggcaattattaaaaagtcaggaaacaatagatgcttctgaggctgtggagaaataagaacacttttacactgttgggggtaatgtaagtaagtttgaccattgtagaagacaatggcaattcctcaaggatctagaatcagaagtaccatttgacccagcaatcccattactgggtatatacccaaaggaatataaatcattctgctataaagacatatgcacatgtatgtttactgcagctctatttacaatagcaaagaaatggatccaacccaaatgcccatcaatgatagactagacaaagaaaatgtggtacatatacaccatggaatactatgcagccataaaaaggaatgagatcatgtccttttcagggaaatggatgaagctggaagccgtcatcctcagcaaactaacacaggaacagaaaaccatattctgcatgctctcactcataagtggaagttgaacaatgagaacacgtggacacagagaagggaacaacacacaccaaggcttgttgggggcagtgggaggcaaggggagggaagttggaggttggttcaatcagtgcagcaaaccaccatggcacatgtatacctatgcaacaaacctacacattctgcccatgtatcctgtttttcttttttagaagaaatgttttgttttaaaagaaaaaaatagtaagtcattattatgagtagttactgaattatcataaaatatcatttcataacataaaaattatatatgatagcatgttcccacacaaaaactaggaaatcaataggtttgaattgctttaaaatatcattgtaatagtggataactttgattaatacatctttatatgccagtagaatgcctatgttattattacatttgctgaatatgggactttaataaaaatgtaaaaatgacctggatttgcttaaaaacagaaatatttctagaggagaatttacatgctagacatggataagttgtcagaatgagcaggacacattattgctcttggaatctcagaatatagaagtctctaatttaagtaatataaatgatcttcagtatcctgaagatatttgcaattacctatgttggtaatatataaacttaaatcagagctacaaaatactattattgaaataaatatttctgacaaaactgttacttgcttgtatttaaaagcaatcttgatggcattatcttaatatctttagagataacacttgtgaactctaaacattatttttagtgcaaagtttgtcataatttatgtggtttaagtgacaatattacatgagacaattaattttggagtgtcagttccacaaatccaaaaagtcaataaagtaaataattatttttgccactaaacaaaacaaaaaattaagcactatttgccttgatgcatcaggtgttactattttatagtttgtacagtttctgtctatcctgccaactatttaaatgtaagccattctgaaaatgggtatttatatgttgcatcttttaagaaaaagaaatagctttttgtatacgttttaatagtaatcactttcactgatatttacagagaatttaactatagtttctttagttgtaatacatacctattgtctttctgctgaatgtctgttttccagtggcattgataagacgaactctcacagattattttatcttaatataaatataaaagaacctaaaaataggcaagaagtgaataaaatgttttttaaagtagcccatcaaatattattttcatcagaaattattttcttgttgacataaaatgcatattttttatgaaagatcattctctctgtgcaaagatcagagacattgtgtcttaggcacatcattcagcttgctccacagccctggctgtctccactactctggaaaaatcagtgccctcgagtaggaggcttaacattgtttttcttagataaatcacttgacatttcagtgccttaattttgactctctgtaaaataacagaaatggaatggaaatggacttgatgatatttaacattcctacaaaaagtattagtatgttgacttgcaaatgaatggatttctgaactttcagtgtactacaaatcctacggtctcccaaaagaaaacaaaagattgtttttcttctttatttgagaaccattttatgtagattgcaggaaggttgtgaattaaaatatgtttagattttttcattccgttcattaagaaacatttgatttaagctgcagagaggatatgcatttaagaatatgtttagaattgtggttgaggtggcaaccaccatgcaattatcagtttattaacaggggaatgaactcataatggactttgctattttagtcatttcctttaacttgaatataatcttctactttcataatatcaatttaaattggggaaatagcatgttttatcattagatccacaaatatataatggtttgatattagcgattgttaggtaatgattgttccttagttatgtagttgtatgctgaaacatttaaaaaattaatccccatgtataataacattcttgatgtagagcaaaataaaatgatagactgcatattataaaaaaaagagaaaagcattatattattttatgcactattcccacagaaatattttttagttttaaaatatccatttgacccttcagcaagctgaataccagggattttattccttcagcataaagtaatttggtaacaatatttaaaggcatatttctaacttaaattttacttttataaaattaccaaaagacagatcatttgtgaactaattggttattagctcctttaatctcagtcatgtgtttgtctctaaataaaattatttcatttaccagagttttactgctcagggctcaggtgactcagtcaagaaagtcattcttgtgaagctacctaaatggtaacaacggtagtggcagtgggtgataccttagctcaaccattagctgcagctgaagtgtttattgtaagtcaagcacagatctaccaactacatttcttctaattgtagcagatgaaaccacacacatttttaaaggaccagatatctaagcacaaaggtcaacatttggtaggcatgcagaaaacatggaagtgccttatcttaacgggatcatgaatcttcatctttaaagggcagtttttacagattttcagaattgataccttaagttgttctgaacttcaattacaaaagctattgccagattgtgttttgtttttattcaaaatgtagccactcatgaagagaaacttctgagtttgaaatgtgatttgtgtttttgcaaaatgtttatttgaatgcaattttacctccagtctaaacaaatgtaaagataaatgtaaaacactaagaggggcaatgctggcactgaaagcttaactatgtagtagtattgggtttgtcctttaatttttacaacatatgcttttttagtttagaaataatattgtagacttttaagatctcagaattttaagctaaaccactaataacaactgtcttcattatttaaagtgatctaaattgtatagaaataaaagggttttaagaattataaaaatgtagttattgtttcctgcttttttctctaaacttctaatgttcaattcttgtgttttatataacgttttaaaataaatcacaccaaaccttagtctaaagaaggtatagtaatggttggtgtcagatctgagagtgaaccaagcacatgttaggatttagaatcatcaagataaatagtaacaccaatggcaacaaggaagcaatttaaagacaaatttctggaatcaagatgtcaacagtgtattttcccagggatgactgcttctgtttgtaaatattgctattaaagtacatcacctattttctacaagggatgctgacttgtcttattttcttttatatattttggtgactaatacatacttgttatgtgacagattctaaaatattcaatgaataaatgttagatttagtgaccacatcacatgtaaatgggttcagaatcttgcaattcttggtagataaaaccatggcactaaggatctggataagtgaagaaatggcaggataacacttatctatgctaatgagttcagatcttctctcctagataattaaaaccgcaggctactgagataactttgccaaaccatgctgaaagcttttcagttatatctaaggaactgtggagtagagaaaagggaatgggcaattaaggaaaaatatctagattttcaagaaatggaatatgaagttattcacttttcttttttattcttttttgagacagagtctcactctgtcgctgaggctggagtgcagtgatgccatcttggctcactgcaacctctgcatcctgggttcaagcgattctcctgtctcagcctcctgagtagctgggattacaggtgcacgccaccacgcccaactaatttttgtattttcagtagtgatggggttttgccatgttggccaggctggtattgaactcaggcttgtcctgacctcaggtgattcccctgcctaggcctcccaaagcgttgggattacaggtgtgaaccaccgcgcccggccattattcacttttagaatgacaagatgacactaattttgggaaagaggatagcctgatttattaaataaatgacctatggaattcttactaaaaatataactttgcatatatcagaatataatgatgatgaaatggtctagatctgtatatacaactggtctatatagattcattcaaaaaggtgtcgttttgaactcaataatatttaactaaatttactatctctactaaagcaaaaagaaagacttttccgtatttgaaatgaccaaaatctcacagagcatacgggatcacagacttctagagcactatgtagtgatcccctagtttagttttttaaaaaattttgacagagagagattgattaatagttagttagttcttatgtaagtgatccagattccagatgtgaatgaaatgcacatttatgaaaatatatttgtatagctgtagcatatattttaaaaacatgattcattatgtttttttaacacacacgcatgagactgtgtaagttttctttactgactgattagctctgtggcactaggtcgttccttaccactggactttcattaactcacctatccaatgggagataaagttcttaggtcatagggctctgctgaggtttttatatgtatatatgtgtgtgtaggtgtgtatgtatctacatacacatataacctaaaaaaatcaggtatgtttattagttattttattaaaactattaaaatatagaattggcttgctgaattcatggacccaccagttacactgagacatcttttaggtatactcaacttgttcctagtgtgtgactctgtttcctgatgtgcctttgatggtcatatttaattggtgtcaatctagaccttccttacgctcaatttgatgttcttccctgcacatacacacttacatgcacacatttacacacacccacacatacttacataaacacacgtacattttttcacaaagacatttacaaaatcatacatgcacacgcatgcatgcgagcacacatgcacacacacacacccctagcatgcacaagggtggcttgttgctttcccaataaagtcataagattacagatgaaagacaatttagaattttttaaaattctatgaatctaaaagttcagagttgaattatgatgcattcagttaccttttatttgttattttttcttgttttaaggactatgcatatatatgcaaaaaatttacgtgtataaagtgaagatatttagtaatttctgaagaacattcattacatatatgtatgtgtatgtgtgtgtgtatatatatatatatatatatatatatatatatatatataaaatatgtatgtgtgtgtgtatttcaaagctcttcccacatgaaaactcagtgtacattcagtatgtgccagttgaacctgtatgtgggactggaattctgatttttaaaaataccttttctcaaagcctttctctggctctaagaagcttccagatctgtcctaacagcttgaaaaccaagatcttgactttttatagaatacttcactctgtgccagaaactgtgttaagcattttctttacctatatcatcaggatttagtcttcacaaaatactctaggacacatattattatactgattttaaaaggatggactgaggctaagagaaattaagtgcccgagttcatctagctaataagtgtcagacaggaatttgaagtctggtctctctaattctaaaacccatgatatttacaaccctgcaaggaagttggaaatgcatcttccaggctgcagttgtagttattgtgggcatttccttaaaggaaatggtgtcgagaatggttgttgctagccaaaatcagaagtgtcagatttctaactgctgagacttgcctgtcttcaccattctctggactcatttgagccatttgttttatgatccactcttctactaaaaggtggaactagaggtataacaattatttagtacttaattttatatattgttttctatttttataaattgctcatttatttgtctagctcttgtatatttcccattcattccttttcagataatgatgacagtcctacttactgcctctccccttcccacagcttccattcttcctgggaaaggagaaatcagaattattttgctctccccacttccttcagattcatccttatcactcatcactgatggagtttttacagcataattataaaagatgacattttatcctatgacaaacatgccctggttatatcctaactaaatggatgggtgggttttttaattaaatggatgacttaattttgtgatccagctgggaagatttcagttttattagcagctgtctttccccttttcttaccagaacttgagctattagcacctaactcaaaagagaaaatacagagtttgaagttattattttatacttcacaaatcctttcttctaaacattttttcttaggtgaggaagcaaacaaataactctggctaggatcttttaaacaaagctgttaatatttgcaacctatatccacatgacatctgaaagaaatgatggcttagctttagtcacaaatagagagtgctgatacgagtggaaatagaaagaaaagatgtatttttcttcccattaaaggttgagcgtggactttaaagggggaaattctgagtgattcttaaaacaacatgtgaacttttttatttcccccagacattagttgccaatatgtaaacatttcagcaagaaattttataccacctcctctgtttgtcaggcagcatttaatggttgaatgacagacagtgctgagccttggcagttccatagtgatgtgcaaatctggggattaaaatgacagttaatcagtggaccttttctagtataaactccatggccactatttaaaatcagttacttatcaacaaggcagacgatttttatttcgactttatgttttcgtgtaaagatttcacaacttttccctaggggtagtttctgttgtttggatgttagatgcaaaggttccaattcattttggcagtcttgattgcgtggattcctggtagtcattttaattggtatcttgcagacacgtgggagtcattcacacattgtttcctttttctttgtaggtagaaataacacttcaggatatcaatgacaatccaccagtatttccaacggacatgctggatctcacggtagaggagaacattggagatggctctaagattatgcagctgacagccatggatgctgatgaggtagctcaagcatgtctctgaatttgtgaaacttcgtagtgcagtgatttatcaaatttctaggatatgttgactacttttattacccaataattaaggttaagcatgtgtgctcctttccaaagaacattaattcttgaaatgtaacataaaaatgttaaaaaagagattactatcaagaggtaattttcctctgatcagcaatccacaactcacttgctgcttgcactttaggttacttagccaaattattttttttctttaataataaaaatatctaaagaggtatctctattttatgccattattattcccctttgctatcttatagcagctaaggattggtttttattttatttgtaattgttaaaagcaaataatttaaaactacagaattttaaggtttagattactattttctatatttatatattaagttcagctatgtaattattatgtttcaaatggcatggaaacaaatactttgtgatttgtatttttcttatgaaaaaaactccatagcttattttctctttactgggtaaggagtttaactaatgttctggagtttaaggaagagaagtaactttccagacaccagtatctccttacctctttccccttaagccaagccgaacacagaacagagaatttaattttcttcctctcatctaaactcagaaatatcagaaacttgattcctggcatatgaatcagtgctttataaatgtatttctgtaaccttaaaaatttaaataaataaataataaaataattttaactgccaatacagaaaggtaatgacttagtcatttatacattttgccaaaatctaactattacaaatgaacaaaataaagcatacacatttaggtaattgcaatttgctattagaaaagatacgatgttttatgtttagtacattctactcaattttacaatgtgaagttcacacttatttcaaatttagctagctttaaaagagttatctgacttaatatttctattgttgatagatatgtgatatcattagccataattcagtaaatatttcattttcttaaagtttatcattgataatatacattttgatttatcaattcataaaatttcattaactcttatttgaaagtagcagcaataacaaaaaactcatgtaattggcataggacaattgacatcaaataattgaaattgtaatgactatttcattggttatactctaagaatagagcaaataaaactcatttatttgaagtgatttattctaatcactttaaaagaatgaagtaataatcatgttaattataatagatattctaatgggatggctatttactccatggaatattataattagagtgggattatttaataggaattacaggaatcacaggtagaattgcatttggaaatttagttgttttaatcatcatactgctctcttaagaaatggttatttcagagattccaacactcaccccttttaatactgttctcttgatactgttataattttatttccttcccaatattttctctttaagaatatttcatgtaagtattagtataaatgcaatgctgccagcattcttatttttctccatctgacttccgtgtgtgtgtttgtgtatgtgtgcacacacttgcattgcctccaagttcatcttttaagctatgtttacctttatgatgagactagaggaagcctaggaaggtccttatacatctaggtatttagaccaacactggtttttgtgaatttttattttatttctactgagctttgttttttaagtttaaaaaaaaatgtaagtaaccttgcagatgttatcacttagacatgctagttaagaaaaatacagaatgtaaagtgatgatagctaggatatataagaagtacttttgagatgagacagagtcgggtattagggccagaaaagtataaggctataatgttggaatgaacaagagaattggagggaaggctgttagcaattcaagggtagagagggatgctgacaatatgtatgaggtgtgactgtgcctgaaggcataaaaatcaccacattcttataactcgatttgtttgtgtgcgagtgtagaaaggcagagaggatggaagggagtaactaggtgcacctacaacattaaaggaaaggggggcatttcaggaaaactacaaccattgttttttaaagaaaaagctcacaaagttgtttgtcttcttaaatgcatttttctcttaaacaatttaataacgttttaataactgctgactgactataactcttgacacgaggaactcacatgtctttggtttcatattaagtagaatggctgcctatggcatttagaattttgggctgttttctttttgttgttgtttttagttgcttataataaatattaatgcttttagataaacctttgttttattttctactttattctcagctccttacctcttagccaaattttggggaaaatattttaaaaattttctctcttttcaaatcctggctctgttttctttcttcatctagtttgagtaagactcgagattatgtaggtcatcagccaattgtgtagatttttaaaaattatttatatacttttcattaattactttacctaacatataagtgttagtatgctataggaactcttgtagggcactgtagaacaaagcctgggtaaaggaattacaattttataaaacaacatgtacatgttgaacttaatttagatatcatttgaaatgtgttggatcaagatttacatgtttcagaagcacatgattccgtttgtctcttgttcccttttataaattatgctagtaatgggctaggatactcaaactttgcttcgtggtaccatacatgtttttgaaaatactatttaaggttctaatatgcatttgaaatttatagctatttacttttagaattccttctatgtgcttttgtctctgtggttcatccggagagcagaatatttttaaccagcattatttccactgcagtgaagctgaaacatgatatttgtttcttgttttgttgctgatatggcatattttgaatatttagtaaatagacttttcaaaagacctaattaaatcattactcttggccagatattttcagacattcactaatattatgaattcaccacatcagctgattttgaatatgaaaaagattgttttttatcaacacagcctgatatgtttacctcttttcagaaaaattattacaactttaggaatattattatttattacagcccatttgtagacagggcatttctaaatatcaaaccatttttgtaatagcattaaataggtttttgtttcttttctttaccttaatttccaagtacttactattttcatgggtctgaattgaatgtagctacttccatacctcacccactttactaaaataatggaattcctagtgaaacagaacaaatgtacagagtgtggtcagatgagaattctcacatgcttattgaaagtttttgttaaaccataaaattacaataaatacgttagatattcaatgtacacctgaatatacaaggtaaatgtgggtaatgtcttagactcagctgttccattattaaatttaaatgtgctttgaggcattcattttactaaatgttaagactggcctgaagaatgcagtacaaactaacactaaatatagcgggaatatttttgctttagactgttagaaatcatctccttatatgtttgaccatgaaggaaaaaatgtatgtaagctatgatggaaaagatgtatggaaactgtggatgctgtaatcccccactgtgtcagctttacatgcctatacactccaaacttaccttcttcctaatattctcattgagagctctgtgtctttatattttaataaatacattctttgaggttaattacaataaatggtatatttgttttaggtaagtatattaaattaaagagtaatttttgaagtcaacatttctagcactacttatacctagtgtcaaggtcaataataacatataataggaaatctgatactgtattttcccatggatatatggcaactctagttatattttgatttaaattattcatttgcagaagtctaagtcatcaaataaatttaagccatcatgtttctcttataagaaaatagtaagaataagaataaaataacaactatcattttcctgtgcttactatctgtcaagggttgttctaggtttttaaaatatatgttcactaaattaacctccaaaacaatcctttttggcaggtaatattatcatcccagtgtacagatgaggaaacatgggcttggagaggttaagtatgtggtccaatgccacatgactaataaatggagcacaaattcaaccacaaaatatggccccagagcatcatatctcaatcagcacagggtatattaaacgcagtattttgattgtaatatacagaattaagaaatatctctcttccttcttcttctgccgatccttgcttctcttcttttttcccattccttcaccatcattcagtccttatatgagtgttcctatctctatctattctaatttaatttctgaacgactcttgtggcttcaactgacacccacataaaatgaccctcagatatttattttaaacctcattcccaaatctctaattgccagataaccatttctatgatgctattctttaatccctaaatacaccgcaaataaaatttcacttcctatttatcctgcatcaaagcaggtcctattcttgaaatgtcctcagtaagagtactctcttaattgccagccaaagtaacttgaaatttaaaaagacttttttttcttttttgcttttactttgcacatggggttgttaaaaaagtgagaatatatatggaaatgttgagcaaatgagagagctattagtattatttctattttcaataatctgtcaaattttactaatttgtcccatgaattgattcagagcaagacggccaggattccaatcccttaatttcttttaaaatgggcattctaatagtacttaccttgctagtttgcctttaacaaattaattagtgccctggaattgatgtgctcaaggtggcgtttagcagctagcaaacactatgaatattctatttttctctccgccatctctctagttcagaattttgagggtcacagctcaaagacctgagagtacgtaggaaatcacccccattttcattttccagaacagggactttcattttacagaactgtttcagcaacttgggggaaatgaagcctcagtctcttgggccccaactgtattcacaatctgccttctctggcctctccctacactagtccatactgcaatatcaatatccttaaaagattgcttccaattaaaacaatattggggttccttggctgtagaattgaggcaaagttgtgttatatttgaagttctcaaaaaatataccgatactctaacattttagcttgactttcttcttttgttctatattaaaattgtccactctaacacactgttcaacagtaagccaagtccatgaatagtgaatgactgtaaaatattgtattcatttgatacgcttttatttttattttattgtgataagaacattaatgtgagatctgcccttttaaaagatttctaaatgtacaatacagtattgttaactataggcacgatgttgtacagtagatctagaaattattcctcttgcataagtgaagatgtatacccatggcttataagctcctgatttctccctactgtctgtcctggaaaaccaccattctactccctgcttctatgtgtttgaccattttagatacttcatatatataaatacctaccaagcagcatttgtccttctgtgactatctaatataacatccttaaggctcatccatgtagtcacatatggcaggatttcgttttgtttttgagctgaataatattcctttgtatgtatatacaggttgagtatttcttatccgaaatacttgggaccagaagtgtctcaaattccttttttttttttttaaattttggaagttgcattatacatgctgatttagcatccctaatctgaaatgtcaaaatctgaaatgttccaataagcatttcctttgaacatcatattggcacttggaaatgtttggattttggggcatttggattttggattagttttgattagggatgctaaacctatatcacctttttttatctattcgtttgttaatggctatttagtttgtttccaaatcatgaccattgtgaaaaaaggattgctggatcatacggtgattctatttgttatttttttgaggacctccatactgtttttccacaacagctgtatcattttgcattcccaccaacagtgtacaagggttccaatttccccacttcttcaccaacacttgttttggtttatttgttatgatagccatgccaacaggtgtgaggtgatttctcattgtggttttgatttgcatttccctgatgattagtgacactgagtattttttatatacttgttggcctttttttttttgagacaagagtctcgctctgttacctaggctacagtacagtggtgcgatcttggctcactgcaagctctgcctcccgagttcatgccattctcctgcatcagcctcccgagtagctgggactccaggctactggctaatgttttgaatttttttttagtagagacggggtttcactatgttggccaggatggtctcgatctcctgacctcatgatccgcccaccttagcctcccaaagtgctgggattacaggtgtgagccaccacgcctggccacttgttggccatttttatgtattcttttaaagaaacatctatataagaccttaaccatttttttattggattaccaaacttaatagctattatgttgtaggacttatttatatattttgaaaattaactttctatcagatatacagtttgcaaatattttctcacatcccatagattgccttttcattttctcgactgtttactgtagagaaactttagtttgatatactttcacttgtctgcttttgcttatgttgcttgttttgggagtcatatacatgaaataattgcccaggctgtcttttagcaattttcaactaggagttctatagtttcaggtcttaattttaagtctttaatccattttaaattgatatttgtgtataatgtatatttacattcttttgcatatggatatccagttttcccaacaccccttgttgaagtgactatcctttccccattatatatccttggcacccttatggaatatcaattgactatcatgcatggatttatttataggcgttctagtctgtttggtttgtctgtatgtgtgtctttatgccagcacaatactttattcattactgtaactttgtagtatattttaaaatcaggaagcacaatacctctaactttgtttatctttctcaagattgttttggctatttaggctcctttgtggtttcgtatgaattttggaattgctttacctatttgtataaaaaatgctgttaggattttgatataaattgtattgaatttgtaaattgcatagataacatggacattttaacaatattaagtcttccaatgcatgaacttgggatgtctttccatttgtttgtatctttgttgatttctttcagcaatgttttgtaatttggggcatacaaagcttttaccgccttcgttagttagtaagtttatctctcattacctgtttaagtcttataatatcatatgaacttaaagccaaaaagccttcctttgtcaaatacatgttcaaaagaaaatataaggagcaatgcttttctacttccaatagctcagatgcttggtctctttttttagggtgcaaatgctctcgtcacatacactatcattagtggagctgatgatagttttcgcatcgacccagaatccggagatctgatagcaaccaggcggttggacagggaacgccgctccaaatattcactgctagttcgtgctgatgatggtcttcagtcctcggatatgagaattaatatcactgtcagtgatgtgaatgaccatacacccaaattttccagacccgtgtactcttttgacattcctgaggacacaatccctggtaggtgatgggtctcttatgtgtattttgcaagaatcgcttttgaaccaaaattacatactatgtttcggctgctcttaatcaatgattagtttttaatcatatactactagttataaaaatatatatgctggattgttggatcttttcattaacgatctttggtaaaattctcaagcaaatggctaaattttttaggatgaatgaggttagccatttatgtgtctgaaagtatttgtgacatgggttattaattttctgtcaatcacagttttggtactctttctgctttaaaaacgtctaatgtgatttgggggctatgtataaaaagaacagcaaaaaaaaaatacatgaaaaactgtgaatattgattctaacgctcactagctgtgtgaccaacggcaagttaattcatttctcttagtttcaattctctatcctgtaaatggaaacagtaattcctgttagagttaaggtaaaggataatttagaaagtacattgagtttgctaacacagggcttgggtattagcaaatgcccattaagtgttataagaaactgaatctttaattataatcttgcttctttgaacatattatattgtgattttttttagtctgagtactcaatatccatgtttctggtgtgtgtgtgtatgcttcattcccattattggaaatttttatgtaaaattaaaattttattctgaattacatttggaatgattattcatgataagccatacattttagaaactccatttggcaaaggaattaaacatctacaggagactccttctacctgaagttttttcttcactcctcaagatatcttgtgcaagtcctttatggaaatcccatcacacttatttcttgacttagttattgcaatgaccacataagttctagagtagtatcaccagggcataagtctatatattttttggaatcctcagttcctgacactagcaatatgctaccttaaatgttgattgaattcatcagtatatttatggataggtactgctagatggaaacataacatcagatatattattaattcctcaggaaatttatgctgaaacctgaggtccactggatatctgatatgtcacatactgtattcaaatagggaaatggtaatatcaaaatctgcagaatgttatgttcactgtattttcatagcggttttcagttaagatattttactgtacaaatacattttttggtctctttctatatgttctcttagtaatacttcttacttccttgattttatactattaatttattcttttgataggttctttggtagcagccattttagccacggatgatgactctggtgtgaatggagaaattacatatattgtgaatgaagatgatgaagatggcatctttttcctgaatcctattactggggtctttaatttgactcgattattagattatgaagtacagcaatattatatcctcactgttcgagcagaagatggtgggggacaatttactaccatcagagtttatttcaatattctagatgtaaatgataatccacctattttcagcttgaattcatacagcacatctttaatggagaatctacctgtgggatctactgttcttgtgtttaatgttactgatgcagatgatggtatgtattttatttaatataatttttaaaacatctataaactgtcatcagatttatattacatttatttattgtgttgagctgtcacaaaaatgcattttgtgaatataggttggaagttgaggaatagaattataactgaactgtagaggattttaaaaattaagtactttatcggttaaattcttatttataacagaaaacataccttgtattgttttataaactttatcttatttttccccctaaatgtagggtcgtgtttcaatttagcaatgtagaagtcataagaccacttttttttgtataattttgttagataaataaaaatattaggtttacatatgttattttaacttgaaaaggatagaatttcaaagcaaaatgaaaccaaagacttaagtaaaaatacttacgaatgcaaaaactaagtttcacatttttggctgacaaatagctaataatttttttttttttttgagacagagtttcactcttgttgcccaggctggagtgcaatgatgcaatctcagctcactgcaacctccacctcccaggttcaagcaattctcctgcctcagcctcccgagtagctaggattataggcatgcaccaccacgcctggctaattttgtatttttagtagagacggggtttctccatgttggtcaggctaatctccaactcctgacctcagatgacccgcctgccttggcctcccaaagtactgggattgcaggcgtgagccactgcacccagcccagctaataatattttaactaggtttcatttcagctcgaacagtctcagatctgtttaatttatgctaatgatcaagttaaaattttgcattaaatttatactttacatgtgtttgatttgtatttattgcaaaagcaattggcaaactttattttaatagctgactcctttggcctttcttctaacacctgttttgtaagtatacatatcatataatatagcattagagaaaacattgtatggattatcaacctttaactgaattgtctggaaaattagtacgtgtttttcccttatgttggatgcaactaaattgtctcatcaatatataaaacaagggacagtactttgaagaagaaataggtctctattgacaggcatatctatctcaatttagaattgccttattcttatgacttggatgatttgtgaaatctcagaatactattctattttaacattctattctatacttactttccttctcatagtgtctataaatggcacttggaacgatatgagaagcaaaaaggacagtattttatatatgtttcaataagtaaaatgggaaatactttctttagaattcattgagtaagagcattttgatgtttcctcctctaatttaagtgcagttaaaattgggcacaaagatatatctaaaatagatacagctgtaatgctagtactactactattactactactgttgctagtaacaatactttaatgttaacgatgttaataagaatctcaagaactgacatctgccaagtgttttgcatgtacccagtcctggcctaagaacattgcacactctatttcatgtacctcatcccaggtctgtggattggctccagttagatatctgtatataattgaggttagtccctattttggagattggtttatctgctataacttttagttagtctacctattccatagataagaatattttcaaagctaatcatgtattcttatttgtcctgtgactgtgctcaacttttctacagagaagaattttccaccatgtttctttttgatttattagttatgtattagagagagcccattgtttcatagaattgtatgttttcctggaataagttttatttaccatcataacttaaaatatagggaaactgcgaagataccaaaaaattaaaaagaaaaagaaaagaattttgtttgtcaaaaacctgctggaatattccatgcacatgtaagcacagaaatacattgaccattgtctctaagtaagtttttgtgatattttttctttaattgcattgagtaaaagtttcaagctatatttattcattgttttagttttgaatacgtttatcagtgtaatttcctgcaccttgacataaaatatatgacacaattcctattctttctgaatttcaaggacagtgataaggctatacaaaggtaagcttgtttgtaaaactttccagctcagttacacaaaagggtctcaagtgtttcacagacaatattagtcagacattttttaaaaataacaaattaacaaataaatctcaatcactgatcagaaggttccaatgaggtaatattgtcatctttttagatgaaggaattttatatgaaaataaatgtcacaatctgttatctgtctatggattctgtcagagtttaaaatttagcttacatgatgatttcataaacataaatcagatcttttactgttttcacaagaagggtaatacctctgttagcatcaagactactaagcatgcggtattacattgaggaaatatcggagcatcacggaaatattctggctttgatggttatttcgttatcctataaattatttacactttaaatattgggaagtcatattaaaatgttttgctaataatacaattggaatttttgctgaataaatgtagctatataatattggtgtacaatacagaccattgagtttcatatattccagtgacctgatgaccttgttgaaactgctttataaagatgggtgttattcaaaacacttctatgtgttgcagctatgtgaaaagttgacaaatattagttctttatagaaattagaagataacatttatagattgtgagtaaatatacatattttatagcatgaaactatacacctatacttttaaaatatattttactatttatatatatttttatatatttataatatatattttatgtgctgtgcttcttagaacaaaattattcatgagactgaaatactatatatagatatctacatatctatatatagtgtgtgtgtatgtgtgtatatatatatatatatgacgaaaccataaaaccatatgtatgcaataaaactgccaggaagagtcatgtaactaaatgacttggagaacattgaacacaaatggttcacagtgggctgtttgaagtttaaagatctggtgggccattaaagcccactaaatttaaattgcaacacttatggctaaagcttagaattcaaaacaatgtaaaaataataattttacaataatgtgtttactgtctcatggttcagatatttgttgaaaaaatagaaaaaaatggtctgagcttagtatttttcagtatacttcaaatattccgggagaaatttgagttttgctatgtctgcatgtattttttagatgtagtgtatgtggccaaagtcactttttagacttgtcagaaatgaaaagttattttctttacagtaaagtaaatgcagatggattccatgacctgtaattgcagcaattaattttcagttcctgagatgagagctacttcttctataatatggcaatattttatgtaaaaatagttatattttttatttgtttcatcaacaataatcttcagtttatttttaatgttgttacttaatatatttgtcattatgtatttgaatataaaagcaaatttttcttttgttatacttttagttagcttaaaatttattacttcccttacccattcatctaccaaactttttgcctttataaaagaggctgttctgctgtttacaacaacgctataaaattttgggatcgtgttctctttttgcctctgcaatttagctgtttactcaaggaagtagcatacatgatggactaaggatgatcagatacttgatttaattgctcccattcctgttgatttatgtagaaatgttaggccatgtaaaatgtcagtatttttaatgtattttgatcttagatatgaaagattttatatgcttctctagaattaaattttatatctttgcttgttggtatttattttcattcatgtgttttcataactgcatttctcaataatagtcatgtccccaaaagaatggggattcaatatttactgatgaacttttttgtaggaaatgcagaaaattttcttaaaaagtaattaaacgtaactatatatgtagatgttaatagaaacacacgtatacacataattaaaaataaattctgtgtgtatatatagatactcaaatatgtatatgttataatgtttgagtaaatatatatacacacacaatataatgtatatacgtatatttacgttgtaatgaaagtcctaaaagctttatatatatatatgtgaagatagtggaaatttttatcctctaaagcctgtggaattttaagacaaggggttgaaataagctgttaaccttgttctagtcagattctacaattctgtttctttcctgcgggtgaattgacctctgacacctattagctttatttattcatatttttcctgatcttcagactcctaagtattctgaactttgtaatctcttccttgttcacttgtgagtagtcttaaataaactataaagattaaaagtcacaactcataatgagggggaaaaaataaactacgctttcaacgatttactcaatcattgtttatcctagaaatttttgttaataagtcattgtctgaaagttatattcataaatatttttcccatgtttcaaattaggcaaaggatattagagacagtaaagtcacagaataagagtaagtgtggcgtttttaaaaacattgagttctacatggtagaaaaaaatctcatactcaagttaaatttgacttcttaaagaacttgatgaagttcaaaaaaaggcaaaagttaactgaagtattgatagaataatgagaaagaatttttttaaagaaaagagtaaaagggtgattaaattgttctagacgacttttgccaaaagtgaacatcacttctcataggtagaattcagaaacctggatagttgaaattaatgttagaaatatagaagctaattgtaggtaattcaggttagtcagtagatatttgctagtcccagaatatacatctttattaaagatagattacctggatgtacagtacgtttttatcataatatcctgtaatttttccaatgtcattaggataagatataaaaatgcacatcgttacaggccagagaagaaaacatcactctgaggcagaaactgacttctttctgttttcactgcttatttgttatttacctttagttactaaaacagtaagatgatgtatatgctccacatcatttttgttataagactctctgcaatcattttctgaagtgaggatttagaaacaatttttaaactaaaaaatgacacatgatcctaagaaaaatcaacagtatctaaatacagttcaataatagcatgagcatttatatttggaaagttttatgtataattttactgctaacaatttctttaaaaatactttttagaaactttaaatatgtttaataaaatttgaaagagaactattgtctcaaaggtccattacttagctagacacttaataggaattaataagtatttattgattttgacacgaaatatagaagtacacttacagcattcatgactaatgccatacatcagaacattttattaccctttcttgaaaattggtgtcagcctccctaaattactaaagttacaaatgtttgactaatagtatagcgtgtggcactgttagtgttggaccatcaggaattatgtgatagaaacaaggaaatatatagaaaaatatctgctctctggaatatttttctcctctttacttttgtaatttaacatttcaacaccctagtaaatagcaagcagtatatagatcatttgttcacaggatttcctaaagtgtgtttggatgcacggcatatcaaacatgccaaattacttgctaaaagttttggtatagcttgttctgcaatcagcatatgtttaagaaaattttttcttccctttaatttcaggcatcaactctcaattgacttatagcattgcttcaggtgatagccttgggcagtttactgttgacaagaatggtgtactcaaagtcctaaaagctttggatcgggaaagtcagtccttctacaacttggttgttcaagtgcatgacctgccacagattccagcctccagattcacaagcactgctcaagtctccattattttgttggatgtaaatgataacccaccgacatttctttcccctaaattgacatacattccagaaaatacacctattgatactgttgttttcaaagctcaagcaactgacccagatagtggcccaaacagctatattgagtacactctgctgaaccctttgggaaacaagttcagtattgggaccattgatggtgaagtgaggctcactggagaactggacagagaagaagtttctaattatactctaacagtggtggctacagacaaaggtcaaccatctctctcttcatctacagaggttgtagttatggtacttgacatcaatgataacaaccccatctttgcacaagctttgtataaagtggagattaatgaaaacacacttactggaacagatataatacaagtgttcgcagcagatggagatgaaggcacaaatggacaggttcgctatggcattgttaatggtaataccaatcaggaatttcggatagactctgtcacaggtgccatcactgtcgctaaacctttggatagagaaaagacccctacctaccatttaactgttcaggcaacagatcgaggcagcacacccagaactgatacctccacggtcagcattgttctactggatattaatgactttgttcctgtatttgagctatctccatattctgtaaatgtccctgagaatttagggacactacccagaacaattcttcaggtcagtatatttaaataaagcaagtattgtcttaattataagacatctatttgaaaacctcccctcttctacagcgtttacgcttcccctgttctctcctcattctcatccataaatgctcaattgcagatacagcaaattttgaaaaggaaaggtttataaacatcatacctaagaacctcttaatttcctcattgatgaaacttttgtattttactagctttcttttgtgtatactcatgttgcacacatttatgtatttgtgtttttgaattttgttccacaaggataatatctgcacatagtaaaaaactaaaatgatggaaatgtttgaaacttcgttataaatattgttctactcttttccttcatatatttaactacctaggtgaaactgctcttaaaaatttttatgaagccttccaaaaatgctgtgcattagctttacacatatttttacacaaatagactcgggtgatatatactatagtgtgccatttttattttttacttgaaaatctaaaaatatatctttggaatctcttaacatagttttacctcatttttttttaatggaggcattttatttcatgagatgcattgtttgttttactcacatcttggtatgtactgttctacaggtggtggcaagagatgatgatcgaggatctaacagcaaactctcatatgttctgtttggtggtaatgaagacaatgcttttactctctcagccagtggagaacttggagtaacacagagtctggatcgggaaacaaaagagcgctttgtcttaatgattacagctacagattcaggtaagtccattacacccttgttcatttgtagataatttctaggccaggcacggtggctcatgcctgtaaccccagcactttgggaggccaaggtggatggattacttgaggtcgggagttcaagaccagcctgaccaacatggtgaaaccccatcactactaaaaatacaaacattagctggacatggtggtgcgtgcctgtaatcccagctactcagaaggctgaggcaggagaatcgcttgaaaccaggaggcggaggttgcagtgagccgagatcacaccactgttctccagcctgggcaacaagaacgaaactcgtctcaaaataaacaaataaattaaataataataatttcttcataatatgagtatgaagtattttctgtttgccattaaatgaaatatttgttcacttttactaatgcttgaaattctgattgcctctatgttattgatggcacatcattcactttatgacatttatatataagtggcaagggcttaaggacatcgccacctaagccctattcccataaaacagaatgaattgttgccctataagcttattgagtacctctggatgtgaccttacactctacttcctgagctaggggcatttaaagtactttagctttggaaacatgtagatggttccaaccacttctcttctgatagacatgggtgagtgagtctgttaggaggagctttcactagaaggtggctcagtattcagtgaagcattggtctaaatgtgcaggctgctcaagaacaaagtcctggttccagggagccaaactataagttcctgatgccatcagccttgaaaatcagggtcagggggaaaccaggacttggaattattagtataagtataaataacagaagtctaaccctaatttctattaaataagaaatatgcagatcagatgtgtgaagattctgcccaatagagttatggaggattctaagttatggagggtgagcaatcagattatcagtaacattatgatatgtggaagcctgtcactcaaagctttaaaaatgatgctgaagaccatgatgggaggcacaaatgagtttcagtgacattagtgtcctaagtcatggtgttttggcagctctaaaaatgaaagcattaattaaaccttgtttcaaagcacagctctctatgggcactgtttttcgagtcgctctgaaatagactggcatttctgaggccactggtggataaatactcaattagatgtctgaagttcacttttatgagtgatacagaaaacagaagttgtgaggaaagttgaactgggtgatcttgaaattaattcccttggatactcttgatatgaataaccacttttttcaggagaatgtgagttttagacatccggttttagaatctacagtttaatcttattttccaagaatgagatctttgacagaggacttaaattacatattcactgttttcattcaaaagtcaaacttgtagatgacatgagaaatttcggaaaaatatggcagctattagatcccagatgcaatgtttttctcaaatctgtagtgttctaagggcctggaaaatatcaaagtgtttcaaaaaaattttgagagtttaattctttatctcacaaatcacctttcctttgcattttttttgaactattaccttagcccagagataggtcaacttcatcagtatggcacagattgcagtggcagtttttaatcatgcaaaccactaaatgtttcaatgtgggagggagaaaacattaccatttaaactctcatcatatttttatttactgactgcatggttacagagtagcacatttggaaactctaactactcctgtctactgctccagtaagctacaaccacagtatcatatgtatgcagtgctaaaagttacattactaaattacaaaaccggaagagggtataataattatatctcatttttcctgtagataattaaattgctaaacagactacaattccattactgatgatatgttgcttagctataacagaaagtatggatattcggccttcattatgcattacttatagttatttcttctggaaatatttactgtaccaagtagaaactcataggaggctaacacatccacctggtatagtaatgcaggtactactacatggtttaaaggagaatttgctcaaaagcagttatgtccttcatatgggttaggcattctactcctaagtagcctttcttacaagagtttgccttaccattttctcatatgtgcaataaataaaataatgttttaaatggagcaagtagcaggaaattatcagggaaactagaagagtatactttaaaaaatgaattcagataattaatttagaaatggaagtatatcatgtagttaaatacatagactttatagttaaaccccagttcacatcctacctctgacattcccagctatatgaccttcaacaactttactattccttcatgtttgtatctatgattggaaatactaatatctatatgaaagtttattgatcaaatagataaaaaggaatacttattctagctattaatgtcagtcagcatgtttactagacatttcaagcttagtaaggccaaagtaacacttttgacttctattcacctccctaccttaaatgaattgcttcatagatcatttcacaattgctgaaggcaaaccttgttattattcttcattcctcttcctctgtacaccatatccaacaaattcattaacaaggagactcagcttcaaaaatgtccaaaagtgtcctgaatttatccacttttctttacctccaaaacgacctccttagtctaagctggggtagtatgatagcttgctaactgcctatcttttctcctgcatggtgcattattcaacaggcaacccaagaacatttaaaactataaattagataatcataccctatctcttgcatagacagcatgcagtgatttctaagaataaaatttaaatgtcttaccattgactacatgggattcaataacttggtctctgtccatttatctgaacccctccaccaccaccagctgccacctttattttgagccagagtcgtgcactggccccagctcaccctttgtctcctgtcagttctgcatttagtatcatcacattattagattgtaattggccaacatggaagtatttacaccctggaaatcagtaagtgctttgaatgtagttggcctgtttcttgaaagcagttgctaaacatttactgaatactgccaatgccaaccaatcaatcaggcttccttaaaaatgccaacctttctgccatgttggccttttgcacttgtagttctctctgcctggaattttctattctacagcgagctgtttggtttggtttggtgagggagaagggcatccatgtcatggtcattttgtcattattttagataaaatgtcaacttctcagagaggacttgtctgaccagtaatgttatgtttgccctttcccttttcccagtgtcactctatcaacttcctctttatgatttcttaacacaaattcctatctaaaattgtgttcttctacataaaatatatgagtatatagagtttgtttaccttatccttctctatcagatttccagagaaagtaaacttcctaagtcttattcaaaatgggattctcagaaacacttagaaaaggacctgcaacataataggtgcttaataaatatttgttgaatgagtaagttatatatgttgaataatgatagttgtcatttgaaagacaacctattattttaatatgcaactgttatttatatttatttaacatacttatatttagtttattgttatatattcattgtttgcagatttttttaaagaaacttccaaaagaaaaaagtgcaaatcatttttaattcatggctgaaattccagaagtttttgctacattggctgtggtcattcaaagtgacctctcttttgaaaagcagcacaagtgtttaaagctttgtggtgtttagtgtgatgtgacaaattgcagtcacatgtaaggacccagtgaagcattttatggctttaattcagtttcaagtgcttaaaatactgcttgagctatattctcatgactttcccctgaaccttctggctctgattcaattctgttatctattagacgtttctagacaggtcgtattgctactctgtgctttactatccaccttttcttactctggttcataagatttaattcaaaacctgcatgagcagaaactacatgcttctgaatagtttttgtttgtttgtttgttttggagagggagtctcactctgttgtgcaggctggtgtgtagtggcatgatcttggctcactgcaaccttcgcctcccgggttcaaacaattctcctgcctcagcctcccaagtaactgggactacaggcacatgcctggctaatttttttttattttagtagagacagggtttcaccatgttgccaggctggtctcgaacccctgagcacagacaatccatctgccttggcctcccaaagtgctaggcgtgagccactgcgcctggcctgaatagtttcaccattcgacaattcttttatacctggttttcccaaagcaaacaattgtgaatcttccatatctcccacatatctaagcactttctaagcacacgtggcaattggtttcacatagcttaaatataagggcccatcatttcacaccaacttaatatgaaaaatttgcttgttttaaattttattatggaaattttggtgttcacataaattattccaacagatatatacttacgcaagtaatttgtccagaccttttagaatttttttaactcaagatgagattataccctcaaaaataaatttaaatgctgtgaggcattaatatctgccactactctttcagggaactgaattaatgtgcgagaaagcagtaaaacaaactggtatgacactttggggatgctacagttatactcagaggagtttttaaagaaagctacatatgaaaaaattctaagttagagaaatctgacattaagtgatggtttttttttggccaggaggtttcttggagatgagccagtccacttcctttattttccagataagaaaattgaaggctgggatagataagcagtgtgctagaacttgcagacccaggtagtagcaaagtcaggtataatatttagaatttctgcctttcaactaaattcttgctcatccatatcatatttattaaatttttttaaggaaatcaggatattccttaaaatatattgctgactctctccatgaaataaatttataaatatgcaatttaaaaaatattttcttttttactttattcatttcactttaataaatgaaacattcaactgctatttttctttccccaaataaataaatgtttgaaaacatttttaaatgaagccaaattaagtggaatcagtaatttcaatattggtattttgaaaataagcttaaatttagacattgtttaaatttaattgttaaataaagaagatataaagaatttgttaggctttatgcctagaagatgataatattggtaattatcactgccaattatcattttgcattaattaaaatcaaactatggtgctaatttaatgcactttataaataagttctgattacagttagtgatatggtttgcctgtgtgtccaccaaatcgcatcttgaattgtggttcccataatccccatgtgtcatgggagggacctggtggaaagttattgaatcatgggggcagttacctccatgctgttctcctgatagtgagtgagttcttatgagatctaatggttttataaggggattttccccctttgctcagcacttctctctcctgccaccatgtgaagaaagacgtgattgcttccccctccgctgtgattgtaagtttcttgaggccttcccagccatgccaaactgtgggtcaattaaacctctttcctttataaattacccagtcttgggtatgtctttattagctgcatgacagcagactaatacaggttactgatatcagagagagtagggcactgctgtaaaaataccaaagtgactttggaactgggtaactggcagagactggaacagtttggagggttcagaataagagagaaaaatgttggaaagtttggaacttcctacagactttttgaatggctttgaccaaaatgctgaggtgttatggaaaatgaagtccaggctgaggtggtcacagatggagatgaggaacttcttggaaactggagcaaaggtcactcttgctatgcaaagagactggcaacattttgcccctgccctagagatctgtggaactttgaactggagagagatgatttaaggtatctggcagaggaaatttctaaatgacaaaggatttaagatgaagcagagcataaaagtttggaaaatttgcagcctgagattgcaatataaaagaaaaacccattttctggggagaaattcaagcccactgcagaaatttgcatgagtaaccaagagctgaatgataatcaccaagacagtgggaaaaatgtctccaaggcatgtcagagaccttctcgacagcctctcccatcacaggcctggaagtccaggaggaaaaaatggtttccttgggtgggcccagggcacccctgctgtgtaaaacctagggatgtggtgccccacatcatagtcactctagccatggctaaaaggggccaaggttcagctcaggctgttgcttcagagggtacaaaccctaagccttggaagtttccacatggtgttgagcctgcaggtgcacagaggtcaagaagtaaggtttgggaacctccgcctgaatttcagaggatgaaaataagcttaaatttatacattgtttaaatttaattgttaaataaagaagatatatgcctgctggggcattgcctcatggagctgtgagaagaaggccagcatcctccagaccctagaatggtagctccactgacaacttgcagctatgcacctggcaaagctgcaggcactcaccaccagcctgtgaaggcagctgggagtgggactgtaccctgcaaagccacaggggcagagctgcccaagaccatgggagcccatgtcttgcatcagcatgccctggatgtgagacatggagtcaaaggagatcaatttggagctttaagctttaactgcccctctgcattttggactttcaggggcctgtagccccttcattttggccaatttctcccatttggaatgggtgtatttacctaatgcctgtaccgtattatatctatgaagtaactgctttgcttttgattttacaggctcataggtggaaggaatgtaccttttctcagataagactttggacttggacttttgagttaatgctgaaataagttaagactttgggagactgttgggaaggcatgattgtgttttgaaatgtgaggacatgagatttgagaggggccagggacagaatgatatgatttggctgtgtgcccagccaaatctcatcgtgaattgtagttcccttaatccccatgtgtcctgagagggacctagtgggtggtaattaaatcatgggggcagttacctccatgctgttctcctaatagtgagtgagttctcaggagatgtgatggttctataagggcttcaccccacttcactctgcacatctcatttttctctctcctgctgccttgtgaataaggacatgtttgcttctgattctgccacgattataagtttcctgaggcctccccagctctgggttaattgtgagtcaattaaacctctttcctttataaattgcccagtcccaggtatggccttatagcagtgtgagaagggattaacacagtcagtgagactattatacttctatgggcttattgatatttaacaagtctcttaatattgctttttcacaaaatgtttatagagcactctactccagatattcttctaggtgctgaagataggctggtgaagaggtctctgtctttatacagcttaaattacaatcacaaaaatagacagtaaaaaataaacaatatagtatatagattgggagtgttatgaaacatgatgcggttaaattaactggcgagagagtgttaagtacttacgtattttacccattttgaaagttgaatctttggacttgatggtagaatcggaaggataggaagctgcaaaaaggcacgaatcaggcatgagtcctagaatatttggatgaacaatttggagatggggagaaaaaagattttagggcaaattaccaagacttagtttttggacatattacgtttgaaatattataactaattgagatgtcacgtagaaagttaaatataaaagtttagttctcagggaagacattcaagtagagatacatcttagaaagtcataaacattagatgatattcattatatgcacacttagtgcttgtaagttccagaatatgtattatattatctcatttaatctcacaatagccctgaaagttagggactagtatctcaattttattgatttataaaacaaccaacaaaaatttgtgttataaaaactaaacaacttgtactgcccattcagctgtttgtcagtgactacaggatttgaggccaacccacttaacaggtgatgatttcttaacaattatttaccaattcccaaatgtcagcctgtctaccatattctgttttatatagactatgtttatacgaatttcttccctttggattaaattttatttttatattaaagagaacattggtttaggaagcaaaaaatcttgtggttctctctaagtaaaatagctggtaaagtcataatattcatgaattagaaatcacagcattattcccctcaataaataaaaaatatgtatccaagggttttattaagtataaagtacaaagcgaatcttagatattatactatgaacgtacaatacatatgatatgctcatacctgcatagacaatgcagttagttgggctgtatgtttgcattgaatttgggggtaggagattaatctgcgcacaaattaaatatgttatcctttatcctttatagataattctcagtctgttgtactaaagggatatagagattctgtctctagatttggcacaaaagtttagttataaagtatttgtgtgtcagcataaatagtaggtcttcagggaacagttcagttattagcatttctaattaagggcatttatcatccaactgaaagggaatatatttcattcttatgcagggattgaaaattgctttttaatggagggaaacatgctgtttttgcaaagttaatgctaaaagctaaaaggagtgatcatcatgctttattttattggtgagcacctggtaacattttgaattgttgtctgtcacattatttagttgaagctggtcattgcattataaatggctctgtaatcaaaagagaggtcagaattgtgtaatatgacattttacatccgaagataattgtttttaaatattccagaaagatcacattttgtcaatattatttgtgggaatgtatgatagaaaagtttgccttgtctgttatgatcaacatttttaataatgaaaattgcttgaaaacttttaaggccccaataattctataaatcaaatcatgctagagttgccttcaattaccagacatgaaatgcatttgacttaattttatttttgagtctcgggcagcttttgttatttccattggcatatttgtcatagatgggaatcttgtttccaaagttgataactggttattgttttaattcctcttatttgtagcagactttctatgaagtttgttagtgatctaaatattattctaaatcatttatttaaatagcattcttttaaatcagctactctttagtcagaaaaaaatatttctacatagaattttatttgtgttttcttaagataaaactccagaaacatttaatttccaaaattccattgaataagagctaaagttgccatcaggttccatagaattgaaatttgataaaacagtttcaatctattatccatttactccatgtgagctacaaatctgagtatacaaagtaaattaaactttgaaatggcaataaactatgattaatatttatgataaaatttatagaaactgaatgataaagattatataaaatcaaaaccaacatgatttcattatgaggatttcattattttcaaaaaagttttctaattctatctttttgaaacaaaccttttttaaagcttattttgataagtattcttaaatatataatttgatattttcactcaggaggcaggcagaggtaggttgagtttaaaattaggtggtagcctctagtgtttcagagtttcaataactgtgttgaaatttttgggtttctttaatgtcctccaaatagtaattcctcatatgtgctttttgcaggcataaaatatttggttattattattttttattttataatttttaaaaattatgataagatgtacttatcattacatttctcattttaacgattttttaagtgtatggtttagtgattaagtatattcactttgttgtgcaatttttcagtggcattgtcataactttactaaagtaattattttagttttacttcatgcctttatttagtatgtaatttatcttaaggaaatatagtgtttttgatagattcctatgcaaaaataatgaaaaaaatattaagtgtgtatatatctaatttatataagcatatatgtagaactaattagcagcaatacattattttataaaacagaatttttaaaatacagaagtgttgttaatatttaaattgttacataccttttgttttatgtattttttgtattcaaattttaatctaaccacataatcttcaatgctaatataggatgactgaatttcaatacattttttagtggatggcttacttactgtgagaaaaatgagtttacttcatggggaaaaaaagaagctaatactttattacaacaaacacaccgctagtcaggggacccatttaccaaatatttgatgtcaagaaagaaaatggctttgttgcaaagcaacagaattaagttaagcagaattctatttctgctgaatagccttttatgtttcagagaagtatttttgatttatagttgctattataaaaaatataatcttcctgacatttgaacttcaatcgtttaaactcattcattacacttattatctgtgtatattctgatagagcagtgacctgaaacttttttcttttttcaaatcttattttaagttttaggccaggtgcggtggctcacacctgtaatctcagcacttttggaggctgaggcaggagatcacttgaggtcaggagttcgagactagcctgaccgacaaggtgaaaccccgtctctactaaaaacacaaaaattagccaagtatggtgacacatgcctgtaatcccagctacttggaaggttgagccaggagaatcgcttgaacccgggaggcggaggttgcagtgagccgagatcacaccgctgctcttcagcctgggcaacaagagcgaaactccgtctcaaaaaaaaaagtcttattttaaattttcttgaacttcatttgatatatttgagctgactaagctaccagtcttaaaggcaatgctagttattagtttaatggtttttcatacttaagagtataaaatgtgactcacacaaggcccagggttaactgtggtatcataaataattggaagattaacctgtgcacagtctctctctctctctgtctctcttcccatgagtgtgtgcatgtgcacaatttggtttgtgtaaattttaagatatgccattcagaatttgggttttcttttttggctattttatgtgaaaactgaagaagaattttatcactttttccatgtttatgttatatttatgtttatatgaatacatatgtgcatacatatgtacacacactacatacaactttacaaatttaaatttgaaattttttcatctgactactaattgtaattaggtttttgacttttcactggagttctgacttctaattcaaatatccactgcatcttcttaacctctacaattacaagtttctgagaccttcacttttaattttatttgtatattttacccctttcattggctcactgtcctctatcaggagcccgtgtcattatatcctgcctctttgtgattgcatctggttttcataaatcaatcccaggtggaattgaacaattttgccctattacaccactacctatataattcatcattatcagatctatttgagctaaacattggccctagtattctgactcttctcatgggattcacgtttaattgggaccttctgtttctaagtagtacactatctgcaaaactttgacctttgtctgtagtcttgttctctgaccccagccttaggctaagtcccagactataaaagtatagtcctagattgtatatttctagaagtgttcaattatgtgaactttcatccatgtagaccaggttttcatatagaaaattagagaaagagttaatacagacagagcacaagacctaatggtatgcattatgggctaatataaaaattaattaaacataattattcctgttttcaattaacttataacttaataggacgtgactggagtacgttgataattataataatatagagcaaaacatctgcaataagagtggcagagttttatctgagcttaattaacttagaaaagattttttttaagaattcaaaactggctctctgtctattctggctaaatggaaattggttcagttctttgggtcttaagttgtttaacaaaatcaaacaagaatacctactttatggaatctgtgcattaaatgagcaatacatgtataaaatatgtatagatctggtatcaaatgtgttcaatgaaatatgtataacacatgcatgtatgtatatgcacctatatttcaatttagatataaatatatgagcaaggtttacagataatgactctgatttcagtttttgacacactaatgttgagactcttcagtaacttgcaagagcagaccaacaaatgggcagttggatctgacagcccagaggcagcagaaagctttggacggaagataaagtaatagtaaacattatgcagcacttcaaataggatgtatccactacacggtgggaaacagtaatactccggagaacctctccacacagttaaaaggaagggttacatcacacaccgggttctgtcctggggtgggatgaggggggagggaaagcattaggagatatacctaatgtaaatgatgagttaatgggtgcagcacaccaacatggcacatgtatacatatgtaacaaacctgcacgttgtgcacatgtaccctagaacttaaagtataaaaaaaaaaaaaaaagcaaacacacagacacagaaaagcaacaacaaaaacacagcgtcttcattcaattagcacataaaagaagtgccaagatctgtggtcgccaaggactagggagtttgtgtcactcatctggcacaaatgcagtgaaaataagattcacttgaaattaagagacattccatttttctcccttgatttcatttttctgtgtaaagctgatttggaggttatgctatcagtcaacaagcaagatgttgtagtgggatggagggttggtaagccccattcacaggaataatagtcaaacacattggaggcacgattcaaatttcaggttaattaaatctcagtaaaaggcttagaaatgtagaacaaaatttctgtaaggtttcctatgaaaaaaaatttttaaaactaacaagacttgtgtgcacatttcctggggtaataagaaagttgagacagttgaagaaattgtacttcacttttcttgaggtgggaaaaaaaaataagaagagaactccaagtgcttatgaagtgggttgtggctgataataaggggagaaaagggatactctggagaaagttcttggcttgaaaacagactcatatagatgtagaatcacctatggggctgatcgtggcttaaggatcatctgccagtcttgagaatcatttactaatctcaaggatcaacaaatgatcctcaagccagaattgtctgttgtcacctgagtgctttgaaaatcatctggaaaaataagttgatattctttggtatgaacacagtgagactgaacttgctgtaagctttccttgataaacagggctcattttttactccccccagcatttgctttctacagtatctacagtaatgtatcaacagtagtaatgtatctacagtaatatatggtttacagacaaagaaagaaatcacatattcttgtccaaatgagtcagtcataatttaatgtggttttccatatgtgtatcaccagacactttagaataccaaatattaatgtaaagactttgactggcggttacttattttctaattgtgaattacagcacaatgtgtatatcagaaatattcagatctttcttgaaatctcactgtaagtcttaaaataccacatttaaaaatgtccaatttactatgtcttccataaagctgtgaatttttagagagctaaatgtctcatgtatttttaccacaagtgaatcattgagatgaattattattcaaaatattttcctgaataatatgagactgaattgaaaggtttggggagggggcagaatcctgagagctgtaatacagaaaactatataataaaaaatgactttttatagtcaatttctgtgagttttttggtctctaaaacaagtacaagaagaacaatgggtaacatagaatataatttatgtgctaggtagtgtcctaagcacattacatttttctcaatacccctttggggtagagtctattataattctcattttatggatgaagattgatttttagtgagtagagtgaaatatcagtaaaagagattaaagaaccctgcatctcctcccatcctttgcctctctggaaccttgattaatgtatcccctctttcagtttctctctctcttccatgacacctccttttgctcacacaaatgcacacatattccctaggtaattttttttttatgcaactggtgggaattctactaacattattcagagcattaacttccatttcataaaattgtatatagtgaaacacacattcaagaaatttaagccaaacattggtactcaacaatacactccaaactgtttattttagccttaatatattgcttgtgagaaatttaaaatctatgccaagattattgtgctcaaatgtcccacaaacttaagctggccagtagtgaaggtccctccctgttgggcctcttcacctcctgcctggtgctcttctaggctcagcgacagagctgcttgtccagacccccaaagcagcgcaggaagcagcactgttccccctactggcagtaccttccagcttcttgtcagtggtaaagactccagggctgctttacatgggtcacatctcagtgacattcctcactaggtctgtggccttgaaaaagctacttaaactttctaaacttgagcttactcatataccaaatggagatgacagcagtgctgatttatggggattagataagacagtttatgtaaacttcttaaaccagtgcatgcatatctaaggactaaacaaatatttactgttattgatatttctttcaatatgttgcatggaattttgacagtcttatttgatgtgtttcttatcgtatcctacattcatatctattttgtgtgtgtgaaatatttgttgcataattttaccattgcttacagtaagcaagtactaaaaaggcatttacatttttttttagtttatagttcattatgcatattaccaatagattgagggctatttttccctttagtgtaaaatcaaacactaataggtaagatttctgaagtcataaactttatgttaaatttttagatatttcttagacgtcaaaattttttgactttgtatgttaatttaaatgaaacacttaatataaaatatcttatgatatatatatatatatggcaacaatgatcagtgtgcagtctaaatttaattgcatcattttctgggaggtatcatgcttctttattgtgctctgctcaactgggtatacacattctttcatctaacctagaattcacaaaaataacagatctccaaaaccatttcattccataatttccccatctgttgattttggttcctatacacacatctgagcataaaagctcattggtactaggccacgagtaattacaatctaagaacatagaagaatgattgaatagtggtaaaggaaataccagcaaatcacttgactattagaaaataatatggtaaggttgtgaatctcaataccattctgtgataatgagggcactccataaacattttacaaataaatgaatgagtggctttatttacagaatattgaatggtaaagttaagtagaatttaaatgtcatattaagggaaataactttattgaaggtaaagtagtatcttaagcagaaaaggagagtatctggggttttattttattttacataaatgcagttaaatggatcttcattgtttctatttagaagagtttgagtttgaaaaacggttttgaaaacacaaccaacagcagataatttgtctttcagttatggggacagcccacagaattccaacacatatggcatctagccttcaccacaaaattagtctagtacagatagtgtggcccaagtgtttggcaaatgttgggttttcaccatatattgatagcagctggaacaggaaataaaaatgaatcatttcacgttacattgaattttaagtagaagcagcacacatgattctgagttagctcatcattatgaagttattctagcacgtagaagataacacttttgagatataacttgaagctattttttgtttcccacagacagtatgggaaagggatttaaatacctcagagactctggaatttgtgatagtaacaatgatagtcacagctgagagtccagtttttaacattgccttgttagttggccagctcttccatgcctgtgggtattcttcaaatctggttttgtgctattttaatgtaatttcagagaaattaccggcagtgcctcttttgtggcattcaaatgatattgttgtgttctacattgttgaatcagcacctttaaaatagaataagagcatgacatatacttttcgtgcagagttactaggaaagagttgaaattctagttcacaaatgaaaacatttgtcttgtaacaaaattaaaaatcactcaatcacttatgtgttcagaaattttactttgatgtttcctaaattctctttagtaattctgtctacagctaatttttgttaaatttgttattttttgtttataaacattgagacttgattttcttttctttttaggatcccctgccttgactggaactggaacaatcaacgtcatagtagatgatgtcaatgacaatgtccccacatttgccagtaaagcgtatttcacaacaattcctgaggatgcaccaactggaacagatgttttattggtaaatgcctcagatgctgatgcttcaaagaatgcagttataaggtcagtacattttcctttgtaaagtttgtctgttttctcattaaacattagtttttgaactacatgaatataatgtttaatttaaatgaacgtcatattaacacatatcctcttcttgttatccattgctgatagccaacaattcattaaatgaagattcaaacagtaaacattttacttattactctaagattttatttaatttttattttatttatatttttatcatatctcatggttttgtggtttgggactacactgggtgcttctgtctcatgaggttgactggtggcacttcacagtatttacatggtgactgaatgatctggaggggccaagatgactttgcatgcctgctgccttggcagggttggttggaaggttcaggatcatcttggccccctctgtcctcaagtagtctcagaacttcctgatgtggttctttagcaaagtagttggactttttagttggtggttctcaactccaagagccacaagtgaaagctcccagaactctcaaaggtcagactcagatgtgccatagcagcacttctataatactctgttggtcaaagcagtggtgaccagctcagattcactgtgaggagaaacatgcatcactcgttgattggagaaatgtcaaagaattttgaccatttttattccactactagctctaataagaatatttgtgtattcttcatttagtaaatgtattttactttgcttaaatcctcttaaaattgagaacacaaatatgataacttgttcagagaggatgtgaaagaaatttgagttgcaacattttatcaacctagattgtccccttcttccatatctattctaaactacaagaaatgaagatttccaaaggttctagagaaaaactcacacacataaatattttatacccctcctccactttctataggctggtattaggtaaattagagttggttagatggctatgaaagtaatggagcagaagataaaatttgagacattaagaattatcagctatgggtaccagatatacggatatggtaatgagctgattcatgtcttattttgttgtttgttaccaattttcttttaacaaaatcattttggaaaactggttttcaccacacaaattttaagaaacacattcagaccacaatacttggtctctctaagaaatgacctttaagctgaaaggactgagctatggaatggaattaatctcgttgttttatctaagaaggtcagcatgtctggaccagagtgagaaaggagtcagagaggtaggcaggggctaaatcatgcaggccatatacaggccatatatgtcacgatacagaattggggttttccaatttacctttaggtgagaaactactggggagttttaaacagaagagacacataaactggtctacatttggatagaatctgatgagagaggatttacggagagaaaccagtgcaccatttaggcactaattaatatagttatccaagtagagtaactttgtacttacgtggagaaatgaaaattgagtaaatagatttggggcatacctttgaaattggatgtgagacaggaaggggaacatcacacaccggggcctgtcatggggtcgggggagggggggagggatagcattaggagatatacctaatgtaaatgatgagttaatgggtgcagcacaccaacatggcacatgtatacatatgtaacaaacctgcacattgtgcacatgtaccctagaacttaaagtataataataaaaaaaaaacaaagaaattggacgtgagatcaaatgaaagagagaaatcagaatcatctaagttttccactcaaacacctaggcagatcatgatatgatatcatttactgaaatgggtagcattgaaggaggaacagttttgtgagaagtcagaagtattctatttgaatacagtttcaaatgactgttactcattcatttagagataccagttaggaagctggagatatgagtgtggagcttagggttggggttagggctggatatacacatttgagagtcatcagtgtttagaggacatttaaaaccaataaactgaatgagaacacgtttgcggagtgtattagtctgttctcatgctgctaataaagacatacctgagactgggtaatttataaagaaaaagaagtttaatgggcatatagttccacattggctggggaggcctcaaaatcatggccgaaggtgaggaagagcaaaatcacgtcttacatggtagcaggcaagagagcttgtacaggggaactcccatttataaaaccatcagttcttgtgagacttattcactaccacaagaacagtatgctcgaagctgcccccatgattcaattatctccacctgaccctgcccttgacacatggggattatttttatttatttatctatgtattttttttgagatggagtcttgctttgtcacccaggctggagtgcagtggcacaatctcagctcactgcagcctctgcttcccaggttccagtgattctcctgcctcagcctcctgggtagctgggattacaggtgcacgccaccacactcggctaatttttgtatttttagttgagatggggtttcaccatgttggccacactggtctccaactcctgatctcaggtgatctgcccacttccgccttccaaagtgctgggattacaggcatgagccaccatgcctggccgacacatggggattattacaattcagggtgagatttgagtgaggacacagccaaaccatatcagagagagtatagcaggataaggaaagaggcactagaaccagtcactgggaattctccaacactttaaaggtaggtttaggaggaaaggtctccaaggagactaggagttaaggtaggagttaagaaggtctgaagttaaggaggcctggctagagacaacagaggaaatgcaggacagaatgaattatttgcatgcattgcaaaaggatggaaagctatatacaaatttctttcagtgagctacatacagatttctttcagtggaccaagacttattccaagagaagagttgagttctcagagtcctgtaaagtcaaatcatagaggactgagaaatttctgtccagggtcataacccgtttgagtcattgtacttagcaccaaccagagagaggcaggtacaactgaacttcttccaggttatgagcttcaaaaggccactaaataccctttcttttacttgtcttataccaaagcatagaaataataaaaatcatatcataagattcaatccaaagtctttagcttaacattaagagtagaaccttgggaattaagttgtgtggaattgaatcctgactctactattactattgcattagtatgggcaaattaacatttctggacccggttttcagtggattaagcagagtaataatgaaactaactttaaagagagtaagtaaaataatttaagtgagctggttagaatagcaccaggaacaaaaaacaatgctcaataaatgtcaacccatattgttctaatcatgcaaagcacctagccctctacctgtctatcatttgttagtgctaaataagtttctgataatgattttggaagagatgccctatctattgtaatgttataatctaataattctttatctgccatgcagatgctgtttcttagacagtatatagaatattaccaatcagatatagggaaattctcttgtatgagatgtataaattcctgaatatgaagttgaatgtttacaaacttgatcctgtcttccattgagtcattcatttatttctataataaagtaaatgctgtgatgacctgctgtttttttctagtgcatgttaaagattcattgcaaaatgctatcctatgcttgtgaattatgcttgtaaatttggtctagaaaaattgtattcatactctcaaactgttttacaaagctgtactggtaggtctgatgggattgttttgctttggtagtatgtattttggttatttgattggttgattaaattttcttcttttaacatgagaattaacattatacttttacatacattgaaatccaaaaaccccatcagtgaaaatcttaaaatgactctacagactatcatatattcagttaaaatgaaaattgaagctatttttgtcttgtgaataaaaaacattcaattcacttgcaaattaacagggcaaacaattattgcagcttaaatagaaaatattttcacagacaaagtaaatagttattataacctcaactttatttactctggtttgataaaatcttaatggaatataatgtattttatggttggtgttaataactccttgctattcatggtatcctgaagaaaatctattctttcttcagattaaaagagctattggtttaattatttatctcccatttaaattttacatggttcggttatttactgaactactgttgggatctccaggagcataaacttttatgtgtcttataagttaatttttttccaatgatctagcatgattttgcatatagcatccagccaacaatgtttcttttttacttctacctatttgatcaaactttgtatttctacaaatggtgtacttactttatgttatacattttacttcacctttagtattttcccttatagaaaatcagactgtattaattcttagtctttctctatccagattatgtctttgccttccacatatctattccagagcttagcttttacagatatgtatccccttttctcccaactggaccaaatctctattcaagccccacttctaattcttctgtatcacaaccctggagacagccacaaactccactgacaaagtcaacattctaaggaagatttcttttctttttttttttttttgagatggagtctcgctctgtcacccaggctggcgtgctgcgtcgtgatctcagctcactgcaacctccgccttccaggttcacgccattctcctgtctcagcctcctgagtagctgggactacaggcacccaccaccatgcccggctaatttttttttttttgtatttttagtagagatggggtttcaccgtgttagccaggatggtctcgatcttctgatctcgtgatctgcctgccttggcctcccaaagtgctgggattacaggcgtgagccaccgcgccccggccaggaaaatttcttaatatgtgctattaatctcttcccattcaatttcctccaactctttaattcaaaagttactcatttttcttgtgtttcttcaagttctctctcttccttgaaccatgtagatatctatataaatgctcatttacataagttagcgtatctacagaaatgctcagaatttctgttgaattctggttcttttatttgcctcccatggcctaggaaagtcattttagtgcctcaaaggcttagtttctgcatcaataaaaatgaacataaaaatttatactttacagtttgtgagacaaacatttactaaccacctactatgtatcaaacagtatgtatggaatcagttaatatccataaatgtctctggcataattattaggacatagaagtcactaaattaattcaaggtttcttttttctttttattcttctcatatcatcttttttactcctaatatattctttcttttacaatatctggtacataacagtggttgtcacttaaataaatgcattgaatgaacgattttaatattctctggaatggctgcttttactcattctatttttactacaacattcttgaaagcttcacaacctgttttctctgaccatttattcctgaaaatctttagtctgattttttttttccttcattgctttactaaaaaaaggccctgtcagaagactactgaaatttttcaagtccagtgacttttctaagtccttattctcctttactttttgcaatgttcacactacaggccaggccatcttttctttttggcattttttcctgctcaatgtctatataaatattatttcttatcatcctgcatctctgatcacacacagtttgttttctgtttctcttttctctctctggaaagtaatttgaatacttctcactgcattattttctcagtacttgtgtgtgtgtgtgtgtgtgtgtgtgtgtgagagagagagagagagagagagagagagagagaatttattccattgctgcaagcatcaattctgtgaacaaaacctccaaatctgtactatcaactctgattccactccaaaattttgcacccatatttataactcgctgatagacatattacactggaggttctgttggcatcataaacacagtgtacctaaaattctttgcttttcctgtttctcattttggttttctgctttgttttaataatattgtcttggtttgttttttaccacaccttgcagctaagggtcatcccctctcttatactcaatcagtggacaaattctcatgtttcttcttttctaatgcatctggcacccattcttttcagtgcatcccttctgccaagatcctagttcagttcataattacatcatgcctgtactattataataagaattaactcacttccacgcctctagtttctaatccttccaatctatgtagtacactgtcctgtaaaattatgaagccctgactatgcaccaaaaatttattaaactctcaggagtttggaactctagggcccataagaagtgcaatttaatagaagagataattttgtaatttcttaagtgtagtaccgtataacaagtatagtttaagcacagaataggtggaaagaatagtatggccaatgatccttcaatgatactaagtagaagtagtttatggagaaataaaggaatgaaagatattctaggcaaagacagtatcaggtactaaggcaaagagctatgcaaaaaacatggcattagagaaagaaagtatttccatatggttggtgtgggttaggaatggactttgtataccatataaaaaattcaaaatttctttctgcatctaaggagagaaacaatggaaatgttttaagcagcaagcacaaaaacatgcctagttatatttcataattatttctttcccagcattataggaaataatttgtacaaagcaaagctggagtcagtgaattaaagggcaatggcagaagtatgcatcaacatgagcatctcttggctctgctttaacaattatacttccttcctcaaaatctttcaattccagtttgcctatggtataacccccagtcttcaaattctagtcaccccataaatggccccagctaattctgcaaaactctgcaacatatggccaaaagttcagtattactggatcattttctgctcatgggacaaggatctgtgctttcccaagccttataggtttgctcaatttattctatatctttgaccagggcttggcaaactactacctgcaggccaaattgggcctagtgcctgtttttgtaaataaagtgttattggaacacagccatgcccattcatgtacctattgtctttggctgctcttgccatatgatggtaagctgagtattgcaacagagaatatatgacctgtaaaactgaatatctttacaatctggcccattatataaaaggtttgctgaccactagcctagaccttcttttgtttctgcctttttgaacactattgaaagatgggtagcccctttacaacttatgttaaatttacctttctctgaggaagctttattttaatcattccagtcaagagtgttctgtcttctgaatacctacagtgacacctctttactgtttcatagcactttactgttttgtaattaccttttttttatatctttctgtcataaaggacataaacttgaaaccaggattttttttaacctacttaaccgtgtctctgttttgaatttttagtccctttatccatttaactatctaaatataggttgagcatccctaatctgaaagtccaaaatctaaaatgcaccaaaatcctaaactttttgagcatgaacatgatgccacaggtggaaaattccacacctgatacctttgctttctgatgtttcaatgttcacaaaccttgtttcaagcaattatcaaaaatattagataaaattatcttctggctatgtatatgaggtatatgaaacataaatgaattttgtgttcagacttgagacccatcccctagatctctcattatgtatatgcaaatattctatccagagaaatccaaacacccctggttccaagaattttggataatggatactcaacctatgtatagatagatatggatagattgtatgtaatagactattacgttatacatatatattatataggtcctattatgttggtaaacttagacttttaaaggctcaccatttatcaattacaatgccaagtgctctttatacaaaatatttttaatagtcaaaactaccaaataaaaagtaaaatatgacctccactttacagataaagaaagaaggcttaaaaatgttaagaaatttttgtgaatttaagtgctattcatggggtttaaatttatgtccaagtgaactatgttctaaagtccagtctcttaactaaatgatcatattctcccagcagacagtataatgcctataaccctagtagatctcaggaagaggcaaagaagttttacaaaatcaaatggggatattttaactttacaaaagcaatagttgatttagggttcagatcacagtggtctctgtttatgcaaataatttgaaatagtaatgtattctcaaattagaaaataatttaacgtgtttattgattttcattgaactaaatgtgaacaaattctatattgacacaacttgagcaagagtccatgttggccttcgcaattggtacattttccgtcttcactacattccctcagttgagttttaccttccttctactgtggaataatgggaaaagtgcatggtgaagtcataaagacagaaattcaaactctagatctgctatttatagattgtatgtttctttgtgcaactactttagtctctgttagattcagattcattatccctaaacagtcaaaactaaaactaaactataaggatagttttgggatttaaataagagcatatataaattgcccagtagtgtgcttgacatgcactaagaaatcaataagctcctggaaatatttaagtaacagcataaatgtttaactgttaagaagataccacaagacacaatctaataaagtttttaactttacaaaaattaatgcaggccagagaagcaagagaggtcatcaggagggatgagaatagaaccaagcctcaagtaagagatgtggcaaaaatctagacatattatcttaactgtcgatctacgtacagagcttattgtgtttcttctatttttaaaattagaagtataaattttcatccaactggtgttatagaacatctcatatttaaaatatacttttatatgctttagaatctagtgaagtctagaaaaaattaattagatattaatgactatttgctcattcattttaaaaaatactaaatatattacctactttaaaatagacagtcatacgggcaatagcatgtgcaatagcataaaattaaaaaatcagaatttataccataggtttctttgtctgttttgtgctgctatagctacagactgggtaatttataaagaatagaagtgtatttggctcacagttctggaggctgggaagtctaagggcatggggcctgcttttggtgagtgcttcctgtgtgttatttcatggcagaagggcagaaggcatcacatggtgagcaatcatgtgagacagagagagggaatcaggctgaactcattcttttatcagaagctcactccctcaataactaactcccacttccgtgataatggcattaatccactcataatgatggaaccctgatggtctaattcacctcttaaaggccctacttctcaacattgttacaacactgttacaatgactaatttcaaggaacatttaaatgatagcaagtctttttgaatggatcatttagtgaaactggactaaaggccacaccatttgcctatcaacacattacgcttaataatacaccatggtcttggcatatacaaaacatccagatgaaaatttatgttttttatcaatctcattttatttttatttgtgaatatttataggaataaatatttgattgaaccttgatccttgccattataaaactaaaaaagtttatggcagcatggcttactttattttcctattaaattatttgattatttctacatccactgacagcaacaaggttccaaaaataaaattacacaattctcaaatccagttttctacactttgtaaaacgttaaggtattttgattattttgtgagtcctgaattttcaagttttaagaattcatgtataaaacttgatatttatattttgataaagagaatatatattatctactgtaaagggcaataattatacctaatagtcacttctggcccaataactatagttaatgctattttcacacatgcctgattctgtcgtgtgatttgccaagcatattaaaaatctgagtgacacaaagtattttatcaatactgaagccatttctcaaccaaaccacttctctattctttccctgttttgctatcattttataagacttctaatagttttaaatataaggtcctcaacagttgattatttcactaaagtaggataaaaaatgctgaaatatttgttttaagctgtgagcataataggagaatgaacatactactggctgcaatatagttttttcccctgcagtttatattagatatatgctgttgctatgtttatatagacacaaagcaaactgtagaaacatgcagccaactccaacaagggtatctatttgttggtataaaagaagaaaacttttaaagatatctatttccatgctatctttcaactttaaaaattacggaccatagccaatttctgaaccttcaagcttagctacttctttcctggctgatctttgggacctcaccttatacacaaaatcaggaatatatgcagacaactgtactcttcagaaagaagagagaagcttttctcagtggaaactcttgcccgttaacctatctggttagcatcaaaacatccatgaagatgtcatacctctcctgacaagaaagcaacaaaaccatatgaggaatgacaaagacagaattaatcactagaaaggtctttgtataaataatcagtccttgagttgttctgagaagcagatacatgtcaaatacaggttttgtcttaaaagaatacaattttcaactgatcttctctggtttattatggtatacagcagaaaaataatttttagtttcatttaaaagatattcatttgtaatcctggctactaaccacaatattagagcaagtcccctgatttatgcttttaggctcatttatttaaagccttaggggtttgtttggtggccttgcacaacttaagagtcctaaaaaccttgtgaagacttccttgacatcactggacatctcacgataaagactgtcaatgtgatgttcacagaaaatttgaaatatttattagctagactagttgtattctttccaacattgttgtatgatctttcttgtaacgttttcttgcatttctacctcagttttttaattatagtaaatagaagttacgatattaaaactatatgacatatccctatttctgctttctgctttagttataggatcatcggtggaaactctcagttcacgatcaacccatcgacaggacaaatcatcaccagcgcattgttagatagggaaacaaaagataattatactttggtagtggtctgcagtgatgcgggatccccagagcctctttccagttccaccagtgtgcttgtcactgtgactgatgtcaatgacaatccaccaagatttcagcatcacccatatgtcactcacatcccatctcctactcttccaggtaatcaaccaaattctgaggccacatggatataaacaaactatgtatcagacatttctataaaaatatttatgatattttacatacatatttctgatatagcctaattttgcaaatcctctaaaattcaggttgttttgtctgatggaaatgaaaaaatgcttgaaacttgaaaattaaccctttcttgctagactaattgtgtataatgttttataattgttatgtattattatttcttaatattacttgaatattataaataattaacatatatattacatcatcgttaatgatgtttatggcctgaggtataactttgtgtaagtttgctaagaggaggggcattgtctctattttgcatgccatatgccactacctgaaacatgatatgggagataataggcattcaactatgtttgtcagtggaaaatgaatatttgacttcaatttttcatagatatgttttcaaaaagtttaataaatggataattcttgttaatatttattttattccaggttttacaaatgaaaactgttctgttagcaagtttatggatccatttatgaatcattttcatattgacaatatgcatttatccttctgtatctctttaaatttagtttgacatttgctaagaaaggcatactctaagaactgcacaaatctgccattttaatttttaaaatgagttttcaaagaggaaaatatagaaatatagctcattattgatttaatcttccttgctcggaaatatttttaattattagaagaaaaacttaacagatagagttaacagatcctcctttcagtgatctttgatcttctattaatctgagaatgataccaatctaaaatataggattcataaatttatgtgccaactttctatcaaaggaaatgtcagtatcaaaatgataaatacctgctaaaggtcttcagatgaaatgatgttggcaggcatggttctaattacatccaatgtgtggtggtgcaagataaaatttcctatgtaaaatgaggtatgcttaagcatcttttcctcattggacttataaccactggcctttttaaaattaaagatattttacttttgttaccgtttcttctgtaggggtgagagtgcaggtttgggaatggtttctgaatgagtagattgaaaatatgtccttatggcagcttttctgcatatttttacgacaatctgtttcattggcactcagtctaagcactaacttttggagtccaagttgagtccattatccctcaattcttatttcttactactttacaattattttaattggcttatgtatatatctgtgtatgtatatacacacacatataaacatacacatatgcacttttttttccatctgataatagttcacgtataaaggaattttgtcataaaacagtggggacaaggaataaatggtaatgaacatgatttttgttgacaagattacatataaagtgattggaagatattttaagacacactagagcaacggtatcattgcattgggtagaggcatagcactttgcagagctcgcatattatgtttcttggaatgttgttttatgtgcagatttttctcctagaaactatgatttttgaacgattagcaagttcttttccctaggcttctctcaaaggcatactgaaaagtattaaatccaacagactgtataaattttagttagaaaatggcaggttagtctctgaagacaatcatagagcagatttgacttgtgaacctcggagaaaatataggagatactgttctccctagtaatcatgagaaaataaggtcacatcaagcagcaatagagtgtcttatatgcacttatctgctaccaaatattttatttaaattccacgtgagtataactgcacactttctcttttataggttcctttgtctttgcggttacagtcacagatgctgatattggaccaaattctgaactgcattattctctttcgggtagaaattctgaaaaatttcacattgacccactgaggggagccattatggccgccggaccactaaacggagcttcagaagtgacattttctgtgcatgtaaaagatggtggctcatttccaaagacagattctacaacagtgactgttagattcgtgaataaggccgatttccctaaagtgagagccaaagaacaaacgttcatgtttcctgaaaaccaaccagtcagctctcttgtcaccaccatcacaggatcctctttaagaggagaacctatgtcatattatatcgcaagtgggaatcttggcaatactttccagattgatcagttaacagggcaggtgtctattagtcaacctctggattttgaaaagatacaaaaatatgttgtatggatagaggccagagacggtggtttccctcctttctcctcttacgagaaacttgatataacagtattagatgtcaatgataatgccccaatttttaaggaagacccatttatatctgaaatattggaaaacctttcccctcgaaaaatacttactgtttcggcaatggacaaggacagtggacccaatggacagttagattatgaaattgttaatggcaacatggaaaatagtttcagtatcaatcatgctactggtgaaattagaagcgttagacctttggacagggaaaaagtatctcattatgtcctaaccataaaatcatcagacaaagggtccccgtctcagagtacttcagtaaaagtcatgattaacattttagatgaaaatgataatgcccctaggttttctcagatatttagtgcccatgttcctgaaaattcccccttaggatacacagttacccgtgtcacaacttctgatgaagacattgggatcaatgcaattagtagatattctataatggatgcaagtcttccatttacaattaatcccagcacaggggatattgtcataagcagacctttaaatagggaagatacagaccgttacagaattcgagtttccgcacatgattctgggtggactgtaagtacagatgtcacaatatttgtgacagacatcaatgacaatgctccaagatttagcagaacttcctattatttagattgccctgaacttactgagattggctccaaagtaactcaggtatttgcaacagatcctgatgagggatcaaatggacaagtgttttatttcataaaatcccaatcagaatatttcaggattaatgccaccactggagagattttcaataaacagatcttaaaataccaaaatgtcactggcttcagtaatgtgaatatcaacaggcatagttttatagtgacatcttcagatcgaggtaaaccttccttaattagtgagacaacagttaccatcaatatagtggacagtaatgacaatgcacctcaatttcttaaaagtaaatatttcactccagtcaccaaaaatgttaaggttggtacgaagttaatcagagttacagcaatagatgacaaagattttggactgaattcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagggtgtctttgaaggtattggccaagaactttggcagcattagaggtgcagatatagatgaggtcactgtaaatgtcaccgtgcttgatgcaaatgacccacccatttttactctaaacatctacagtgtgcagatcagtgaaggggtcccaataggaactcatgtgacctttgtcagtgcctttgactcagactccatccccagctggagcaggttttcttacttcatcggatcagggaatgaaaatggtgccttttctattaatccgcagacaggacagatcaccgttactgcagaattagatcgagaaacccttcccatctataatctctcagttttggctgttgattcagggaccccctcagctacaggtagtgcctctttattagtcaccctggaagatataaatgataacgggcccatgctgactgtcagtgaaggagaagtcatggaaaacaaacggccaggcactttggtgatgacccttcagtccactgaccctgatctccctccaaatcaaggtccctttacttattacttgctgagcacaggtcctgccaccagttatttcagtctgagcactgctggagttctgagcacaaccagagagattgacagagagcagattgcagacttctatctgtctgtggttaccaaggattctggtgttcctcaaatgtcttccacaggaactgtgcatatcacagttatagaccaaaatgacaatccttcacagtctcggacggtggagatatttgttaattattatggtaacttgtttcccggtgggattttaggctctgtgaagccacaggatccagatgtgttagacagcttccactgctcccttacttcaggagttaccagcctcttcagtattccagggggtacttgtgatctgaattcccagccaaggtccacagatggcacgtttgatctgactgtccttagcaatgatggagttcacagcacagtcacgagcaacatccgagttttctttgctggattttccaatgccacagtggataacagcatcttacttcgtctcggcgtaccaacagtaaaggacttcttgaccaaccactatcttcattttttacgcattgccagctcacagctgacaggcttagggactgctgtgcaactgtacagtgcatatgaagagaacaatagaacgtttcttttggcagctgtgaagcgaaatcataatcagtatgtgaatcccagtggcgtagccaccttctttgaaagcatcaaagagatccttctccggcagagtggagtaaaggtggaatctgtggatcatgactcctgtgtgcatggcccatgtcagaatggagggagctgtctacgaagattggctgtgagctccgtattaaaaagccgtgagagtcttccagtcatcatcgtggcaaatgaacctctgcagcctttcttatgcaagtgtctgccaggatatgcgggtagctggtgtgaaatagatatagatgaatgtcttccatcaccttgccacagtggtggaacctgtcacaatttagtgggaggattttcatgcagctgcccagatggcttcactggtagggcgtgtgagagagatatcaatgagtgcctgcagagtccttgcaagaatggtgccatctgccagaattttccaggaagcttcaactgtgtttgcaaaactggatacacaggtatgacaacgtttgtacttttctcactaagactttagccatgtcaagtatattgaaacgaaataattttatcattttccaatgattttcatataaatgagcataatagtaacaaatgtttttaaacatttactgttggtcaaatactgttctaagcactttttatgtatttgttttgtttacttcttacaagaaaacttatgaggtaggaatattttccagtttctataggcaaggaagttgaagtagagagtaagtaattaggttttctcaggtgattcagttactttgctgtaatgtcactattcaagtctacacagttaaatccagaacttaagtgcttaatctcgtagcgtctcttacaagagcaaaaaagagaataatatctacttaaaagagtattctagatattaaaggataaaatatatacaaaacataagatttggaccattttgtgtgttaaataattgttaacaatgattgttgttgattctttatcatcatcgtttttgtgaccttttaaaatcatagtcgtcattattatcgaaatgtgatccacatcgtgagaagagcgagaatcatgttttcagatttagattaaaatgatgtgttattgggccaggcaaggtggctcatgcctgtaatcccagcactttggaaggccaaggcgggcagatcacgaggctgagagatcgagaccatcctggccaacatgtgaaaacccatctctactaaaaatgcaaaaattaactgggcgcggtgttgtgcgcctgtagtcccagctactcgggaggctgaggcagaagaatcacttaaattcgggaggcagaggttgcagtgagccgagatcgcgtcactgcactccagcctggcaacagagcaagactctgtcttaaaaaaaaaaaaaaaatggtgtgttattcctaatggttgggtagaaagcacaataggcttatttctcaagaaagctagaacacaactgagccacagcttatcttgacagactagaaagcagcattaaacatagcagtaaaaattttgaactagtctttggcaccctagtgggatatgatgtccatatatacatagatctctacctatttctactccatgtctatatcattattatctatcaacctatctattagttaatcagtggttgatgttccttcaaatgtgaataaatgttatgctattgataagttcgaggagagcaaaattctatcttataacttgcacattatacatttgtaaagcatgcatattacattgagttactctgcagtatttataaacataatttacagtactagtagtataggtagaatcaagatagattgctttaacttttgtagatgtattacagaataatattttaagcaaatgcatttctatgttatattttcaaaagtgtccattatgtgtatactgatggttttatatttggagaattgaatcacttgaggaaaatatagagcaagtttgaaaatgttgaaacagaacatgcagtctttgccttctaatgaaataactttgaaatgtaaatgaagaaaaagtggcagaaaacatgtgtaatagaaaaagtgatagatttcacagaatctgatttagctatagcttttgggaagtcacctaaccttagctgattcttcatttctctgtccacaaaatgggaataatcataagtactttcagggtttttgtaatgagtaaatataatgtttgtaaaacacctagtacaggccaggtgcagtggctcacgcctgtaatcccaggactttgggaggctgaggcaggtggatcacctgaggtcaggagttcaagaccagcctgtccaacatggtgaaacccatctctactaaaaatacaaaaattagctgggcgtggtggcaggtgcctgtaatctcagctactcaggagactgaggcagaggaattgctggaacccgggagatggaggttgcagtgagctgaggtcgcgccattgcactccagcccaggccgacaacagtaagactccatttcaaaacaaacaaacaaaacccacgtggtacactgtgcagtattcagtaattgcagtctaattagtagtagtaataatggtattagtatagtggtagtaatagaggagtaccacagaatttttaaaaagacatgaaacctgtgtagcggaagttaactgtgagtcttatgagagttatttatatgctaagatcatgaataatagagctatatacatgctgaggtcaggatttctagaacacttccctcactctttcttacccatccccaaaattactttatcggctgggaattcaacaataagagtttttatattctacattagtctaatgcatttattcacacttaggtttagattgagtttacatttagtcctagaatgaagaaagtgcaaatgtattaggtatggataagaaacatggaaagtactactggtgtgaacaaaggcaccatttgctgattttagcataaatgatgagtaagttacttctgtctggcttgtttatttctttgtttcatttcatttaaatatacattgcatacttttctaaacgtgatagttgaaactcttaaaaatgcctttccttacatcataaaatattaataacatttatcaagcagttatgtaaagcactttttaaatctccttgcattatagacattattacatttagttcttacaactctgtaagatggatattatgattattgttccaattttgaagaccaaaaaattaagtcttcgagtcattaaaagagattagacaacttgcctccagccatggcacagaaagtgttctaactagttttttactagaaacttggctctggtgcctctgctatttatatacatgtcgcactcatcacactttgatttgcacttgctatggagtgttatggtgagttctatggtgatattatttaagaatgttttgtccatcattctattaatacttaatcctcacagaaagcctataagacagtgtattgtctgagactgatcagaaatcggaactactctcagactttgaggcaggaaagtatttgctacaaggaaacagcttacaaaatcttcaaactggctaagaatacaggtcaggaacattcaccaatgggcgcagcaataaagacatggcaggcattgcaagacaccgctgctgatcctcttgcccacctgcagtgctgcaccaagtgatctgaggagaatggttcctgctttgcttttaccattcagatatcatcacagtcttttttgctggcagaatataaacttgaaccccgctggaagggagtctggaaaaggtagttttcagacttccagcccttgcaatatggaaaggtaggaacgatgctgaatgtcagcagatgatatgtggctcaggaagatgttattattcttcctgttttacactgtaggaaattgagcctacagtctggtgactccagggccagagctgccaaagtctatatcataaactctttctagggaaggttgtttgaagttatacattaacgttacatacttctcctcagagttcacttcagtcttcatttgcatagtaggagataatccaactgatcaggaatgatataaacaaacataaaattgaatgattaagatgaatcttacattttttaaatcaagtttcaaattctgtatgaaaaaaaccatccagtaaaactggcagataattaatgtctgacagttttatttcctttttgtattttgtaggaaacaatatgaaaaaagcatagtgagtggcaaatgttaatccatactttaaattagaaatgtattgcttaaatttctatagtttgttaattttttttgtagaggtaatctctgaaggatcattctgagttattctttttacctagtctctgccagatagcctggctcaggaagacagagctaatataccaaaacatcttaacatctaacctagtcagagctaataaaccataagacaaaatttacacataactgtatgtgtgcctcatagaatgattttttaaaaaattactcataatagctagattttacttcagttaacatgaattaaattgtagtgccttagtaaagcttcacttcttcaaggtctgtatataatttttggccatcagaattattttaaattactgtatttttcatactctacttttgtgggcttccacctgcattttatcaataggtttcaaagtctgtgaaattacaaattggagctgcacaattttctgaactttctgcttaaaataatcctcagccactacccatacccagtttctctcatacacacacacacacacacacacacacacacacaccactgagtattttatgtggatttagaaattgtgttaaggattagaagagtaagtggcttatgagttgatgcaaactaagagactttatccccagaatcccctagggtgtgattaaatgttagctgaatggagattttatgtagagaacaacttataaggacgcaagtatgaaaatgataatcatggaacaaaaaataggaagggatatagttattatcatactgtcacaagtttatttctgaaatattcttaaagtttattttcaagtctgtaaccatgcacataagtataaaacaactatattttttaatgaatgagtgatttagagggaatgaatttgtataacatgtatttcttatctcttttccttagttactggaaaaagaaccaaaagaaaattgaaaaaaagtaacatattcagttataatcacttcatatgtttcattattaagaaaattttcttataatttttatattaatatcaccatatgaagctttgattaactgtaacataaattattagaaaagatggataaagtttattatagtataggccatgtgaaaaattaatttctaaattttcacaaaatgtaatgacaccaaaaattaacatcagttgtcagtatgcctcagtgaataaaaactattattcctgccacataagtctaggggttcctagaggaaaactttagcctaataacgacacatgtagtatttattttcatatacaaatgaaaatgtcttgcacttaatagaacactaattagaaagtacagtaatagtaaccacatcaacatttgtctactgctgccaggttttcgctgtttgcatcacattcctggcattaaatccttcatgggaatggatggtgttataaaatgcagcattttgatagagcttatttataaatctggctatcttataacataattagttcatagtctctttaaccttttccattcactttcacacatctggatgcatttcaggtgtagtatttggaataatgccgggggtttattaccttatggagaagttttcctatgttctcaattaagtcccgatatttcaggaaagatgaggtttgttcattcatcacttttatgtcatttgacagtataaacagtaaaattttttcagacataccaacttatatacagaatatgcatagtaattttactgagaaacttgccagatatttgctttcataaagatggaaagagttactaagagtgattcttttaaaattactacggtcatgtattggtgttgttgatgatcatgtgaccggaaaaccatataatataaaagaaatttagtaaatatatatgaaattaaattttgtttgagataaagaagagtggctcatgtaagagacaataaagagtgcaattatttttatttaatttgattcctgaaagcagaattaggcagtttacattaggtaatacattaacttataaaagcattaataacgtatgtttctaagaagtagcttaaatgcttatttctgtagaaaataagcatatatttataagcttatgaacattatgtgtgtaatcatatgtaatcatttgtagtctcattgaggttgtgtttgtgcttgttttacaagacaaaggtaaaaactttttttggttgttgcttttgttactggcagcccttattaaaacatggtatttttgcttttgtttcaatgcaaaaaagccataaggctattgaacaggatacttagactatcttcatagctccttaacaataatgggaaacatttgcatactgtgcaaaagacagctactttttgctaaaataatttggaaaatatataagataaatgcctagaatgaatagcatatatttattatagaatttctttattaataacataatcaatttagacctaaaatggatttttagagttgcacatattctcccatctcctctgtgtagaaatacaggagatttaaaaataatatttatggtagtctaatatgtatatataatctaagatcttaaattgaaggctacatgtatcatagggtatcaaaaattatcgtatcttcatggagtggtccaatttagcagttgagaataaatttagctctatttcacataatccaacattaaaatgtgcttggacaagtgaaacttgaatatacattcttgttgaaaagaccataggtgattacaatagattcagtttatgttcaacacgtcatcacatcttctgcccccaaacatgaaaatagacacaaaatttctcctgtaagtttaggaaagtctgcggataccatggattcctattatgcatttattttcaccttaagctattcccactttccatgtgctaagaatttacacttcttcaagcacatctccttctagttatgataaatagtgtatggcaacacaattaattgatggatgtcaaagcaatgagatcaatttattcttctaaacagctgctatggcagtaaacatatcttaatggaaggaggcctcttgagttcaagaggaataaatgcctgtctttgtgcaagtcctatcagcatacttccaagcctgaaggcgtttggcaagtattgttaattgacttgtagcattaattaagttaatgatccaagattttgtttcacagtgcttcaacacatcagattattgtaccaagagcatgttagagtaattcaaactactgcattctctgatactcattatgctattaacactacaatttaagtagatagacttgcacaaaacaattcagaattttgttaatttctaattgggtaaaaaagcataaactttccaaacctgagaaatatgcatttagaagctttcttttgattctaagtaaaattatggaatccttttctcacacaaaagacacaggtgttttaaataataatttaaatttaaatctgttttcctactatgtctttgaattcaagtatctgctatggcaacctctgagttcatgaattgtaaaaaatttttactctttaaatggagaactcaatttttaaatagtaaataatttacatactctaccaccaacagataagactattttttccaaactcaacaacaaattcctttatttaaccccaaacaaagccattttatctatttttttaacttatattttaggttctgggtacatgtgaaggtttggtacataggtaaactcatgtcacagggttcgttatacagattatttcatcaactaggaattaagcccaataccaaatagtgatctttcctgctcccctccctcctcccaccctccaccctccagtagaccccagtgtctgttgtttccttctctgtgtccatgtgttctcatcatttagctcccacttataagtgagaacaggtggtatttggttttctgttcctatgttagtttgctgaggataatagcctccagctccatccatgttcccacaaaagacataatcttgttcttttttatgactgcatagtattccatgatgtgtatgtaccacattttctttatccaatctgtcatttatcagcatttaggttaattccatgtctttgctattgtgaatagtgctgcattgcacattcatttgtatgtgtctgtatggtaaaatgatttatattcctctgggtatatacccagtaatgggattgttgggtcaaacagtagttctgcttttagctcttgaggaatagccattattaattatttgtaattatccactaagacaaagtaaaaaggaacaaccttatttttaaactgaaatactgaatgcaaggttgaatttgttttttcttaacaatttctatttctatttgtgtatacttgaagaatcagattctattgagaatttaagttttataggaaattcgttctcaaaattagtattttattggtttgtaacatcttctgccactttgtaatcactgtatgttttaataaatgaataagtcttatttgtgttaggatatatttccactcctcactctggagtaactgcaatagcctgtattttatatttaaattaaactcagatgtctatgttaaaatattttatacagggttaaataagaattgattcatataattatacacaaaaagaacaacacgtaaatttcatttgttgctatttaactcaagatttataaaggtagtatttgtaaatgaaattcaaaaaacatatagtagctttataggaacaatgacttgggatttatactcatatatttttgtcagagagcacatatgtccaattatttgagtaagtatacatagcagtaccctctacatttgttacttcttatttgttcctcatttccagtcgttaagaagtgaaggtggcaattttgtaacccactaacatgttttcatgataacaaggctatattgaacacacttataaatacatatataagtctatgtattttatacatgttacttttaacacaactctaaaataattttttggataaagaaaggaatgaaagaaagtaaaactgtacctagtcaaaaagcacaagtgaaaattatgtgtgcttttacagtgaaaaccaaatggaaagagtagaatattactttattgatgacaactaatcaaaaatatggccagtagaccttatgtatttgcaactgggaaatactgtgctgtaagaaaaaaaaatctacatcactaaaatggccttcacataatcagttgaaaaacaaaacaggaaagagttctgtgaaaccgcaactctctggtgagaaatcaagcactatttgaagttttcctgcctatttctccaatgtagtacactgctacaatacttaaaacctgatttctgtgcccataaatttgtaacttgtttattttcatgcccttgccttaacaatacaaaggtattctgaaattgttagctcaatgttttgccttataaggaggttcccaatttatttataagggaaaaaatgttgtgtttatgattctgtgatgtacagaaatgggcttagttagcatcatgagatctgactcacacttataatttcagaccagaataagtgtggctccgtaatcaagccacaaaaacagaaccaatttaaacaaaattttgactgtgttttaagcaaagttagtatgatgaaatgaagtatctatgctcagcagtaggtctcgttgtgcatatagaatgcatatcatttcctgagctatctaataaatgcattagtgaaattgggctgggaagtagaaagtaacttccagaaacaaatgatgtagtatttacaatcctactctcaatgaaaagaaattaactaagaattctgtaacatctcactgcattatgaaatttgaaaattagatcctaacgaatgtatcaaatgattgcaatactttaaagttatagaacagtggtattagaacatgtttaagtttaggtaaaaataagtaacaacaacaaaaacaagtgggacttatactccaagttttatacaccacgtgatcaactaccatagttttgtgaaacctggatatgggagcagaagccctaaattggtctgtgtcatagttttacagtttcacagacaatatattagcctccaagaggcttttattcttcacttttgaaatgtaaatatttcctttgtatggattaatactccctactgaaatggaaacacagtctgaagacacttgtttgctttcttcactgccatatccccctccattatcatgtctggcccataataagcactcactcaatattagttgattcaatttaacaagatcatgtatgagaaaagtctttataaactgaaaaatatgctgtttaggtattatcgcttcagacaaaagacaaagtatacataatctgtagtcaagaataaattttcataagcatttgaaaatatgatgtgttttcttatttcttattctgctttacaacagatatgtgtaattcaagtgatatttcttagtagtagaaagagtgtagtttgataaataagataagttattatctttgaaatacctaagtcaagaaaatctctgcagtgaaaagaatactgtaagtttcaactttctatctataaaatataaaagatgaagggacattgacacagaaaataaattcagtgaaagcatttaaatatgtttatcatgtcatttctctgcaaacagtattttcttccaagatgattatgtaaattatttcctaagtattataatgcacattttacaataggacaactaaacaagattttaaattctaagatattattctaatttccttatgtcaagtaaaacgtttttatatttcttttctccgtgatatgccttaggaaagatttttacgtatggtaatggtgtaacggtgttaatatatttatgtatgagatttaaaaaaaactgaatttgatatattttagggaaaatgtgtgaatcttcagtcaattactgtgaatgcaacccctgctttaatggtggttcctgccaaagtggtgtggattcttattattgtcattgtccatttggtgagtaaaacttatttgttgatataaaatataagtttatttttgcacacagtttagcaattttgttttattatgagtatgaaagaccaaaaaattattgttttacatggaaggttttattaaaataaaatcttaaatgtttaacatttgtaaaagttatggaaatcccattgaatacattgcattggtcattactagaaaaagagtcaactcaagataattgaattaatattgtttccataggatatttccccccaaagatttatggatatcttcttttcagctgagaagttatgaaataaaaaaattctgtaagcactctttcacgtcactctctatttcaaatctttaagagtagtcaaagtaaggttttttgtttgtttcacttttgtgaattttgctttattttttatttttgttttttacattagtttttaattttgttttttatgttaattcagccacttttattagaaggacttagtaactatacctgacgttttcataataggctttttgtagctgatactacctgactaataaaatttcagactaatctgtcttttggataagaaaaattgttaaaaagaacttttttgtatacatacatatttattcaccctagtggaatgaactaaaagattccttccaggtcttatccagctgttacccattactgtgccagccaaaaaccatgagattcagaggaagcatttgtattagcttggcttgtttcataagtttgtgattattccattctttttaaaggctgctttacaccacagcatagaatccatctccaaatgactctgtctcttttctttttttttttgtcccctttgtatatctatttatttatttttttattatactttaagttctagggtaatgtgcacaacgtgcaggtttgttacatatgtatacatgtgccatgttggtttgctgcacccatcaactcgtcatttacattaggtatttctcctaatgctatccctccccccttccccaccccatgacaggtcacggtgtgtgaagatccccttcctgtgtccaagtgttctcattgttcaattcccacctatgagtgagaacatgcggtgtttggttttttgtccttgcgatagtttgctgagaatgatggtttccagcttcatctatgtctcttttcttaagcaagaaagagcaaggatatttttctagtcttcctttgggcatataactgtgctatatggacctgaacagtaaagctcaatctatagtagataatagaatttaaaagacatacgcagttcctaataacctgtataatttactaggtatttttaatttccaaacaacttcatgactatctgtttttattaagcacatccatagaatgataaagacaaacaaaatagaaaaatatctaattttgaggaatgtattttaccaatggttttgaggcccagaaattggctgatttgcccaaagtcaaaaaatgaagttgaggcaaaactaccccaagacgatgtagcaactagaacacaattttttattttcagtccagtatgacattcacagaacccctttttatacaatttctttgaaattctaacaatgcctgtgaagtaatgaaaggtatatcaaggtcaaaataaccacaacttgagatgtccaaaaactttttctttctttcaatggtgtctcatcattttaagtggtgctgctttctacagataaccacagtcaaatttcatggtttaacttaacattttgagataaaagataaggggattagagtgtaaactagaaatgattttcaagtgactgaacagagatgttcatatttttagggatccctttgcaaattttaaggatttaagttttgaggattttgagttgcaaatttggggatttaagaaaattgatacacaataaaaacaagttgctgctgcagtgtagtggtacaactgtcgttgcctattaagtggaactacttgaggggccaaatgtaccttcttgtcactctgtagacatcgccaggggaagaggaatagcacaatgtaaattaaaatagacacaaatcacacatagccggcagtgcaaatttctccccctattccttccaggggcaaagacaaaaaacattatctaaacttagatattgtcagttgacaacataagcacttacaaaagaaaacaaaaatcactgaaacactgctatgtaatttgaaactaaagagatagaagcagaaacaaaaatgatttttgttctcaaatggaatgtggatgaaaggtacaaataaccatgtcagatggcatgcctcaaataaatagccagaggtaggtagttacacttgcatcctttaaaacaaaactttatcattttgaagttagaaaaaagttttttgcactgtttagcttctcatcaataaaagattggctatttggatttcaaaaaattttttcgatacttagattttttaatttaaattacatcttaggaaaaacatagtgcttcagacattataaaggcgacatgtataattataacttcttagaattaagatgcgacctttctgtgaaaacagtaccaaaaccttttaagaataaatattttaaattccataaagaaatattttcatgtttgaaaatacagtatcaatttgaattaaaatgtaagtatctatatactttctccatatatttacactcaaatattcagcacattgttatagatttattgaagtttattcagaagagacctaagtgaacacataatacaaattttttcagtagtatttttatttcatttatatgctttatttttccttttactttaacttcacttactctttctgcatagatagcatatttatatacaaattattaatacatacaaattataaatattaaatatagatgccacagaaatgtataaaatacaaatacaaattctacaggatagatataagtatataatgtataagattatactatgtataaaatattatctctatatatcatatatatgacataacatatatatcaataaatatcatttctataattcctttgccttttcttcaactttggttaaagattaaaaattaaaaattatgtataatttctttttttttttttttgagacggagtctcgctctgtcgcccaggctggagtgcagtggcatgttctaggctcactgcaagctcagcctcccaggttcacgccattctcctgcctcagcctcccgagtagctgtgactgcaggtgcctgccaccatgcccggctaatttttttttgtatttttagtagaaacggggtttcaccgtgttagccaggatggtcttgatctcctgacctcgtgatccgcccacctcggcctcccaaagtgctgggattacaggcgtgagccaccatgcctggccaaaatgatgtttaatttctactcatttataataaatattatttcagtctggacagaaaaggaaaagataaataacacaaacttttatagcaacttctaggctgttttaattttaaaaatgttctgatataacatgtggtagtcaaaatagctagacaatcagtagatctggcctcaaattttggctgtttctcttggttctgtgaccttaggcaagttttaaatactctataaaataatggcattggttccttctagctgaacaattctctcactctaaattttatgcatttatgggacatataaagccaaaattaagaaatgaaacttttgcaagttaataagaatcatgaggtattggcatgggttaattttccaatcatttgccacagtctactaatatttgtgggaaaagaattttggcataacattgtaacatcaataaaactcatttttcaagtttgaaaaagaaccagcacaaacaaatgggaatgctgactttcagaaaaacagacagctattttaaagtagcctgctataaatcatacccacagagggtataaaacaagaaagagataaaaacttaaaagacagttatttcctttcctaaaccaatgattccacttgtcagattttgtggcccttgaaaataacatgaatataggtactgattttaaaaaaatcaaaacaaatgcatttgccatcttcaattgagttgaaatagtttttaagaactatatattatgaaggaagtatgttggctgaaaattgtagcataatacaacttttaaaagatcaacaaatttgggccgcttgcggtagctcatgcctgtaatcccaacactttgggaggctgaggcaggcggatcacctgaggtcaggagttcaagaccagcctgaccaacaaggtgaaatctcgtctctattaaaaatacaaaattagccaggcatggttcccggcacctataatcccagcttctcgggaagctgagacaagagaatcgcttgaacccagtaggcagaggttgcagtgagcaggcactctagtctaggcaacaagagcaaaactctgtcccaaaataaaaaaaataaaaaaaaaatcaatgaattttgaaacgtttctgggaaagaaatctcttcagacatactccattccactaagcctttcattttgagaaacaaaacatacttagatatgttccctaattagacaatgaaaaataattacatcagttaatcatttctgccatgttttaaagatcattcattcataaagatcattaactattttaattttagtttagatgaaattttttggaaagtaaaaaaagttgttaaaagatatctcattttataattcaaaaatattttaatcaaaatatataataaaattttcatgaaattttatgccagtttgtcaattttccctccaacaggtgtctttggaaaacactgcgagttgaacagttatggatttgaggagttatcatacatggaatttccaagcttggaccccaataacaactatatttatgtcaaatttgccacgattaaaagtcatgccttattgctttacaactatgacaaccagacaggcgaccgggctgagtttttggcccttgaaattgccgaagaaagactaagattctcttataatttaggcagtggtacatataagctcaccaccatgaagaaggtgtcagatggacattttcacactgtgattgccaggagagcaggaatggtaagatatttcattttattgttgttgtatatccaactggatcttcaaataaagtatgaattggggtgcaaatcatgttaaattaggtttattcattaaatgaacactttagttatgaaaaacttagacataatatttttcttttgctcatgacaactctgttcaaaaacaataaaaaggagaacaattgagaatatagcctagtgcgtgaaataatttcattgatattttttgtatgtttttaaggccatgtcaggactatacttaaaataactacctttctttcctaagtatttctgccttgactaagtatttctgccttgactgaagaaacaatttaggaacagaggagacttttctacaaaatctacataaaataacttaatcaaaaacactttattgttaaaaaatggtaacaatagtcttagctagtcatagtctttttgctggtggagggtcttgccttgatattggtggctcctgactgagccaggtagtagtggctgaagattcgtggtgggggctatggaaatgtcttaaaataaaacaacaggaaacgttgtcacattgattaactcctttttcatgaaagatttctctgtagcatttgaggctatttgattgataccattttacccacagatgaaattgtttcaaacttgaagtcaagcctctctcaaaccttgatgctaatttattaattaagcctatggaatattctaaatcctctgttgtcatttcaacaatgttcacagcatcttcacctggagtaagttgtatcttaataaaccgcttcctttgtttatccctaagaagcagcttctcatcctttcatgtttgttttgcaagattgtagcagctcaatcacatcttcgggcttcacttcaaattctagttctcccactgtgtctaccacattggcaattacttcctccattgaagtctggaagccctcaagctcatccatgagagtcaaaaatcaacttcctccgaactccttttaatatttgatattttgacctccttccattaatcatgaatgttcttcatggcatctagaatggtgactcctttccagaaggtttttaatttactttgcccagacctatcagaggaatcatcatctgtggcagctatagccttatgaaatgtattttttaaataataggacttgaaagtccaagtgactctttgatccataggctgtagtctggatgctgtgttagcaagcatgaaaacaacactaatctccttatacatcattgtcagagcttttgggtgaccaggtgcattgtcagtgagcagtaatattttgaaaggaatctttttttccgagtagtagatcttaacagtaggctaaaaaatattcaataaaccatgctgtaaacagatgcactgtcatccaggcatttctgtttactgatagagcacagatgcagtagatttagcataattcttaaagaccctaggatttttaatatggaaaaggagcactggtttcaatttcaagacaccagctatattcacccctgatgagagagtcagcctatcctttgaagcttttaacccaggcattcacttcttttctctagctatgaaaatcctagatgacatcttctaataaaaggctgtttttttacattgaaagtctgttctttagtgtaaccaccttcatcaatgaccttagctagatcttctggataacttgctgcagcttctatatcaccattcactgctttgctttgtcctactaccttacagagatgacttctttccttaaacctcatgagccaacctctgctacattccaacttttcttctgtactttcctcacctctctcagccttcatgcaatggaagagagttagtgcctttttctagattagatgttggcttaagggaatgttgtaacaggtttgatcttctatccagactgctaaaactttctccatatcagcaataaggctgtcttgctttcttatcatttgtatattcactggagtagcacctttaatttccttcaagaacttttactttgcatttacagctcggctaactatttggcacaagaagcctatttggcctatcttgactttcgaaatgccttcgtcactaagcttattcatttttacattttcatataaagtgagagaaatgcaactcttcctttcacttgagcacttagaggccattgtagggttattcgttggcataatttcagtagtgttttatctcaaggtacaaggaagcctgaggataggtagagagaccagagacagataattgctggaacagccagaacataaataacatttatcaattaagcttgccatcgtatatggcacggttcatgttgccacaaaataattataatagtaacatccaaggacacttcactcatcacagatcaccataccacataaaataataatgaaatatttgaaatattgtgagaattattcaaatgtgactcacagtcacaaagtaagcacatgctgttggaaaaatggtgctgatagacttgctggatgcaggattaccagaaaccttcaattggtaaaaaataaaatatctgcaaagtgcaataaagtgaagagcaataaaatgaggcatgcatgtatttatagattatattgattttattatgtggctttcatgttacaagaatgacatatctatttaggacttgtgtttattaaataaatacttttctttataaaggaaaatgcatcacatcttttctttattaatgtttgaaaatatttgacatagtataatagaatggaatggcttatttattttttattctttatttatcttcacaactatctctccatatttcccccatctctaacagctatcaaggatttttaataagaaaatgctaacaaatctgtcttaaagtatttttgcactttaactttgagcctttaaaagtgtagttactggtggccaggcggggtggctcacgcctgtaatcccagcactttgggaggccgaggcgggcggatcacgaggtcaggagatcgagaccatcctggctaacacagtgaaaccctgtctctactaaaaatacaaaaaaaaaaaaaaaaaaaaaaaaaaaaaaaattagcccggcatagcggtgtgcgcctgtagtcccagctgctggggataggcaggagaatggcgtgaacctgggaggcggagcttgcagtgagccgagatctcgccactgcacgccagcctgggtgacagagcaagactctgtctcaaaaaaaaaaaaaaaaagggtagttactggtaagatttataattcaccctagataaaggaattgtgtaaaatgttaaattgtctgttaaaaagaaagcctagccaaaacaacaaaataagtgcccttaaatcattttaaatgaaaaaacttggtatgtaaatgattataattgtatttctgacttcatggcaatctttaaaatatatgacaacttatatagtccttagactgatcatatgaatcatacatttgtgtgactatagagaaatttttgccactaaatgtatggaatatgttatattgctgaatgcatatcagcaatattcagaagtaatatttaaaatgtttttaaccaagcttttgctagtttttttccctatgacacgtagttaattttaaaggctaaaatttatgcaatctataattaccaatttcataagggcataagacagaaactaccttataatattaattatttttgaccagtacacataacagacaatctattatgaaagaacaaaatttgtcatttgatctcaggaatattttataaatccatgtttattttgaattggcatcagatacaatgacatttctctcctccactctaatttactacaacattaaaggaaatttaagcaagttttaaaatacagaactatttttaattatgagggggaaaaagaataatgattagctttaaatataaccaattgattgtgtcaacatggtcaagggtagctgctcagacatgtcattcacggatatcgccacatccatcaaactgcattcagggtcctaccaggttattaaatgtatgttacttgaaatattggtgagaaaacaacagaagtattgtatggtttttatcaatcattttagttatagatggttttccatttccttttgaacttagtgttaatattttccagctggaacatttttctaatatatttaatttatatagtgtttacttaataaaattacccccaacattccaaaaatgttgtcaagacataatgttatattttatattttaattctaatatgcccacatttccatattattgtaaaggttaatattaatcataattaaaattttatttctgtgaattaggtgcttaaacaggtgttggtcaccctgaattatcaccaacacaacccacatataaccttttgaagtaaaataatggaatattttacttgatcttggtctcaatgaagtttacattatgagtagtgcctaaaaatccacctgactttaatgaacattagtagaggtataacaaacaaatcttggataaaatatattttctgattagtataggttactgcactgatttttgcttgagattttaaaaatccagcattctctggaagaatatagatttaatcaattctagtattcctgatgattgatgtaaccagaaatattgggccttaaagaattagaaaaacatttagagattgatatatatagattgggctcacattagccataataatatcctaaaactgatgagtaatagtagacatcacctcacccccattctccacacatatgtaagataaccatatttctgatatgttgtcaagtatactataatgtaaaataaacgattttacctgatgacctccaaggtctctttaaacttcatgagcatttgattctatcagacaaggacatgggatcaagaggtgagtggagaaggatgcagtttcatttgtattattgtgaccatagtcatcaatttttaataataccaaatgtgaaaaaaactctgtcattattacttgagtcataggaaaaatgtcttcctgtttcagaaaacatccaaaataaggcccctactggattctgaatttgtcattttctacatttcaaaataattttggttggaaactggcaaaatcattaacctctaagctttaagtcattgcatagttgggataaaacattttaatttatggtggtaaagctataaaaattcaacagtaaaagagaatttaactctgaagattaaattgcataagcttactattaaaataaaacatctcctccattattctttctttgagttgtatcagcaagcttttagatgtatacgaaatattaacaatgactaaaatataattatgttatccaaggttatttttctaattgaggcatttataaatatccatgtggtactttctagtttatgatacttttagggatctctacaaggatacttgcataatatatgtggagagatgtgttcaatcaagtagtcacctaagcagcagaagttgaattataaaaacctaatactgcttttgagattggatgtcaccgcattttacagataactgaaaataatcataactatcaaaagagtaaactaaatggggcatgaatgacttgccagagaattggaagtataaatttttcctacaaatgttagtatttattataatttacttgaaaaaaatggcaaaaaaaattccatgtggctcacaagagtttactgtatagagcttataataattaacttagaaacatttaagaatatgttagccagtaatatttgataaacaattaataaatggattatacattcacctcagtctttgtttttaaaatgtgagatacttcagataaatttttacaagtctcccatttaaatatatgttttatggatactgcctaaaaatcataagcaatattgataaaagtaggatattaaggaaattaatcattttcattcctaatgaaagtggcctgattttttaatacagaaaatttgatatccaaaactttgcatttaagtttggcatgttattagtcaacttgcttaacttcctgcactgttttctacatttgctttgctcttattaaactgaaatgataagcatcctgataaatgaatagttgcattgtatttatatttctctgctacatatgtaacaaatttggattaaccctgtctgtggcattcgtaaatttagaataacgctttattgtctgcattgggagaaacctttcaacctcttgtccatttggataatgaattattgctattcctgtgatatactggcactacactccatccttcttacaatttcagcaagtaaagtgtgcaaagtttgtcatttgtcaaattttaatgaagtttggggaacaaaggaggtgtatcacaatagcattggagattacacaataatatagatatacaactttggtcttagactgcactgcagccatcctcacttgctggtactcattatacaggactctgacttgtatggttatcatgttctgaggccttttaaccataaatttatgactttgtttatcaatcaaaaggagtattcatatgttctactaaacagaaggcttttgtctcaagggaatacgcatcccttagaatgcaaaaatactacttagtcattatttaaatactattggggattttttactgtaaagtgatctacagtaatacatcctgattatacagaaatatgctgtaatgttatttataaataattattcttaacaaaaatgagaggagcacttacttgatttaacaaatttcaaattttaatccaaatatttaaattttcatagattgctatatagtatttatattgtattttcctaatctttttgtaaatgtggctgaaatcatattagaataagacttttgaaaatcaaaaattaagtgtcttttgttaacatagcttgacagtacaataaacacgtttcttaagattgtaatctacaggaagatgtttcagacctattgtgtattattctaaaaaagattaacggcatttttatcttttttcacctataaaacaggggagcaggagaggatttttaaaggtacccttttacctctcataggtatagatagtcataattttagtttgagatatcaaagaaacatgtgcccatgattcaatattataattatgtgatttatacattaaatcaagatgttatcatagtttctaagtcatgttcacatagaagcaagtcatgggtagtgttggctggaaaggctaatagggacggtagaactcaaagttgaatgtttctttctcttgcttcgtaggcagcctccttaactgtggactcctgttctgagaaccaagagccaggatattgtactgtcagtaatgtggcagtttcagatgactggtaaggaataggattagtttaatttttattattacttaaaattttttaaaataaactttatacctaaaaataattataggatgctaagtagtacataaagcttaagatattttatttccctctccaaattttcataatataaaatagtcaataattactgtgcaaaatgtgttaaaatgtgtgaaatgaagtggtagaaataaggataaaattggagaaaaggaaattaaatatagccagtagtctttggaaagattcatgaaataattgcatatgaccttcattctgaaaaacatgtaggataaagacctcagttctttcaaatgcgtttctaaaagtttacgtgaaaattattaacagatatttttccatagcacttaaagctgagcacagcagtaatctaccagaaaataagtgattttaataggaaaaatgataaacagagaaaaataagtagtcacgcatcatgatgcatcattcattgcctcaatcaacttattggcatcccttgcattgatcaacttactgatattctttatcatctcttcagggaaggagcagtgtaatctaacgtaaatattagagttgtcactaattctacagcattttattttccctctgagagtatgctccttcttgttgactcagtattgtgataatatacatctaacttgactaattgaaaacataatttccataaatattattatttttcataattcggaagtctaacaactctgtgtgtgtattggacactcttctacatattttccattgaaatttatcacactataataaatgtcaaaaaaaagctatattcactctttttcgaactaaacattatactaaaaatgtaatcttttgacactaatatttatatcttccattatttatttaggactcttgatgttcagccaaatagagttacagttggaggtatcagatctctagaaccaatccttcagagaagaggacacgtggaaagccatgattttgttgggtgtataatggagtttgcagtcaatggaaggcctctggaacccagccaagctttggcagcacaaggcatcctagatcagtatggcgattttatttcttactgttttaaagaaaaaaaatgcaaaaaagtatgcttcagtgagcatcaaaagatgaaattattatgctcaaatctctaaaaataccaaatgatttacattgttttgaattttaaatactatacctttgaaattttggcataaagtatgatatttaattagaaaattaatatgtttctagattcttatacatatatatatatatatatatgcatgtgggcatgtatatgttttatcctcttacagagagttgtgaagattaaattagttaagttggtaaattatataaaaaagggttccagcacagagagatatgtagatgttagccatcatggacacatagaactttatttcacattaaatagttttacttatagacatacatattcctaaaaacttgatacagctttaaaaacaggcaataacttgattaattatgaactgtaaggcttttttatttgattattaattaggtttctagcaataacttagggatgttagaaattacatattttattttaaaattccttttgttcattatcgaagtttgaaaaattctgaaaaaatacaaggaagaaaacaaaattaacctataatctaaccacccagagacaactactcttaggttattgtcatgttttgactgcttagtatcccaagatgtgaatgtgctatattttaactgttgctatacactttagttatttccaattttattaatataccaattaccctgtgatgaacacattttcacaaaaatctttgctcacattattttttggatgagattaccagaaataaaactattaaaggcaaagctaggaatactttctaatgtttgtaacttaagtattttaataacattttctatttgcctttcttttcctacatgttgttactgttttgttacaaagtcacactagttcgttattattattaatcaaacagtacagaaaaacaaaggattgggattgccaccattgttaatacttcggtgtgcatccttttatatctccgtgttcacacaagtacttttttaaatatcaattttttttttcatttagagatattttgtgaacatctttttaggtcaaaacctactgaaacaaaacttttagacttacctttaactcctctgtttctgttagaccttatgtccagaatgatgtttctgtttgtttgtttgtttgctttttgagacagagtcttgttctgtcgcccaggctggagtgcaatggcgggatctcggccccctgcaacctccacctcctgggttcaagcaattatctgcctcagcctccggagtagctgggattacaggtgcctgccaccacgcacagctaatttttgtatttttagtagagacggggtttcaccatgttgaccaggctggtcttgaactcctgacctcatgatccaccacctcagcctcccaaagtgctgggattatagaggagagccactgcacccagcctagaatggtttttaaaacataagtcagttaacttttcacttcttggctcaaagtgcttcaatagcttcccatctcacccagcttcaaagccaaaatcctgaccctgaatgaaaacatttttatgatctgccatctcccttcacttcctgaacatatctaactattcttcttcttgtgccctgagctccaaccatgttgggcctcggtgtttctcaaacatggcagtacgctttcacttcaaggctttctcactggctgtttcctctagctgaaaagatattctaccagatatacttcattcccttattttatttaggtcttaacaaagattaagattaattcactgcctaatctaaagattcagcaaacccgcaaactcactataccctttctcaccttgattttctctatagctatttttttctttattttctgcctcttccacaagaaaaaataagtacttcctcagtacacggttattttttcattactttacttccatgcttagaacagtgcttagcatatggtaggcattcaataaacattagttgcatgagtatcctgatagacatgtgtcaaaaaatatgtggtccctggatcatatgtattaaccaaagtgtttatttgaccaaggtattttattcaagtaagaattaatttaaagaagaaattgtcacagctttctcattattatataagacataattttttttgaatcttctttagtgtgaggcagactatgttttctaggaaaacttctggtttgattagtttctccaaatgtagttgtaacttgagcttcaaataatggagtgcttgaaattaaacaagctaataaaagtgtatattgagttttagcaaacttctcctcatcttttatgtgcgttattgttctcattatgatttattttagatgccctaggctggaaggcgcttgtactcgcagcccatgccaacatggtggcacatgtatggattactggtcatggcagcagtgtcattgcaaagagggactcactgggaaatactgtgaaaaatgtatgtaaggtcttccgtcttcccctggaaattttaataactatgaaaagtaaaatatatgcacccaagtatgtaatcaaattaaaaattatgctttcattctaaatattaaaatattaaatggacaataattggtaaaatacagtgacattttaaaaattatttttgtaacctgaagaagaatgatatccttttaaaaaatcgtttactaactaaatctctagcttccactttaaaggtattttattcacttatttttgtttgttttatttcttagaattctaggcaatctaaaagatcaaaggttatagttaggctttttttcatattatctgcctttgggggatatttttctggtgaatttttgtgcataaaaaggtatacacactaaatcactcaacactgagatcaaaacatcatacagagccatcataatatgttaaaattaatgttgatactttcattttaatgtacaagtagtagaattaattttgaatattactttttaaaatcctttcatcattgtcttctaagcctaatgttattatttagacattaatgatgttcatatcatcattagaaaatggtgctctctaatttcgagctgcacatctcactaactaaccctaatggttcctcttttgtaaaaattcttcattttcaaacaagtggttactacttaactccattgcaggtatctgactacatttaaggagtcatttgattaaattatattatgaaaacaaatagaaatgcataataaaattgaggatataatataatctaaaaggtcttagcagaaagtgtaattgtgtgtaataatattagatataatgaaaacatagaaaatatatactgtcatgtgattttcaatgtaataaatatttattaaggagcctaattatatctgaaatatgagtcattggctagataaataccagagacactttttcttaaatcatgatataactcacatactataaaatgtattcttttaaagtgtatctttcagggctgaaatccatttgagctcattttcttaatattctttctttagctatattatttgtttctataacttaagcttcaatatttctggaatgtggatttttttcagattacaataaactataatatacatactgattatacatgatgataaattatatgtgatgattactgaaaataaagttagttaccgatgtaaatacttgattgaacacttctttgtcctaatttatagcatactagagactaaagattacaaatcattttaaccatgcaaacgtatattttggaaacacagtgaaaatgattacaaacaaatttttcaagtacatattaccaacaagtgcctgtctttagatattcataatttacgtaatgtggcaaatagtttagtaaaatatttcccaaatggttaatgactgtcatagagtattttaagttcatggttctgaaatgcatttaaacatgtgaaatcaacttatataatgattcataaatggaaattattttttaagagtagagttgggggacattaattcccaaaacgacattttcattgtcctttttatatttttgtcactatagaaaacactccaagaaatgccaaatgaatgcattcattttcccttttttcctttgacttccagctgttactcctgacactgccttatcattagaaggcaaagggcgcttggactaccacatgagtcagaatgagaagcgggaatatttgttaaggcaaagcttacgaggtgccatgttggagccttttggtgtgaacagtctggaagtaaaatttaggaccagaagcgagaatggcgttttaatccatatccaagaaagcagcaattacactactgtgaaggtgagataaaagctaatggtgacttcatttgattagaccgcctgccgtgtagtggtttaaatcacttcccccataatttctgtccttttctttacaacccattagagttccgactaatgctgggcactattccaatgtcatctatcttaactattccccaggcattggccagagtaacaaagatctgaatggtttggtttctacacacttttgtgttgctttagagtagagaaccctgccaggtaggccagcacacaaagaattagttgcaatctatttttctggtaagaatttatatcacttcttttcttacttttagacaaagcaaaccaaaaatataatgtttgtttgaaatacaaaaatatttttctccaacaattatttcaaatattgatatgtatatgtcaattgacaggattagaataaggaaaaacattttgaaataagcaaaaacattttgaaattatatgatttctggagcatatattcaattctctatataaactctgtggagtaaagtatatttggaattcattataattttacttaacctttccaaataatttttaaataatcttaaaaattatgcttcatgagaacaatggatttatcattaggcttttacataatttgttttttcttatctgtaaataagatactagacttatatacagatgaataatttcattagatatccatttttgcatcggcccttagctttctgaagttttaaacctatgttctgctttctttcccacaaataagtcatctcctagaccaacagtttctttagtttagttatatttactgccttccattaatattactttgtatcattctactgataattttttatataaattttagtaaattcttaagataacaaatccagatttcctgaattattttcatctattagtcaatatttaataactactccagggatagttcacagagaaaaagagcaatttgttcagaaaaattatttggtttaattcacatataatactaaaaataaaaatagatgttcacttctaaacttcagcctctttcatcctcaaaatttttctctgtgcaagccaaccatgattatgttgcatataaatatatttaataagtagtacaaaaaccaatatttcttaccttctcaaatgataattcctctagtccagtcatttccaactaggatagattttacccccatgggacatttggcaatatctggagacattttcaattgtcacggttaggagttgggagagtacttctggcgtctagcggtagaggtcaagaatgctgctaaacagtagcacttcacaacaaagagttatctggccccaaatatcattagtgccaaatggcagacactctacccttttcccttacaagagaacatcttcaggttttaactttacctctattgaagcaaaggacccagttccagagttaataaaacaactgtaaaagagaacacataagccattgtattacattattatctggtacttataattttcattgaaaatggtattagaagtaaacaaagtaaagaagcaaaaaaagaaatagatcctcatcttctataagaaacatattttatatggtttgagaggctttgacattgaggtctgtgtgttatctgttaagttgcttccaagtcttcgtgccatttaaatgacatatgaaatatttctgtactaacgtacacttaaagccaaggaattcagtcaaaatacaatgtggttgaaaaaaatcagagacacatttttttcttcactaaggaaaaagctgaatgtcaggatccatttttgtcaccataaattcttctacttccaacaggacagcgcatacaactccagattttgttagcttggtagcaataacttaatttttttcctgaaaggaaagtaagtgcaaattaataaaaaaatgaataatacagaccaaaatgcatagttttatatgaaaattttgaaaagaagcttttcaaaggggcttggcaggtaaagagaataggtaagaaaaaataacaacagtgaattaagaataactaagtaaaccaaaagaaagtggctgttgtaagcaggcaaattatttggatgataggagtatcaagtgcttatacagactaggaagctagttaggatggacttttacttatcaattagcttattggtcaccaagaccccagggttccgttttttttttttttttttttggctccttttctgatcctttctttaactctttcttatggtttgcattctctctctctcattctcttttctatcattctttctctctctctctacagacacacatacacacacacacacacacacacacacacacacacacgcagacagaagatgaggacattttgtgaaaaatgaggaagggtgttgggtaaatgggattccatgtggctagaagagagagagggtgtcagtgtcaggtgtgggcagcaatagtgatgagaggagagagaagaatatgtagaatcaattgggtctattcagaaaaagaaaaaattaagaaaagaaagtttcagagagaaaggcaaaaggaaagcataattgtgtaaaactttgtaggccaatatttaactcatttcacaaatctctcttcattcatggcatgccctatagctccatatttgatgttctgtaataatagtaatgtgatggactttatttctactctaaatcagttcttttgtgtttgtctggtttttttaagtgggcaacataggtgatacagaataattggaataaggaattcaaagctctatagattcaaattaaataaatgaacaaataaatgcagtcatgagttgcataatgacaggaatgcatttcgataaatgcattgttaggtgatttcattcttgtgcaaacatcatagagtgaacttgctcaaacctagatggtacaacctactatacacctaggctatatggaatagtctattgctcctgtgctataaacctgtatggcatgtttactgtactaaatactgtaggcaattgtgacacagtggaaagtatttgtgtatataatcatatccaaaaataaaaaaggtacagtaaaaaggctgcattgaagatttttggggggatgggggacagcctgggcaacagggtcttgctctgttgcccaggctggagtgcagtggcatgatctcggctcactgcagcctctgcctcctgggctcaatgtatcctcccacctcagcctcccaagtagatgggactacaggtgtgcgtaaccatgccgggctaacttttgtatttttttgtagggatgaggtttcacatgttgcctaaattgcacttactgtgactgaagcttgtaggactgaaagttgctctgagtcagagagtcattaagcaagtggtgggtcaatgtgaaggcctaagacattattatacacttctgcagactttataaacactgtatgcttaggttacattaaatttatcaaaaatatttttcttcaataataaattaactttagcttactgtaactcttttagtttataaacttaaaatttttaacttttttctcttttgtaataacaattaaaacacaaatacattgtacagctgtacaaaaatattttctttccttatacccttattccataagctttttttctattttaaaagttttttatttcattttatttttacttttaaacttttgcattagtaactaagaaacaaaaaaacacattagcctcagcctacacagggtcagtatcatcaaatccctgtcttccacctccacatcttgtcccagtggaaggtcttcagggacaataacacagatggaactgtcatctcctatgataacaatgccttcttctggaatcccacctaaaggacctggatgaggctggtttacagctattttttatatcattagaagcagtaccctctaaaataatgattaaaaaaacggtgtagtaaatgcataaaccactaatatagtcatttattatcaaattgcatgtgatatacttttatacaactggcagctcagtaggcttgcttacacctgtatccccgcaatgagtaattcgttgtgctatgacattacaatggctactaggtcactaggcaataataatttttcagctcctatggttcatcattgactgtttattaataaataaaaccaagcaaaaattagcatgatgttttaaaagtgaagaattatataagtgttaagtacagtactgccagggagaaggaaaacattaagaatgttataatgggaacttatattcttatccaccccaatttgtggtatattccaagtgctctttcatcaaaaatttattgaataaaaggatgacatgatgaaatcaattaggaggaaagagctgggagaaggcttttcctttttttttttttcaaaaaggactccagctataaccaaagaaagttgctgtttttactgtgtgtcatgagatgttgcccatttgatgaaatgttattgtcatttagctagaattttctgttttttttttttagtttggtactgaaatatattattatctggaaaaattggctttaataaaatattgctatatgaataacatatgtaaatgtgttagacatcttttcggtaaagtacaaatgaactgatttttagttttaccagatgtgtttgttacatgtagaaatagcatttgatctgagtgacaaaataaactgatccatcttttcattcccgttatttgaggaacagtgccactgcatccccctgccaacacaccagctctgtctggcagtggtaacaggattatgctccctgaaccaaatgttcatcttgcctcataaattatctcattttctaaaatggtctactcaggatactggaaactcggtagctggaaactggagtgggagcaccctgttacccaatgttctcctggacaaaataaaataaaccaaatatcctttagataaattgtaaaagacagccaaagtgaaggcttgcccagacacctcattaagaattcactctttgttcatcatagtttttgatctcaataaatgatataaacaataggcatcattttttcctaaaatttgtgtgtaaaagatgagaggtaaaacaattattttcatctttatttttaaactatgcttcccttttagctgagcattctttttctttttgcaagtggttttcacaattttttagtactatgggccttttactaaacgaaccagcataacacactccaatggcaggttgtcattggaatacaaataatttaaaaaggtataatttaattatcttaaatggacattcgcccctttattatttcaattgtgttctggaaaataattcatcaagttttgagaaattaggtatacatataagaatacgttgaaaaccattgaaacttaaatgtaaaagtacatgttgcctaaaattagagacaaagtgtgtaagtatattctaatacaaccagattcttcagctattctatctgctgtggactggtcaaaaatttaagtttagttttgttaatgatttttatttaagcataccatattttaattgcatactatttttaatatgttttacagattaagaatggcaaagtatattttacatccgatgcaggaattgctgggaaagtggagagaaatattcctgaagtatatgttgcagacggccactggcacacttttctaattgggaaaaatggaacagcaacagtattgtctgttgacagaatatataacagagatattatccaccctactcaggacttcggtggccttgatgtgcttactatatcacttggaggaattccacccaatcaagcacatcgagatgcccaaacaggtaaatgcctttattaagtagagtcacaagggaagtaaaattgttcttcaaaaagtaattgctttttcttgtggcaagactacacatttaacatgaatctcatatacagaacaatttcattcaataaaatttatgtttaaaaaagtagtttgatgtctgataatatcaattataaatatcctaagaatgtcataactatcttcagaaagtttgtaataaactattagccaccactttctcgagagcttgcatctttcttaccaaggttgtaattcagtccatagtgttttgatgctttgcttgtccaccaagcatttcatatacatttgttcatttatttattcattcacagccactctcttcatagaccattaatggagacaaacattaatcaaattcttacacaagtaactgcattattctaatgtgtgataaataatacaaatgaagaatgtagaattctaaaatatagtgaaaaaagagaaaggaaggggaattttgctgtggaattgacatgtatacataaatctgaatgatgaggaggatgaaagtgtacgaaaggttaatttatgttgataggaatttttttaaagaaatcgtttaagccaaagttatagaagacaacacattggaggctaacatcataggcaaatgatgaagttggagaatgaagcaacttcctgaccatgttgcagttttggtcttatttacagagcaatgggaagtaattgaaaactttaatcacagtaggatcaagttagatatgcagtaatattacagatcattcaggctacagcatggagaatgaattggaggaggacacgagtggatctacagaaatgagttgggatctgggcaagatgtcttctgagctcctactagtgtggtggctgaggagttagaaagaaatggataggcaagaaatattctgggaactaaaatcaaccaaactgttagtgattatggtaaaattcaaggaggtttctacttctcaactcaaagaagggtaggtcagcaagagaggaaactgcagaaccctccaaaagcagcatatgtctgagaaatattagatttggtttgggacattttggatttgaagcatctttgagaaaatcctttggatggatgggctggaaatcagaaatagactttagctggaaatatatatttaagagtggtcagtgtcaagcaggtaactgaagtactggacatggatgtgatcacctaacatgagggcgtagagtgaaaagaaagcctgggacgtcatcttgattaaccgtaagagttaatggttatgtagaggagaataagtcggaaaagaagactaagtaataggaagaaaatcaggagtataggaacaaaaagaaaagatgtcacaaaagctcatggaaaaaatatatcaagaatgagaatgtcactatggtagaatgatgcattaaataagaggaaaaaaatgcatgtgagactaatagatttaaggcataaaagttaaagtccaggtcataagtcctttttatatggttattatagaatgttgtgagaaaacaaaccaatggaaattacgctttttgtagtgtcaaaatagattgttgggccctgagataggaatatcagcactgttaacacactcaagtgtaatgaagtgtttcttaactttgcattttatctttatcattcccctaaggagacacttaatatagtctaaactttgccatccccaagtcataaaatgttaacaccagaggtatgtttttatctgccttttagaggcccacaaaccattgtaatagctaagatttttttgttttgctccccaagaacctatgttccacacctttggtgtattatcaccttcaatgggaatgcatgatttagtagttgaagccattggcctatttcatgttctttacaaatttaaaaaatatatattttatttgtatgtatgcaatttttggtatatgggatgtaaaaaggaaggaaattgataaataaatgagtaagaaaaagaaaattcagcctgcccaagtcattcataaatcttcagaatgagtgggattcaagcaatctgacccatgtttggtcatggtaatcttaacgcaccttgctaagttataagatgcacagcttaattatctttcagctggatgatggttctgagactgaggtttctgtattcatgtattcatatgaggtgattgtggagcttctctttacaagaacccagcagtgtagtataagctctttttttttttttttttttttgtaaaaagccttactccttcttcttctcccagcaggttttgatggctgcattgcttctatgtggtatggtggagaaagtcttcctttcagcgggaagcatagcttggcctccatctcaaaaacagatccctcagtgaagattggctgccgtggcccgaacatttgtgccagcaacccctgctggggtgatttgctgtgcattaatcagtggtatgcctacaggtgtgtccctcctggggactgtgcctcccacccgtgccagaatggtggcagctgtgagccaggcctgcactccggcttcacctgtagctgcccagactcgcacacgggaaggacctgtgagatggtggtggcctgtcttggcgtcctctgtcctcaggggaaggtgtgcaaagctggaagtcctgcggggcatgtctgtgttctgagtcagggccctgaagagatctctctgcctttgtgggctgtgcctgccatcgtgggcagctgcgcaaccgtcttggccctcctggtccttagcctgatcctgtgtaaccagtgcagggggaagaaggccaaaaatcccaaagaggagaagaaaccgaaggagaagaagaaaaagggaagtgagaacgttgcttttgatgaccctgacaatatccctccctatggggatgacatgactgtgaggaagcagcctgaagggaacccaaaaccagatatcattgaaagggaaaacccctaccttatctatgatgaaactgatattcctcacaactcagaaaccatccccagcgcccctttggcatctccagagcaggagatagagcactatgacattgacaacgccagcagcatcgccccttcggatgcagacatcattcaacactacaagcagttccgcagccacacaccaaaattttcaatccagaggcacagtcccctaggctttgcaaggcaatcccccatgcccttaggagcaagcagtttgacttaccagccttcatatggtcaaggtttgagaaccagctccctaagccactcagcatgcccaactcccaaccctctgtctcgacacagtccagcccctttctccaaatcttctacgttctatagaaacagcccagcaagggaattgcatcttcctataagggatggtaatactttggaaatgcatggtgacacctgccaacctggcattttcaactatgccacaaggctgggaaggagaagcaagagtcctcaggccatggcatcacatggttctagaccagggagtcgcctaaagcagccgattgggcagattccactggaatcttctcctccagtcggactttctattgaagaagtggagaggctcaacacacctcgccctagaaacccaagtatctgcagtgcagaccatgggaggtcttcttcagaggaggactgcagaaggccactgtctagaacaaggaatccagcggatggcattccagctccagaatcctcttctgatagtgactcccatgaatctttcacttgctcagaaatggaatatgacagggagaagccaatggtatatacttccagaatgcccaaattatctcaagtcaatgaatctgatgcagatgatgaagataattatggagccagactgaagcctcgaaggtaccacggtcgcagggccgagggaggacctgtgggcacccaggcagcagcaccaggcactgctgacaacacactgcccatgaagctagggcagcaagcagggactttcaactgggacaaccttttgaactggggccctggctttggccattatgtagatgtttttaaagatttggcatctcttccagaaaaagcagcagcaaatgaagaaggcaaagctgggacaactaaaccagtccccaaagatggggaagcagaacagtatgtgtgaagtttatgtactggcactataaaatataaaaacaagaaataatactcaaaccattgtaaagttgctgactaggttgggtcacatttgaaaaacaggccagtatggactagtggtggagggaaaactttaaaaataataaccacaatgctgctgaaacagactcacaacaactcttaatttaaacatgtgtggttgaatttatttccctgcatgcattgtgttttgtaactagttatgtggcatgcagcatttggaaaatttttcttatttaccagtgtttgatttgtgatttttaaaaattgatacctttaccattgcagaaaagaacttgtgctttcccagtggcgtatgtgtattgtttcaactgtattattataattatattttgcattgcaagattcttgatgttaaaccaatccttgtaaagtgtaaaaaggaaccctcctatcgtggaatgaaagattaagtatattaacacttttcagaatgatagtttctgtatttgatgttgctcagaaatgtctcagtatttgagtaagttttacatgacagtgggtactgaaattaagtcattttgttcagcactttaacgctttcttatagaattgtcttaaaacttctggatccttgagcaaatgattatagtctcctgactttcatgaggcttccattaggaacagaatgattgcatgttgtccccagaacactgccaccttgctatgcgaatgatgttctcagcagcacttctaagaaacactcttaaaagttatttattgaaaatttttcgtatgcttttaatattttaaagaattgacctaaggaaagcttatgattggacttattttccaaccagataacatttactctaagtacccagtttttataatttatatgaaatcagatttcaacacttactttgtcattttgtagatcatttttttaaaatactgtgtaaaaactttttttacacctaagctgtgtttttgatactgatattttcctatgctgaatagttttcttactttcagggaaggtaagaaaatactttttttatatttgttacttatgtaacattcatatttttctcattttgatatttgtaacatactgtatgctttctacttgtaaatgtcaacaatagaattaaaatatttatttaaaata

SEQ ID NO: 2492 - DNA, 10723 bp, Homo sapiens
  source 1..10723: mol_type = genomic DNA
tccaagaaggggacaaatgtgggaggccatcactgccccattttattgatgcaggctggacaggaggactcaccacctgagctggggatactcaggtcctggggtgctgaggagatggggctgcatctggagagggtgctgttggggtgtactctcatctggagagggtgctgttggggtgtactctcatctggagagggtgctgttggggtgtactctcatctggagagggtgctgttgggggcactcccatctggagagggtgctgttggggtgtactcctgggaaggcaggggccatagaggagcgggagatgtgtcagctgcctccgtttgggtggcagaaaatgtcacagggacctttcagccacaaagaggcttttaggccgtggttgggggtcttcagggtcttgctctgggcctggctgtatccatgctcaagagtggagaggggcagagggggtgggcaggcggccgtcagggtctggtcttgaatcaggtcccatggactccgcggaaccttcgctggctggcggcgtgcatgtggccagccggtcgcacacccaggcgcccagcttacggtcgcagaaggcgtcgttccagcgaccggagccccgcatcatcacgcagtcctcgccctggctccggctggtgggctcccctggagcccagttgctggagcaaaaggctttgggtcaggggatggggcggggagaaggagcccagttcccggcagccctctgagtctgcaccctcccttctcaccccaggttccccatcctgagtctgtgcctggggaccggtacctcattttggtgccccataccctgcagcccaagactcacccttatttatttgtttgtttgtttatttatttattttgttgagacagaatcactctgtcgcccaggctggagtgcagtgcgcgatctcagctcactgcaacctccgcctcctgggttcaagtgattctcccacctcagcctctcaaatagctgggattacaggcgcccgccatcatgactggctaatttctgtatttttagtagagaggggtttcgccatgttgaccaggatggtcttaaactcctggcaggtgatccacccacctcggcctcctacagcgctgggatgacaggcacgagccaccctgcccggccaagactcacccttctaatctgtgcatggaacttcctccctgagccccttcctctatatcccctcctccaggtcagagaagccttggccaggtcccccagcccccactggcgtccttctcccctgcaccctagagacccttatctctgagccctcatccgctttccgatgcagtttatctagggagctcctccctccacggtatttccatctcctcccctggatcccagaggccccctcctcacctgtagtccacgtggctcccatccacccagataaactcccccttcaggtccaagttccgaaggccaatccaggagccggtgtggctggcatgcttggtcaggaagtcctgggggacaggacagggctggaggactggagacatgtgcccggggccttccagcccacttcgagaggttgggtagagtggggtgggggtccccccaccctcgccatgctgcccaccacctctgcagagccccagcccacctgctcctccgggctgtggatgctgaccagctgcccttccatgtcgtcacaggcataccgggcgtggacccactgcttggtgcccttgccgaagtagtagcacttccgttggaaattgatccacttttcagggcacgtgttgcacacaaagcctggggtggaggagaggctcgggggtggggccaatggaagtgccttgggcaccctgggcagactaggtggcagcacccctcctagggccactcctggggtcccggctaaaagcagacccaccccagggcctaacagacagcctcacgggctgtgttctctgctggagctatgatgctgaccagatccatagtagaagcacctcagccaccatggccacaaacaccttcatggttagcagagcacggtgtcgaccatcaacacctcaactaccatcagcatctccacaaacacctcatggccagaagcaccacaagcaccaacactgccaccacacattcatgtccaatatggtcaacaccatgaccacaaacacactcatgtccaacaacacttcaaccaccatcaccacagacacctcacggctagaggtccctcaaccaccagcaccatgaccacaaatgcattcacgtccaacaacgcttcaaccaccattatcaccacagacacctcacagctagaggcccctcaaccatcaacaccatgaccacaaacacactcatgtccaataatatttcaaccatcgtcataaccacagacaccccacaggtagaagcccctcaaccgtcaacaccatgaccagaaatgcattcatgtccaacaacacttcaaccaccagcatcatcgctacaagcaccaccatggccagaagcacttcagttgtcattataatcaccttaaatccaccacggcttgggaactcttcagtcaccaaagccatgaccacatcaccggctccacagccagcagcacctcagccacaaatcccatcatcacaaatgcttcacagcgagcagagcatcaatcaccaacaccatcgccatcgacagctcatagaagtgcctcaatagccaccaacatcaccataaatccatccatggctagcaacacttcaatcaccaacattatcacccacatcaccagttccacagccagcagcacctcagccacaagcaccatcaccaacagcactttcaccaccctcatcacctcaaacacctcatgccagcagcacttcaaccaccaacaccagcaccacaaatacctcatggccaaaaatgccaccaacaccatcatcacaaatgccttacaggcagctgaatatcagtcaccaacatcatctccacaaacaactcctcaaccaccattacatcatcataaatacacccatggccagcaacacctcagtcaccaacaccatgactacattgccagttccacagccagcaacactgcaactgcaaacactgtcaccacaaacacctcccaactagaagcacctcaaccaccagcactatcaccacaaatacattcatgtccaacaacacatcaactaccaacaccattgtcacacattcacattcacgtccatcaacacatcaaccaccaacaccatcagcacgaatacattcacgtccaacaacacatcaactaccaacaccatcaccacgagcacattcatgtccaacaacacatcaactaccaacaccattgtcatgaacacattcacgtccatcaacacatcaaccaccaacaccatcagcacgaatacattcacgtccaacaacacatcaactaccaacaccatcaccacgagcacattcatgtccaacaacaaatcaactaccaacaccactgtcatgaacacattcacgtccatcaacacatcaaccaccaacaccatcagcacgaatacattcacgtccaacaacacatcaactaccaacaccatcaccacgagcacattcatgcccaacaacacatcaaccaccaacacctttgccacaaacacattcatgtctaacaacacatcaattaccaacaccagcgccacgaacacattcacgtccatcaacacatcaaccaccaacaccatcagcacgagcacattcacatccaataacacatcaactaccaacaccagcaccatgaacacattcatgcccaacaacacgtaaacccctaacactgtcaccacaaacaccttacagccagcagaacgccagtcactaacaccatcgccatcagcacttcgtggttagcaacacctcagctgacgccaatgtcaccacaaacacctcatggccagaagcagctcaaccaccaacaccgttattataaatacattcttgaccatcaatgcttcaactgctgacaccattaccataaatacatccatggccagcaatacttcaatcaccaacaccatgaccagcagcacgtcagcggccatcactgtcaccacaaacaccttcatatccaataacacttcaaccaccatcatcaccacaaacacctcatagccaacagtgcctcagccaccaaccccatcatgacaaacacctcatggccagcagcacttcaaccaccaacaaacccctccaaggtcagcaacaccttcatcaccgacatcattaacagaggtacccaccaccagcagcagcttatctccaccacccacaccacagccaacaccatctttaccaaccacaccagccgtgtcttcatcactggcaccgacagcaaaaccagtgctgtggccaggtccaccagcgattactttccccaagcaccatccctaccaacagccctggtcatcatcactggcagaacccgccaaaccagcactcctagccaatgtctgggaaattgtgatgattttcttccagtgggaggctttggtcaggagagccaatgggattgcaagactaggtcccacaatccctcaatatggtctctttctccccttccccccaccgcagtgaaactcccagacattgttgctatcgcctcccaggtggaaggttaaacccactcttactggatcaaatctttcttgcttcaaaatagattttcagcagtggtgtgcacctgtaatcccagctacttgggaggctgaggcaggaggatcgcttgagcccaggagtttgagaccagcctgggcaacatagcaaaaacccgctttaagtaagtaggttttcctatagtgatatgcagggaaggttccactacacgtggtcagatgttttttgttttgttttgttttgttttgagacagagtcttgctctgtctcccaggccagagtacagtggcgctatctcggctcactgcaacctgcacctcccgggttcaagcaattctcctgccttagcctcccaagtagctgggattacaggcgtgcaccaccatgcccagctaatttttatatttttagtagagacggggtttcaccatgttggtcaggctggtctcgatctcctgacctcatgtgatccacctgcctcggcctcccaaagtgctgggattacaggcatgagccaccatgcccagccacagatttttttttttttttttttaaagaggcagggtctcatcatcttgcccaggccagtctcgaactcctgggctcaagtgatcctcctgcctcggcctcccaaaatgctgggattacaggcgtgagccaccacgcccaccctcacatggtcagatttttctaaggagcttagggtctgcagtagcttgagatgagtgtgcttctcacccatgaaatggtaaccagtactcagccctctggaggtgcagcgttaaaacaggaagaggtggccaggtgcagtggctcatacttgtaatcctagcgatttgggaggccaagatgagaggatcacttgaccccaggagtttgaggccgtagtgagccatgattgtgccactgcactccagccttggtgacagaaccaggccctgtctctgaacaacaaaaacaacaacgacaaaaacccaaaccccaaaaccaggaagaggacatttctgagccctcaaagaaaacttcaggggaaggtgtcttggttgtttgttacatagtcacccagagacaacctcagagccaggctcagatcccaggctgtggggctggatttcggggagacttcagggactggggaagaattaggaggtgacctgtcagaagttgtcatggtccagagtgctcttcccctgtgcctctccctgagggaccacactgaggtttctggctgggattcccaaagccacttcacatcccaggggatgggactccatcacaccaagcacagaaacttcctcttctctgccccagttagggcagctggggcttcccagaggtcaaagaccaaaaatcaagggtgggggcattagctggcggaacggcagggctgtaaaaccccagttcctaccgtacagtaattttttttttcttcagaggcaaggtcccactctgttgcccaggctggagtgcagtggctcaatcctagctcaccgcagcctcaaactcctgggctcaggtgatcctcccacctcagcctccggagtagatgagactacaggtacacatcaccacatctggctaattttttcatgtttttgttgaggcaggatcttgctgtgttgcctaggctggtctcaaactcctggactcaagtgatcctcctgcctcggcctcccaaagtgctgggactataggcgtgagccagtgcacctggtccctaccccacattaagggtacagtgactgaatgtctgctctctctgcagcctgctagcctcctgaggtcaacactgcctccattactgccacccctgggaaagaggccaccatctccattgtcccatcactgcagacattacccccgtctggctccctgccctggtcagacaatctaccaggaaggctatgtgtatgagaatcctactaataactcctcactgggccacatcaggcagaggacaccagcaaggagaacccagcgagggtcaacactggactgctttaacgcagaagaggaaaaaaattgtaggagtctccaaatctgtgaaaggacacagttggaatcagaaagaaattgccaggcaagatggctcatgcctgtaatctcagcattttgggaggccgaggcgagaggattgctggagcccaggagttcaggaccagcctgggcaacatagcgagatcctgtcgctacaaaaaataaaaaaattagctagggccaggtgcaatgacttatgcctgtaatcccagcactttgggagactgaggcggaatgatcgctggagtccaggagttcaagaccaacctgggtaacaaagtgagacactgtggctacaggaaaataaaaaattagcctggcgtggtggcacacactcgtagtctcagctactctggaagctgaggtgggaggatctcttgagcccaggagttggaggctgcagtaagctatgattgcaccactgcatttcagcctgggcaaaagagtaagactccatctctctcttttttttttttttttttttttttgagacagagtctcgctctgttgccctggaatgcagtggtgcgaagacagcatgatctcggctcactgcaacctctgcctcccgggttcaagtgattcttgtgcctcagcctcccaagtagctaggattacgtatgcccgccaccacacccggttaattttttaaaatttttattgagatggagtctcgctctgtcgccaggctggagtgcagtggcgtgatcttggctcactgcaacctccacctcccgggttcaagcaattgtcctgtctcagcctcccgagtagctgggactacaggcacgcaccactacacccagctaatttttgtagttttagtagagatgggggtttcatcatgttggtcagactggtctcgaactcctgacctcacataatctatccgcctcgacctccctaagtgctgggattacaagcgtgagccaccgcgtccagctaatttttgtatttttagtggagacggggtttcaccatgttggtcaggctggtctcgaactcctgacctcaggtgatccacccgcctcggcctctcaaagtgctgggattacaggtgtgagccaccgcgcctggccaagaccccttctcttaaaaaataaaataagcggtgttttatgtatgctctgtgtgtcctgccccatcagaaacttagtcctatttccgtcatcacgcacacctctgcctcgcatccaagcacactccccaccctgcgcttatatctttgtgtcctcccgatgacactcgggtcacacaaacgtatagacatgctgcctcacgtcacacgtgcgtgccgtcacatttgccaacacgcccgagccccaggtgaggtcacgcgtcgtcctgagcagagactcacacactcaccgctggacacctgcaactccatccttagctttgtcacctcctcccggagtctttccagcaaatctgaagcttcgttcctctcgttcaattcttggggagtcaacaaggggcggtgctcagagaccaactggcaggccccctccttgtccgttccctcccccactgccccatcccctcccaagcctcaccctgggacttgaagctgctcagatctgcttgaagcccgttcaggttccaggacagctccaagtctggtgtgtgcaggagcgcagggctggtctcagggaggatgtgtacaggccgagggtgccccccaagcctggccccccagcctcgtggttccccagggctctgagacactccctccttcccacccaatctggcttcataaccccgatcccagtctctcaccctgagatttcaatctctgctgttcagctcgaagttcctccagttcctgtgaaatctgcgtggctgtttgcaggggagggggcttcatggtaagcaggtcctcattgtctcccccatctacccccacccatcccttggtctctttgcctgggttcttggaaccacctgctcagtttgcagttcccgggtgtcgggggtggggcacagtgagtcttaatgctctgggtccaggaagtcatccaagaccccctcgctttttcccctgcaaccccaactccaggagtcactcacactgggatttctgcgccatctggtcaccgtggtggctttccaagttcttggaaacttgagagactggagcggcgggagagaagagatatcccaggaacctcaaaggcaggtccttggaccccgcctatgccccaggctcagggaccctctcacatagtcacaacagctgctgttgctgtttgttcatttactggagcaggaggagtgtactcaggaaggtatatgcaagaatataatgaactactgtgtacctctccctcacccagggttaactataaaagcagtaggcgactatcagggtacttcacaaatcttagagcttgtttctgtctcacggcactaaaagtatgcccattttacagatgaggaaatggaggcacaaagcagttacaaaatccttacactacagatgcttaaggctgccaacttacaatggctcaacttacaatagctcgagttacaatggctcgactttacaatggtctgaaaccaatatgcgtttagtggaaaccttaactctcttgcaatgctgggcagtggtagggagccaaagccttcagccagccacacagttttgacttaaactattttcaacgtactttgcgcttatggggacataaccccattgcaagcggaagagcatctgtattaggatgctatcaggcacttttccaagcttccctgggtccccgccttccctaggacagggagcaacttagtttgaccttcagttccttagcgaggggacactgaggcccagagaggagcgggatgagtgctgggcatcctaaccctcacccccaccccctccaccttgaccccttcataccgttccgggcagccctctcttccagctgttttagactctgtgtggtgtcccagtctggggagggggagagaagaggagtggagaggggggattgtcagtgcccccacctgcctgcaccccacctcccagctggggatggaggtcttgggtataagccatggaggtgctgaaagtgtggaggacagggatgctgggtgtggggtgaggggctctggagggtgggggatgggaaagggctggcagtggcaagatgggaggcaggatgggaaaattgggttttgagaggatgcgttgggctcccccagctctgagatgggggtgaaggagggaacacagaagggccccatgagttggggggaccacatggagctgggggtgtcctcacgccacaggagaagcagagtcagcagcccagcccacagagcggcggtcaccagccccagcagcacgatctgagtcccacgcctgcaacaccgcctcctgggaagctcctcgatctctgccgggggtggagggactgactatgggtgcagggtgaagctggatgctggccctgtccgtctctccattacccagagcccccgacagcctgggagcttgtccagagcccacactgaagcaaagggtctcagtggacccccagctccatttgcacagcttccttacctgactcagggctgggtcactgaccacagagacagatctgggactaagagctaagactccctcagccccaacaaccaatgccaggcccccagcttcacttccagaagactaggtcctgctttttccttcccctctgagccccaacgcccacccttacacctctgcacctgtccccaacctggagtcccttccctaaacccaggacactgagtcccagttcttccccaacatcggagccactccccagccactttcccaggtgtcatccaacatccagacctccaaacctctcccagaccccacccaaaggtctatctggatgtcccacctcaagcccctggccctctgcactcaccctggcttggaggattcattatgctaaattctgcttgttccaagttcctgttctatttggcctctgactctattgggctccccgctccctagctgaagccgtt

SEQ ID NO: 2493 - DNA, 13390 bp, Homo sapiens
  source 1..13390: mol_type = genomic DNA
tccaagaaggggacaaatgtgggaggccatcactgccccattttattgatgcaggctggacaggaggactcaccacctgagctggggatactcaggtcctggggtgctgaggagatggggctgcatctggagagggtgctgttggggtgtactctcatctggagagggtgctgttggggtgtactctcatctggagagggtgctgttggggtgtactctcatctggagagggtgctgttgggggcactcccatctggagagggtgctgttggggtgtactcctgggaaggcaggggccatagaggagcgggagatgtgtcagctgcctccgtttgggtggcagaaaatgtcacagggacctttcagccacaaagaggcttttaggccgtggttgggggtcttcagggtcttgctctgggcctggctgtatccatgctcaagagtggagaggggcagagggggtgggcaggcggccgtcagggtctggtcttgaatcaggtcccatggactccgcggaaccttcgctggctggcggcgtgcatgtggccagccggtcgcacacccaggcgcccagcttacggtcgcagaaggcgtcgttccagcgaccggagccccgcatcatcacgcagtcctcgccctggctccggctggtgggctcccctggagcccagttgctggagcaaaaggctttgggtcaggggatggggcggggagaaggagcccagttcccggcagccctctgagtctgcaccctcccttctcaccccaggttccccatcctgagtctgtgcctggggaccggtacctcattttggtgccccataccctgcagcccaagactcacccttatttatttgtttgtttgtttatttatttattttgttgagacagaatcactctgtcgcccaggctggagtgcagtgcgcgatctcagctcactgcaacctccgcctcctgggttcaagtgattctcccacctcagcctctcaaatagctgggattacaggcgcccgccatcatgactggctaatttctgtatttttagtagagaggggtttcgccatgttgaccaggatggtcttaaactcctggcaggtgatccacccacctcggcctcctacagcgctgggatgacaggcacgagccaccctgcccggccaagactcacccttctaatctgtgcatggaacttcctccctgagccccttcctctatatcccctcctccaggtcagagaagccttggccaggtcccccagcccccactggcgtccttctcccctgcaccctagagacccttatctctgagccctcatccgctttccgatgcagtttatctagggagctcctccctccacggtatttccatctcctcccctggatcccagaggccccctcctcacctgtagtccacgtggctcccatccacccagataaactcccccttcaggtccaagttccgaaggccaatccaggagccggtgtggctggcatgcttggtcaggaagtcctgggggacaggacagggctggaggactggagacatgtgcccggggccttccagcccacttcgagaggttgggtagagtggggtgggggtccccccaccctcgccatgctgcccaccacctctgcagagccccagcccacctgctcctccgggctgtggatgctgaccagctgcccttccatgtcgtcacaggcataccgggcgtggacccactgcttggtgcccttgccgaagtagtagcacttccgttggaaattgatccacttttcagggcacgtgttgcacacaaagcctggggtggaggagaggctcgggggtggggccaatggaagtgccttgggcaccctgggcagactaggtggcagcacccctcctagggccactcctggggtcccggctaaaagcagacccaccccagggcctaacagacagcctcacgggctgtgttctctgctggagctatgatgctgaccagatccatagtagaagcacctcagccaccatggccacaaacaccttcatggttagcagagcacggtgtcgaccatcaacacctcaactaccatcagcatctccacaaacacctcatggccagaagcaccacaagcaccaacactgccaccacacattcatgtccaatatggtcaacaccatgaccacaaacacactcatgtccaacaacacttcaaccaccatcaccacagacacctcacggctagaggtccctcaaccaccagcaccatgaccacaaatgcattcacgtccaacaacgcttcaaccaccattatcaccacagacacctcacagctagaggcccctcaaccatcaacaccatgaccacaaacacactcatgtccaataatatttcaaccatcgtcataaccacagacaccccacaggtagaagcccctcaaccgtcaacaccatgaccagaaatgcattcatgtccaacaacacttcaaccaccagcatcatcgctacaagcaccaccatggccagaagcacttcagttgtcattataatcaccttaaatccaccacggcttgggaactcttcagtcaccaaagccatgaccacatcaccggctccacagccagcagcacctcagccacaaatcccatcatcacaaatgcttcacagcgagcagagcatcaatcaccaacaccatcgccatcgacagctcatagaagtgcctcaatagccaccaacatcaccataaatccatccatggctagcaacacttcaatcaccaacattatcacccacatcaccagttccacagccagcagcacctcagccacaagcaccatcaccaacagcactttcaccaccctcatcacctcaaacacctcatgccagcagcacttcaaccaccaacaccagcaccacaaatacctcatggccaaaaatgccaccaacaccatcatcacaaatgccttacaggcagctgaatatcagtcaccaacatcatctccacaaacaactcctcaaccaccattacatcatcataaatacacccatggccagcaacacctcagtcaccaacaccatgactacattgccagttccacagccagcaacactgcaactgcaaacactgtcaccacaaacacctcccaactagaagcacctcaaccaccagcactatcaccacaaatacattcatgtccaacaacacatcaactaccaacaccattgtcacacattcacattcacgtccatcaacacatcaaccaccaacaccatcagcacgaatacattcacgtccaacaacacatcaactaccaacaccatcaccacgagcacattcatgtccaacaacacatcaactaccaacaccattgtcatgaacacattcacgtccatcaacacatcaaccaccaacaccatcagcacgaatacattcacgtccaacaacacatcaactaccaacaccatcaccacgagcacattcatgtccaacaacaaatcaactaccaacaccactgtcatgaacacattcacgtccatcaacacatcaaccaccaacaccatcagcacgaatacattcacgtccaacaacacatcaactaccaacaccatcaccacgagcacattcatgcccaacaacacatcaaccaccaacacctttgccacaaacacattcatgtctaacaacacatcaattaccaacaccagcgccacgaacacattcacgtccatcaacacatcaaccaccaacaccatcagcacgagcacattcacatccaataacacatcaactaccaacaccagcaccatgaacacattcatgcccaacaacacgtaaacccctaacactgtcaccacaaacaccttacagccagcagaacgccagtcactaacaccatcgccatcagcacttcgtggttagcaacacctcagctgacgccaatgtcaccacaaacacctcatggccagaagcagctcaaccaccaacaccgttattataaatacattcttgaccatcaatgcttcaactgctgacaccattaccataaatacatccatggccagcaatacttcaatcaccaacaccatgaccagcagcacgtcagcggccatcactgtcaccacaaacaccttcatatccaataacacttcaaccaccatcatcaccacaaacacctcatagccaacagtgcctcagccaccaaccccatcatgacaaacacctcatggccagcagcacttcaaccaccaacaaacccctccaaggtcagcaacaccttcatcaccgacatcattaacagaggtacccaccaccagcagcagcttatctccaccacccacaccacagccaacaccatctttaccaaccacaccagccgtgtcttcatcactggcaccgacagcaaaaccagtgctgtggccaggtccaccagcgattactttccccaagcaccatccctaccaacagccctggtcatcatcactggcagaacccgccaaaccagcactcctagccaatgtctgggaaattgtgatgattttcttccagtgggaggctttggtcaggagagccaatgggattgcaagactaggtcccacaatccctcaatatggtctctttctccccttccccccaccgcagtgaaactcccagacattgttgctatcgcctcccaggtggaaggttaaacccactcttactggatcaaatctttcttgcttcaaaatagattttcagcagtggtgtgcacctgtaatcccagctacttgggaggctgaggcaggaggatcgcttgagcccaggagtttgagaccagcctgggcaacatagcaaaaacccgctttaagtaagtaggttttcctatagtgatatgcagggaaggttccactacacgtggtcagatgttttttgttttgttttgttttgttttgagacagagtcttgctctgtctcccaggccagagtacagtggcgctatctcggctcactgcaacctgcacctcccgggttcaagcaattctcctgccttagcctcccaagtagctgggattacaggcgtgcaccaccatgcccagctaatttttatatttttagtagagacggggtttcaccatgttggtcaggctggtctcgatctcctgacctcatgtgatccacctgcctcggcctcccaaagtgctgggattacaggcatgagccaccatgcccagccacagatttttttttttttttttttaaagaggcagggtctcatcatcttgcccaggccagtctcgaactcctgggctcaagtgatcctcctgcctcggcctcccaaaatgctgggattacaggcgtgagccaccacgcccaccctcacatggtcagatttttctaaggagcttagggtctgcagtagcttgagatgagtgtgcttctcacccatgaaatggtaaccagtactcagccctctggaggtgcagcgttaaaacaggaagaggtggccaggtgcagtggctcatacttgtaatcctagcgatttgggaggccaagatgagaggatcacttgaccccaggagtttgaggccgtagtgagccatgattgtgccactgcactccagccttggtgacagaaccaggccctgtctctgaacaacaaaaacaacaacgacaaaaacccaaaccccaaaaccaggaagaggacatttctgagccctcaaagaaaacttcaggggaaggtgtcttggttgtttgttacatagtcacccagagacaacctcagagccaggctcagatcccaggctgtggggctggatttcggggagacttcagggactggggaagaattaggaggtgacctgtcagaagttgtcatggtccagagtgctcttcccctgtgcctctccctgagggaccacactgaggtttctggctgggattcccaaagccacttcacatcccaggggatgggactccatcacaccaagcacagaaacttcctcttctctgccccagttagggcagctggggcttcccagaggtcaaagaccaaaaatcaagggtgggggcattagctggcggaacggcagggctgtaaaaccccagttcctaccgtacagtaattttttttttcttcagaggcaaggtcccactctgttgcccaggctggagtgcagtggctcaatcctagctcaccgcagcctcaaactcctgggctcaggtgatcctcccacctcagcctccggagtagatgagactacaggtacacatcaccacatctggctaattttttcatgtttttgttgaggcaggatcttgctgtgttgcctaggctggtctcaaactcctggactcaagtgatcctcctgcctcggcctcccaaagtgctgggactataggcgtgagccagtgcacctggtccctaccccacattaagggtacagtgactgaatgtctgctctctctgcagcctgctagcctcctgaggtcaacactgcctccattactgccacccctgggaaagaggccaccatctccattgtcccatcactgcagacattacccccgtctggctccctgccctggtcagacaatctaccaggaaggctatgtgtatgagaatcctactaataactcctcactgggccacatcaggcagaggacaccagcaaggagaacccagcgagggtcaacactggactgctttaacgcagaagaggaaaaaaattgtaggagtctccaaatctgtgaaaggacacagttggaatcagaaagaaattgccaggcaagatggctcatgcctgtaatctcagcattttgggaggccgaggcgagaggattgctggagcccaggagttcaggaccagcctgggcaacatagcgagatcctgtcgctacaaaaaataaaaaaattagctagggccaggtgcaatgacttatgcctgtaatcccagcactttgggagactgaggcggaatgatcgctggagtccaggagttcaagaccaacctgggtaacaaagtgagacactgtggctacaggaaaataaaaaattagcctggcgtggtggcacacactcgtagtctcagctactctggaagctgaggtgggaggatctcttgagcccaggagttggaggctgcagtaagctatgattgcaccactgcatttcagcctgggcaaaagagtaagactccatctctctcttttttttttttttttttttttttgagacagagtctcgctctgttgccctggaatgcagtggtgcgaagacagcatgatctcggctcactgcaacctctgcctcccgggttcaagtgattcttgtgcctcagcctcccaagtagctaggattacgtatgcccgccaccacacccggttaattttttaaaatttttattgagatggagtctcgctctgtcgccaggctggagtgcagtggcgtgatcttggctcactgcaacctccacctcccgggttcaagcaattgtcctgtctcagcctcccgagtagctgggactacaggcacgcaccactacacccagctaatttttgtagttttagtagagatgggggtttcatcatgttggtcagactggtctcgaactcctgacctcacataatctatccgcctcgacctccctaagtgctgggattacaagcgtgagccaccgcgtccagctaatttttgtatttttagtggagacggggtttcaccatgttggtcaggctggtctcgaactcctgacctcaggtgatccacccgcctcggcctctcaaagtgctgggattacaggtgtgagccaccgcgcctggccaagaccccttctcttaaaaaataaaataagcggtgttttatgtatgctctgtgtgtcctgccccatcagaaacttagtcctatttccgtcatcacgcacacctctgcctcgcatccaagcacactccccaccctgcgcttatatctttgtgtcctcccgatgacactcgggtcacacaaacgtatagacatgctgcctcacgtcacacgtgcgtgccgtcacatttgccaacacgcccgagccccaggtgaggtcacgcgtcgtcctgagcagagactcacacactcaccgctggacacctgcaactccatccttagctttgtcacctcctcccggagtctttccagcaaatctgaagcttcgttcctctcgttcaattcttggggagtcaacaaggggcggtgctcagagaccaactggcaggccccctccttgtccgttccctcccccactgccccatcccctcccaagcctcaccctgggacttgaagctgctcagatctgcttgaagcccgttcaggttccaggacagctccaagtctggtgtgtgcaggagcgcagggctggtctcagggaggatgtgtacaggccgagggtgccccccaagcctggccccccagcctcgtggttccccagggctctgagacactccctccttcccacccaatctggcttcataaccccgatcccagtctctcaccctgagatttcaatctctgctgttcagctcgaagttcctccagttcctgtgaaatctgcgtggctgtttgcaggggagggggcttcatggtaagcaggtcctcattgtctcccccatctacccccacccatcccttggtctctttgcctgggttcttggaaccacctgctcagtttgcagttcccgggtgtcgggggtggggcacagtgagtcttaatgctctgggtccaggaagtcatccaagaccccctcgctttttcccctgcaaccccaactccaggagtcactcacactgggatttctgcgccatctggtcaccgtggtggctttccaagttcttggaaacttgagagactggagcggcgggagagaagagatatcccaggaacctcaaaggcaggtccttggaccccgcctatgccccaggctcagggaccctctcacatagtcacaacagctgctgttgctgtttgttcatttactggagcaggaggagtgtactcaggaaggtatatgcaagaatataatgaactactgtgtacctctccctcacccagggttaactataaaagcagtaggcgactatcagggtacttcacaaatcttagagcttgtttctgtctcacggcactaaaagtatgcccattttacagatgaggaaatggaggcacaaagcagttacaaaatccttacactacagatgcttaaggctgccaacttacaatggctcaacttacaatagctcgagttacaatggctcgactttacaatggtctgaaaccaatatgcgtttagtggaaaccttaactctcttgcaatgctgggcagtggtagggagccaaagccttcagccagccacacagttttgacttaaactattttcaacgtactttgcgcttatggggacataaccccattgcaagcggaagagcatctgtattaggatgctatcaggcacttttccaagcttccctgggtccccgccttccctaggacagggagcaacttagtttgaccttcagttccttagcgaggggacactgaggcccagagaggagcgggatgagtgctgggcatcctaaccctcacccccaccccctccaccttgaccccttcataccgttccgggcagccctctcttccagctgttttagactctgtgtggtgtcccagtctggggagggggagagaagaggagtggagaggggggattgtcagtgcccccacctgcctgcaccccacctcccagctggggatggaggtcttgggtataagccatggaggtgctgaaagtgtggaggacagggatgctgggtgtggggtgaggggctctggagggtgggggatgggaaagggctggcagtggcaagatgggaggcaggatgggaaaattgggttttgagaggatgcgttgggctcccccagctctgagatgggggtgaaggagggaacacagaagggccccatgagttggggggaccacatggagctgggggtgtcctcacgccacaggagaagcagagtcagcagcccagcccacagagcggcggtcaccagccccagcagcacgatctgagtcccacgcctgcaacaccgcctcctgggaagctcctcgatctctgccgggggtggagggactgactatgggtgcagggtgaagctggatgctggccctgtccgtctctccattacccagagcccccgacagcctgggagcttgtccagagcccacactgaagcaaagggtctcagtggacccccagctccatttgcacagcttccttacctgactcagggctgggtcactgaccacagagacagatctgggactaagagctaagactccctcagccccaacaaccaatgccaggcccccagcttcacttccagaagactaggtcctgctttttccttcccctctgagccccaacgcccacccttacacctctgcacctgtccccaacctggagtcccttccctaaacccaggacactgagtcccagttcttccccaacatcggagccactccccagccactttcccaggtgtcatccaacatccagacctccaaacctctcccagaccccacccaaaggtctatctggatgtcccacctcaagcccctggccctctgcactcaccctggcttggaggattcattatgctaaattctgcttgttccaagttcctgttctatttggcctctgactctattgggctccccgctccctagctgaagccgtttttttttttttttctttttctttttttgtcaggagggtgttgaatcagaaaaaggaggggccctcaatttgccactccttcctggctctgtgccaggaaagtcagtccggcctcacctccttactcacaccagtccctttcttagaaattcaccctctttcccagagagggactggggagccccgcttctcttctgggtgaaaggcagtagctaagggtcattgcttctgccaacgttagaaccagagagtcctcctacctgaatattgaccttcctccatggcggtcctgcttggattctcccgatgatggagcactcactccctgacaacgcagtccactcagcgggcacaatcacagctctggctgatttgggatttaatgatggttagggtgagccatcaaatcctagttaccagcacaggatagcatctgggacttggtggcactcaggggccatttgctgattttgtttagtctacaatctggactcactagcgtggttagcagggagacacagctggtgtggagagatagcagcctgagatcagaagtggggcactccagagcccatcacacttgagctacacagcaggtgcacccatgagatcttgacaaatggcttaattaacctggaaacttctttcctcattcgtaaaatgatgataccaagaacacctatactgttggttggtgatctgtgctaaaaatatcaccagcgtttattataattgccttgcctgtgtgacctcagccaaggattcaaccattctcagcctcagttttcccctctgtaaaatgggctgatgacagcacccaactcatgaggccaagataggatccaatgagatcacagcatacctgaggtttttggtgccgggctgcgcacagtgggtcttcggattctaaacatttatgaaacatctactctgtgccacgtcccactgagaaatgctaagagcccataacccaggcctcagccttctcctctgccaatgtccccagggcatctgtaaagtgctctgactttatttatttatttatttatttattgaaatggagtctcgctctgttgcccaggctggagtgcaggggcacgatctcggctcactgccacctccacctcctgggttcaagcgattctcccgcctcagcctcccgagtagctgggactataggcacgtgccaccatgaccagataatttttgtatttttagtagagacgggttttcactatgttggccaggctagtctcaaactcctgacctcatgatccgcccgcctcggcctcccaaagtgctgggattacaggcgtgagccactgtgcatggcctatttttttattttttgagatggagtctcgctctgtcacccaggctagagtgcaatggcaccatcttggctcactgcaacctccacctcccgggttcaagcgattctcctgtcttagcctcccaagtagctgggactacaggcacccaccaccacacctggctaatttttgtattttagtagagacagggtttcaccatattgatcaggctggtctcgaactcctgaccacaggtgatctgccctcctcagcctcccaaagtgctaggattacaggcgtgagccactgcgcccgaccaagtcctctgactttaaagcatctactatgtgctgaggagcatgggacttggggtccttcaggcctggaggtcacgggctaccttctttcgctgcttgactataggtaagtcccttctctcggagcctcagggaggtggggtgtggcgcggccaggctctgattagcggcagctcaagctggcccttttgacattgtgagaggaacccagagaccatcctgggactggaactgtccagggaggcagctggacagacctgagtccgagtcctggcttcttcctggatgagcagctcagtttgctcatctgtaaattgggagtattcaaagcaccagcacacagtaggtgctcagtaaacctactggcaggatgctgggggactgtcctcattctgtggggcctctctcagtggaactgaggttccaagagggtaagtcatttgtccccatcacgcagtggtgggactggaactcaaacccgggacccttgagctgggagcccatttgctcaatcatctggagacataatctcatggtggggtgtctactggtaagtgctgggtggcaggatcccaactccaggccgtccttctaacccaagaggtcctgcctctgcctagagtcttccatggctccccagggccctctatgatcggcccagcgcactcaccaagctcatctcagaccagatggcctgctttcacttccccaaatcagggactcgaatgcctcgagattctgtccacactgcggcccccacccccgccccctcaccacccaccacctcccttctctggttgtgacctcctgctggtcatcccttgaggctcagcccaaggtcgtttcttccaagggcgctttgatctccacttcccatggccaacccccaacacaccagatacgtactcacttagtggagtttggagcctgtgtctgtcctcctagtgtgttggggtcgaccagagcgattggcagggaccgtcagagacagaggtttaagcaggaagagagacactttcttctgaaagtagagccact

SEQ ID NO: 2494 - DNA, 13390 bp, Homo sapiens; identical to SEQ ID NO: 2493
  source 1..13390: mol_type = genomic DNA

SEQ ID NO: 2495 - DNA, 17212 bp, Homo sapiens
  source 1..17212: mol_type = genomic DNA
ccgccctgctcgtgataaggcacaagcaagggctgccctgaaggaagctccaaagagaaaggagggcaggaagcccacggcccacaggggtgtagcccgagacccacctgcagcccccagcccttgccaggaaaggtaagctcaggcctcactgggaccctgggcccttctcttccttatcctcctgcagcctctgcccagcctgcctctcgccatgcggcagcctgaactttccacctccccggagaggctttggctggtttgtgatgttggcatctgagctgtgggccaggatcggaactacttcctggcctgggtacgaagccatggccagagtgggcagctgcccctgagggtctgggagtgagctgtgggctggcattgagcacggtggtcctgagtgagccccttcttacccggcctcagtctgcccgcctgtaggatgggagcggattggactacatggtctctgagggccctcgcggctcaagcgccagcgctggagagagagtctgagggtaccacgggcgtgctggcctgggtgctcactcccgccctccttcatgagcggctttcctctgggtgtgtccagggcatcacagagctcttctgcccaaacccggaggcctaccagggcctgcccaccttgcctccttccacactctctgtagcagcagccgcagccatggcggggatgaagacagcctccggggactacatcgactcgtcatgggagctgcgggtgtttgtgggagaggaggacccagaggccgagtcggtcaccctgcgggtcactggggagtcgcacatcggcggggtgctcctgaagattgtggagcagatcagtgagtgtccgctgcccgcttgctgaactcggcaccatgggcggccgccacgggtgtctctgggcacttccgggccatccctgctgctcagctcccgataatggtgtcacggtgactcaggcattagcttaatcatttggttccaaaaaagacatttccccaacttcctctccctcccaccctcttccctccctcccttctgctgcagctggtctgctaaggatcagacgcagccacaatcctccattcagccaccaataggggcagaaggagtggtcttgtctgggccgaggctgaagtcacattgctgaggtctgagggggtctaggtgacccaggggcctgcccccacgctccctccccttggcggaagctttgagcaggttggtgacaggcccagcctgggtgggaaggccctgcccccacaggaagttacagcagagcagctgtggtatcagtcatggaggaccacggggctagtgacacgggggctcctcatcttccttccctgccgggggtgggggctaccccttcctgagagagcagcaggaagaccccgataggcagagccggaagacaggcccaccacagtcccggccaagagcctgggcctgggctgccagtgggtggggggtgggtgatggtggggaggcttcctcagaccccgccaggccaccatgtgcagcacaggaggaggtcagtccgactgtggagaggatagggtccagaacggcccggccacaagactgaggctgtgaggggagctgccaggggcagggcccggagcagctgtgagaatagaagtgaggaacagagagagggtggtgaagacctgggtggccccagggcacggcatgagggtaacgcaggaggccttaacctggagtcagacagaccccgctgctctacccgctgctgggcaccccagggcaagttcctttagctctgtgttccctgtggtggggatactgtcactcctaagcacatcagctctgtctactgatgctcagcctggccgccccgggccagtccctggcctcctggagcagcagcgggtgagactgacccatgggggctgcgtgccggctgccgcacagagggcgctatcatgggggcctggagccagaggagggggctgccccgagcccaggatggggataaccccaggagaagtcctgagaggtggcctcagcagggaggagcaaggtggtggcgctgggactcggagggctgtgaattagggctctcggctggtgaggatgctgggagcgtgaccagaaatgaggctggctggtgcctggccagctctgcatggccccgaaggcctccagaaggggtctagactttcttctggaggggaaggtggccaccgaagggttctcagcaggaggctgtcctgctaaggtcagcagcaaggcgaaaggctggtggcggcaggcccctgaggaggctgtggtcctggttagagacaccagggcctcctaaggccgggcagggaggatggagaggagggtggattttagaggtgggattggcattgattacatgtggtggctagaagagaaagggaggatgcctgggcctttggcgcgagtccgtgtcccccagccctgagaggtggtgtagggagctggtgaggagggggagctggctaggagagggcacctctgtgcacagcgagtctgagctgagctccaaaagccgagaccaggagtcatggtgcttacagtcccagtgtcagccactcggccacaggaacagagggttctggaaaggaggaagccggtggacaggcccctcagctggcagcacatgggtttctggctgggggcccagggcagggtctgggccgagggccacgcatggggaggcagcagaaaatggcaactgaaaccacagaatagggagacccagtaaggggacctggccgaggcaggagaagagggtcccaggccgaacctggggaaaggacaaggtaaggggccggtcaggagagggaccggagaggggccagagaggacaggagaagagcaaggagccaagacaaggggatgcggcggcacacagccagagtcccactggggtgcccaggagggaagggcccagcctgggaggggaagtgccggaggacgagcgcttctcttggtttggcagcagtggtgatgcccggcatgtgcagcagtggggttgggggctggctgaggtgggtgggatgcagtgggaatcagaaaactcaccgggaggacctgggaggaactcaggaaacagggctttgcaaactctcaagggctgtgtgcccagagcagctttccggcagcctttttcctatgctctctcccacctgttcatgctcctggagggaggaggcggggagacctgtgccttccattactgtaactccagttcccagctggctgacaagggacagacgcacatctctaattcaatgctcactcatggatcgtcatgtgcgtgcacaagtttgctgcaaaccctgcagctaccacatgggaggccttgttccgtgtcccagtttgtaagatcgttattgtatcttacagggaaactgaggcccagtgaggttaagtggcttgtccaaggtcacacagctaatagctaaaaatattgagtgctcactgctccaggccaggcacaggtccaggccctgaggacatacaacggtgagacagacgtagtctctgcctccaggagctccccagaatgcaagacagaggctgttaaaccgtggattatgggaggacagagggggcgtcatgtggagggagcccagtgggctggaatgcaagagatggggcgctaagattggggcactcagatgctgggttggagagctcccctgggaagcgatatagaagccaagcctagaaggccaaatcaggggctgcctgcagagagccctgctgctgttaccatggggtagaccccaggcccgcccaggctgccccactcttggcttaggcagggcaggggagtggtcgccccaggcttctgaatcctggggttgtgctgggtgttgggggcaccagggaggaaggttggacccagatgtgcccccgtgccccacagatcgcaagcaggactggtcagaccatgctatttggtgggaacagaagaggcagtggctgctgcagacccactggacactggacaagtacgggatcctggccgacgcacgcctcttctttgggccccagcaccggcccgtcatccttcggttgcccaaccgccgcgcactgcgcctccgtgccagcttctcccagcccctcttccaggctgtggctgccatctgccgcctcctcagtaagttgcccggctgattcccctggcccacgagggtgatgcaaagaggcaggttcccccgtttccaggcccagctctgttgacgctgtccttgctgtctgggttgccaccctgcctgcagggctgtgacccgccccaagcacccatgggtgaggtggggaggctgcagcaggacctagtccccgctgagaccctagctcccctcaggcatccggcaccccgaggagctgtccctgctccgggctcctgagaagaaggagaagaagaagaaagagaaggagccagaggaagagctctatgacttgagcaaggttgtcttggctgggggtgagtgcaagtgggggtgggcctggggggttgggggcaggggccggcccgtgagtcccagccctgggggacaggcctggttgactcccaacctgcactccaggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtgcacccaggagccacgccccctgtgtcagggctcccccacccaggatccaccccctgtcccgtgtctgtgcccaccccagatccacacttcgtttccaggccttttctctgtgtgtgcttgtccccccagcccagcccccctccccaccccacggccgtacctggcgcagccctgactgctgcttctgccgcggcccaggtggctggactcgtcgcggtgtctcatgcagcagggcatcaaggccggggacgcactctggctgcgcttcaagtactacagcttcttcgatttggatcccaaggtgggtcggggcagggagaaagcgggcctcaggtccatgagatgtggagacctagggcctggggtatgggctctgggatgttagtgacttgtagtggcctgtccgtctgcccgtttgtccatccacacctttgtttactgaccccacaaacacccactgaaactcatctactcacctcagcatcaggccaggtcctgggccccgggcagatgctgaagcggatgaagaccagtaagtctcagtgcctgtttcccagggagctgtcagggaggaagctaagacccacagatcctcatagacagtgtgtgtgtgggtgcccctgagaagtctggggctcaggtgggagaggcccaagcctgggagctctgggaaggcttcctggagggggcaccattagggactgcaggacctgggggtgggtgaggaaggaagctttgcagggtggcccctctgtgccctgttcactcttcctcccttcctccattggcaaccaacatgctccaggcaaaatgctccatgcaatgtgcttcgcgcacatctcaaaaacttcccagaagtccacaggttgctctttctacctgtaggccccacctctctgccccctttctctgcaaaacatcgtagttgtctgaacgcttgctccgcagaatcccacttcttgcttccaagctttctctgggtgctgttcgactccctctcactccttggccatggctattctatatattttgacaccatccacacgtgagaagtgcacctgctgaggtggccacgtctccaggctatctgttccctggccatgtcccacccgcttcttacttgaccacttacttgcagcatagacaccaccccgaccactcctccagaatatcttcctcctgaagcctcctgtacacttgcttggggggtggcctctccccaagccactctgccaggctctgtgatgttccctcctcctctccatggcctctcggtgttggtgagccccaggctctgccccaggctctgctctgggcctctgctctctcctctccttctctcagtcatctccagtcttgtggatttcaataccatctccacactctctcccagctgatcatctccagctcagatgtctctctcctaagctttatttatttatatatttatttatttttattttttgagacacagtcttgctctgttgtccagactggagggcagtagtgttatcccggctaactgcagcctggacctcccagggtcatgtgatccttaagcctcagctccccaagtagctgggacgataggcgtgtactatacctggctaattttttttttttttttgacatggagtcttgctctgttgcccaagctagagtgcagtggtgcaatctcggctcactgcaacctcttcctcctgggttcaagcaattctcctgggattacaggtgtgggcctggctaatttttgtatttttttagtagagatggagtttcaccatattggtcaggctggtctcgaactcctgacctcaggtgatccacctgcctcagcctcccaaagtgctggggttataggagtgtatttttttagtagagatggagtttcaccatattggtcaggctggtctcgaactcctgacctcaggtgatccacccgcctcagcctcccaaattgctggggtaataggagtgtatttttttagtagagatggagtttcaccatattggtcaggctggtctcgaactcctgacctcaggtgatccacccgcctcagcctcccaaagtgctggggttataggagcgagccactgcgcctggcctaatttttttttttttttttttgagatggagtcttgctcttgttgcccaggctggagtgcaatgacgtgatctcaggtcatcacaacctccgcctcctgggttcaagcagttctcctgcctcagcctcccgagtagctgggattacaggcgttgagccaccatgcccagctaattttgtatttttagtagagatggacggggtttctccatgttggtcagactggtctcgaactcctgacctcaggtgatttgcccactttggcctcccaaagtgctgggattacaggcgtgagccacggcgtcgggccagctgtgcctttttattctagtgttttcttctctatgacatatttccacttctttgttttgccatttcacacattatctattgactttgtaagaaggtttcactgtcttacattctcttccctgcccacacaatacacacatttccttgcctctttctaagtgagtagtgtctgtagtctttggttaaaacaatgtgatatggctgtaaatagtaacacatataaatagtgttcctagttaagccacagagtaactatgattattttttccctttttgctcaaatggttttgaagttcataattgccttttttttttttttttttgagatgagttttgctcttgttgcccaggctggagtacaatggcacaatctcagctcactgcaacctccacctcgcggattcaagcgatctcctgcttcagcctcccaagtagctgggactgcaggcacgcgccaccatgcccagctaactgtatttatttatctatttttgttgttgagatggagtctcgctcttgttgcccaggctagagtgcaatggtgtgatcttggctcactgcaacctccgcctcccggattcaagcgattctcctgcctcagcctccctagtagctgggattacaggcgcccaccaccacgcctggctaattttttgtatttttagtagagatggggtttcaccatgttggtcaggctggtctcaaactcctgccctcaggcgatccacctgcctcaacctcccaatatgctgggattacaggcgtgagccaccatgcctggcctacacttttctttcttatttttcggttctttttctttctgtgtcctactctccggagacctcttcaacttatcttctaaaatatctattgaatttttaatttctgtaactatatttttaagttccaagagctcttgttttttgagtgttcttttatagggtttttttttttttgagagggagtttcattcttgttgcccaggctggagtgcaatggcgtgatctcggcccactgcaacctctgcctcctgggttcacgcgattctcctgcctcagcctcccacatagctgggattacagatgcccaccgccaccatgcccagctaatttcttcttgtattttgagtagagatgggatttcaccatgttggccaagctggtctcgaactcctgacctcaggtgatccacctgccttggcctcccaaagtgctgggattacaggcatgagccaccacgcccggctcagcttatttttaacaaatgtgtatggttgtgcaaccatcaccacaatccagttttagaacatttccactgccccagacaagcactgattgcacgatgcccatttgcagtcattcctcctcccacaccccgaccaccactgatctgctttccatgtggctttaatttacatttccctgatgactaataaagttgagtcccttttcataaggctattagccatctggatatcctgctttgtgaggtttctgttcaaacattttgacaattgtcatattgagtcgtttgtctttttcttattgatttgtaggagttctttatatattctggatatgagcactttgccagataaatacattgtgaatatattttccccctctgtgctttgccttttaattgtctgaatggtttcttttcataaacagcagctctttattttaatagaaccaaatttatatttttatctttctttttttatttttagagatggggtctcgctctgtcacccagactagagtgcagtggtgcgatcatagctcactgcaaccttgaactcctgggctcaagcaatcttcctgccttagcttcctgagtggctggggctacaggcatgtgccacaagcctggctaattctttaaaaattgtttagagatggagttttgctacgttgcccagattgggtctcaagttatcctcccgcttcggcttcctgagaagttgggattttttttttttttttagacggagtctcactctgtcacactcaggctggagtgcagtggtacgatctcggcttactgcaacctccgcctcccgggttcaagagattcccctgcctcagcctcctgagtagctgggattataggcatctgccaccacacccaactaatttttgtatttttagtaaagacaggatttcactatgttggtcaggctggtctcacactcctgacctcaaatgatccgcccgcctcggcctcccaaagtgctaggattacacgcgtgagccactgcgcccagttacattcctttaaaaaaagaatattctggtcttgatttatgagtgcagtgctttagctctgtaaggatttttttttttttttttgagatggagtcttcttctgtcacccaggctggagtgcaatggcaagatctcggctcactgcaacctctgcccccctggttcaagccattctcctgcctcagccttccgagcagctgggattacaggcatgcaccaccacgcctggcctaattatttttgtatttttagtagagacggggtttcaccacattggccaggctggtctcaaactcctgacctcgtgatctgcccgcttcagcctcccaaagtgctgggattacaggcgtgagccaccgggcccagcctctataaggattttttcgccgggcgcggtggctcacgcctgtaatcccagcactttgggaggccaaggagggcggaccatgaggtcaggagatcgagaccatcctggctaacacggtgaaaccctgtctctactaaaaatacaaaaaattagccgggcgtggtggtgggcgcctgtagtcccagctacttgggaggctgaggcaagagaatggcgtgaacctgggaggcggagcttgcagtgagccgagatcacgccactgcactccagcctgggtgacagagcgagactccatctcaaaaaaaaaaaaaaaaaaaaaaggcgggtgccaccatgcccagctaatttttgtactctacaaggattttgattcacgtttgaagttctcttctgcgccctacctggcctttatttcctccaagctgttttattcttgttgtcttggtctctatggttcactcttgaagctttccttaaatgtgggtagtccatgcctgtccattcatatttaaaagtgaagctctaagaaaccaattggagaccctgagtgtgtgagtagggcttggcatcttggtggccccctggaggcgatggggccgggctgccactctttgtcgggcatttctctggtggctcagcctctcagtggcaaccccactgatctttcaactggagatagaaggcttcctgccaatgtcttgggtgacaagtgggaaagggtgtgggtgtgtcactcatctgaatgccagctttctttaaatttgtgtttttgccgggcacggtggctcacgcctgtaatcccagcactttgggaggccaaggcaggtggatcacctgaggtcaggaatttgagaccagcctgatcaacatggagaaagcctgtatctactaaaaatacaaaagtagctgggcgtggtggtgcatgcctgtaatcccagctactcaggaggctgaggcaggagaatcgcttgaacccgggaggcggaggttgcggtgagccaagatcgtgccattgtactccagcctgggcaacaagagcaaaactccatcttaaaaaaaaaaaattgtctgttttcaccctagtgcaacccccaccccgtccagctgtgtctggggtaccaaatgcaggggtgcatctggctcagcatctccagagagtgagtcccagcttctgccaggtgtctccttgccatcacttggctgcatggagctggggagggacctgctttttttcttggactttatccagagtcctctcttcagctcaccctcgcatctcatccagaggatccccatcagagcctgccaggggtccgccatgcaaactggatgcctctgttgagatctctgttctttttgctgattgctttccgcctattttcaagtctcattggtggatttaccagacaggagagggacaaggcgtgaggccctagcgctctctgcataacccagttcccatctacagtttgctctccatcttccaaattatttcctttttcctttttttttttttttttttttgtgacggagtctcgctctgtcgcccaggctggagtgcagtggcacgatctcggctcactgcaagctccgcctcccgggttcacgccgttctcctgcctcagcgtcctgagtagctgggattacaggcgcccgccaccacgcctggctaatttttttgtattattagtagagacagggtttcactgtgttagccaggatggtcttgatctcctgacctcgtgatccaccgacctcggcctcccaaagtgctgggattacaggcgtgagccactgcgcctggccttctttttctttcttttggagacaaggtctcactctatcccccaagctggagtgcaatggtgcaattacagctcactgcaccctcaacctcatgggttcaggtgattctcccacctcagcatcctgagtacctgggactacaggcacgcaccacctcatgtggctaattttttgtatttttagtagagatagggtttcaccatgttgcccaagctggtctgaaactcctgggctcaagctatctgcctgccttggcctcccaaagtgctgggattacaggcgcaagccaccgccccggcctgtcctttgtccttttgggtttatcttcctaaacctttgctatcaattttgggtgagtttcagcgggattgttggtcttctgtgggtaactgggatcccctcttggagtctctgccttcccagttccttttctctggaatcctcttccttcacgcttcccttgagtggcccactgtcatccttcctatctctactcagcttgtcacctcctcagggaagccttccctgactgcttccccatgttccattctgtcatctccattgaacttgggggggccttagactgagggctcatgtgagcttccctgtggaaactgtttccttgatagtgtttattgcagccttggattatttgacttattgattggtttactcggtctctcctgcacccagggcagcatgccagcacacagtaaacatcagcacaaccaagccaaggtttagacgtgcaggcctgggcagcagggggctagcaggctattaaggatggggttgaggtctgtggcccatgtctggccactgaatgaatctgcctcagcaaggagggcagggcagagggccaaggctggcaggggctcagtgcagggcgtccagggcagctggcatctgaccagcccagcctccagcctcctctccccccgctccagacagaccccgtgcggctgacacagctgtatgagcaggcccggtgggacctgctgctggaggagattgactgcaccgaggaggagatgatggtgtttgccgccctgcaggtaccaggcgggcctgggggcaccagggcaggtgggaggtgagccagtcccagggcaggaagggccttcctgagtgggggctacctccagggaagcccggcctgggggtactgctaggggaccaggctgctggactcagccctccctggcttcatgaccacctagtaccacatcaacaagctgtcccagagcggggaggtgggggagccggctggcacagacccagggctggacgacctggatgtggccctgagcaacctggaggtgaagctggaggggtcggcgcccacagatgtgctggtgaggaggggctcagggcaggggctgggcagggagaactgtgaggtaccgggtgcccctctgactctggtcctcccataggacagcctcaccaccatcccagagctcaaggaccatctccgaatctttcggtgagttgggggccagagtaggcagccctgctggaggggttggtctgcatatggagggagggggtgaggcggcctttcacaaaccccagcatcccacgaaggccccggaagctgaccctgaagggctaccgccaacactgggtggtgttcaaggagaccacactgtcctactacaagagccaggacgaggcccctggggaccccattcagcagctcaacctcaagggtaagtgcacagggccaggggctgggtggggggatccccacttgtgggctaggcaggtgaatgctctcaccggccctgtttcctcctggagaccggggaagatgccctctgtcctgaggtgacggtgtgggctaggatgcactccaggacctcaggcggctcttcccctcccgacctcctagaccaccccttctctccctccaggctgtgaggtggttcccgatgttaacgtctccggccagaagttctgcattaaactcctagtgccctcccctgagggcatgagtgagatctacctgcggtgccaggatgtgagtgagggctgggcaggggccagggccgggcaggagctggggcaggggcaggggctgaggagcatcaagcttggttagcactgtccccctcacccctctcgcccaggagcagcagtatgcccgctggatggctggctgccgcctggcctccaaaggccgcaccatggccgacagcagctacaccagcgaggtgcaggccatcctggccttcctcagcctgcagcgcacgggcagtgggggcccgggcaaccacccccacggccctgatgcctctgccgagggcctcaacccctacggcctcgttgccccccgtttccagcgaaagttcaaggccaagcaggtaccagaaggcgtcagggtgggaatgagcatagtgtttacccagagacctctgacccctgggtctccacagagccttcctcaggaaagctacgtactcactgggcttctcccactgtgtccctgagattgtgcggctggtacccaccctttgggaggagtcacggtccaggtgcccatgtccaccttgcagcctggcgcagtgcagatctgcaccttggcggccccacgtgggcactgccccttcccaggctcacatgctgtcaccctgatggggaggtgggggctcggtgactctggaggaggggaatagtgcctggcagcccgtcaccagtatggtcccgcagctcaccccacggatcctggaagcccaccagaatgtggcccagttgtcgctggcagaggcccagctgcgcttcatccaggcctggcagtccctgcccgacttcggcatctcctatgtcatggtcaggtatggcccctggcccagccccctgcccagcaccgtctctgccctcacctgccacccggctgctgtgtgcccacatcccaagagtaggttctggacaggcaccccaaagactcccttcccttgttctttgtaagcaggccttactgagggccccatgtgtgcccctcatgctgtccctccacaacaaacataagagacaaagctcacgccaggtactggggctcatgcctgtaatctcagcactttgggaggcagagataggaggatcacttgaacccaggagtttgagaccagcctgggcaacacagaaagtccctcgtctctacaaaaaattgtaaaaaattacctgggcatggtggtggtcacctgtagtccagctactcaggaggctgaggtgggaggatctcttgagcctgggaggtcaagactgcagtgagccgtgatcacactactgcactccagcctgggtgacaaagcgagactctgtctcaaaaataaataggctgggccaagcatggtggctcacacctgtaatctcagcactttgggaggccgaggcgggcagatcacgaggtcaggagttcaagagcagcctggccaacatagtgaaaccctgtctctactaaaaatacaaaaattagccaggtgtggtggcacgcacctgtagtcccagctactcaggagactgaggcaggagaatcccttgaacccaggaggcagaggttgcagtgaactgagaccatgccactgcactccacgctgggtgacagagcgaaactctgcctccaaaaaacaaaacaaaacaaaaaacaaataggcggggcacggtggttcacgtctgtaatccttgcactttgggagaccgaggcgggcagattatttgaggtcaggagtgtgagaccagcctgaccaacatggtgaaaccctgtatctactaaaaatacaaaaattagccgagtgtggtggcaggcgcctataatcccagctactcgggaggctgaggcaggagaatgtcttgaactcgggaggtggaggttgcagtgagccgagattgtgccactgcactccagcctgggtgcgaacgagtgagactcagtctcaaataaataaataaataaataaataaataaataaataaataaaagagcctgcgcgatggctcatgcctgtaatcccagcactttgggaggccaaggcaggcagatcatgaggtcaggagttcgagaccagcctgaccaacatggtgaaaccccgtctctactaaaaacacaaaaatcagccacaagtggtggcacgtacctgtaatcccatgtactcgggaggctgagacaggagaatcacttgaacccgggaggcggaggttgcagtgagccgagatcgagccactgtactccagcctggcaacaaagcgacactccgtctcaaaaaaaaaaaaaaaaaaaaaagagatttcaggtcaggagagcagaagaaccagttcttgctccagctctgctgtggacagttcactgtctgggcctgggttcgccggtccgcaagacagggctagcggtggatgctgttatggggagtgggcccctttgattagttgtttcccaagactgcaaagaagggagggagacagcagttgatgaggatggtaacaaaaaccaaaaaaagttaccatttaaaggcttggcctgtttgcccgatgctgctaaatgctgttgtggggattttatcaattaacccccatttaccagatgaggaacttgaggcccagggaacccaaatggcttgctcagggttacacagctggtgagctgcagtcgggaagggctggctctccagcacggcgccacattgtctgggcgggctctggccatgcagggtggagccctggctcactctctctccctgggggccaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcaggtgggcccagacccagggtatatggatgggggacaggtgcaggccggagctggatccagccagggtggggcaggggctgctcccttatcccacccaccatttgcccctctgtctgcccttcaggtggccatcgagtttgatgaacacatcaatgtggccttcagctgcgtgtctgccagctgccgaattgtacacgagtatatcgggggctacattttcctgtcgacgcgggagcgggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctc

SEQ ID NO: 2496 - DNA, 17212 bp, Homo sapiens; identical to SEQ ID NO: 2495
  source 1..17212: mol_type = genomic DNA

SEQ ID NO: 2497 - DNA, 5479 bp, Homo sapiens
  source 1..5479: mol_type = genomic DNA
ttcccaagccacagccccgttttatttacactcatcccaaagcacatgatggggctgaaggacgaatctcaggggagcagaaattagctgaaggccacagaggatagagacggggggcagggggagaacagggaaaggacagcgaggatggacaggccctcctggagcgttctccgtgggctcccgcgtctccttcaggatttggacttggacacagcaagtccgatgagtccggccagtcccgccacacccagggccatgcctcccacgatggccatgcccacgagtccatctggggaaggaaagggacagtgtcaggagcccggcccctgcggaaaccctgaccgtccccttccgccagccctgcccctcaacagaggcacacccctacctggagtcgcagggcaaggggctctaagaactggaaggggtggggctgaggggctgcctggaggggttcatttacagagagaccaaagtgcccaggcgtggggaagagcggggctgaacaaaggggccgaggctgtcacctttcttcatggccttgtcaatgagccgctccagttccttggcctggttgttctggggctctgtctgcagcaacccgcggacgtactttaaggccttctcgtattcctgcgctcggggaaacgcgcacgcgtcatacacaccgcagtgtttttttgtttgtttgttttttaataagagacggggtcttgctctgttgcccacgctggacggcagcgtcgcaatcacagcccactgcaacctcaaactcccaggctcaagcagtcctcccgcctcagcctcctgagtagccgggattacaggcgtgagccactgggccggctacacctcagtatccaccactccccctgcccacgtgaagggccttcccttcttcagccctgggggctcctccctcgacctccacccactccctccctccagccccaccccacggagtagagtccacaaacaaccccaactctgcgggagataacagcgcaaggcttgggcctgcacccagtctcttgacgtcaccttcctccccaccccctcgccactctgatcttccctcggagtcctcatctgacaccgctctgcacctctgcaccccttcagccttcccgctgtccagggctccaccctggaggacacagtaagaaggtcctgcagccccagaggagggtgaagggaacggggtccccacctcaccttgagccggtagttccccacggccaggtagaagacgtaatcccgctgttcctccttgctccctttgggcagcagctctggggaggggcagagaagagggtgagaaatgcttctttcctaatactttcctaatactgtgtcccagaggccccttccactctctgaatgcctctgtgatcctgggagggtcacagtcctaagcctccctttcagctccagtcactcccagcaccctagccagagctctgggacagggtgaaccccagctgtgccaacaccccagtgacagaacatgccttttatcagtattacagtcaactggtccatccaactgaaatgaggaaatcggggccctggagaagccaaaggcagcgtgactcagttttggcatctgctgtggtattttttttcagacggagtttcactcgtcgcccaggctgcggtgcaatggcgtgatctcggctcactgcaaccttcgcctcctgggttcaagcgattctcctgcctcggtttcccgagcagctggaattacaggtgcccgccaccacgcctggctaatttttgtattttcagtagagatggagtttcaccatgttggccaggctggtctcaaactcctgacctcaagtgatctgcctgccctggcctcccaaagtgctgccgttgtggttttaactaaactgcctgctgtacaattattgtttaaaaaaaaaaaagttaggactccctccccctttaaaaaaatcagctcaaaactcaccttcaatcagccttccccgaagaccccacctgactttgtcttccttccttttttttttttttttttttttttttaaagagacagggtgggccgtgagccgtagctcatgactataatcccagcactttgggaagctgagccgggcggatcacctgaggtcgggagtttgagaccagcctgaccaacatggagaaaccccgtctctactaaaaatacaaaattagccgggcgtgttggcacatgcctgtaatcccagctgttcgggaggctggggcagcagaattgcttgaatgcggtaggcagaggttgcggtgagccaagattgcaccattgcacactcagtctcgggaaaaaaaaaacaaaaaacggagacagggtctcgctctgtcactccagtctggagcacagtagcatgtccatggctcactgcagcctcaaactcctggggtcagtgatcctcctgcctcagcctcccaagtagctgggactataagcacacaccaccatgcctggctaatttaaacatctttgttacacagacaggccaggtggtctcaaattcctgacttcaagccatcctctggccttggcctcccaaagtgctgagattacaggcatgagccacagtgcctggccccacctgactttcttaattcagagacttcccagaggataactgtactgtatgcactagaatttgttgctaaataattctgcaggtgtttataaatcttcctgtctgtactgttttctcaactagactggcaacacttagagaggctgtttcttctacacctacaccctgctgtagaataaacctgaaaatctgaattgccgaagtagacaaacatagggtaaaattatttgtatcttttaagaaagagtcttatttttatagtttttttttttttttttttgagacggagtctcactgtgttgcccaggctggagtgcaatggcgtgatcttggctcactgcaacctctgtctcccgagttcaagtgattctcctgcctcagcctactgcgtagctgggattaaaggtgtgcgccaccaggcccagctaatttttgtatttttagtagagacagggtttcaccatgttgattaggctggtctcgaacccctgacctcgtgatccgcctgccctggcctcccaaggtgctgggattacaggtgtgagccactgtgcctggccatttttatagattttcaataggcatcctttgctaacacagtcagcattctgtattcatagattcaacgaaccatggatcaaaaatactcagaaaaaaaaaaaagatagttgcatctgtattgaacatgaacagacctttttttcttgccattattccctaaacaatacagtatactatttacacagcatttacattgtatttggtattataagtaatctacagatgatttaaagtatatgggagaaggtgcacaggttacatgtaaataccatgcgattttatatacgggacttgggtggctattggtatctgtgggggtggggttcctagaaccaatcccccatggctacagagggatggctgtacactgactgtgtgcttataaatgattatttgaacacaaggagctacagagaaactaagtggttaagtattgtggcctctgacaaatgatgacccacctaaaaccaataggaaatagggttcccatccaaaaagcactatctggctggacgaggtggctcacacctgtaatcccaacactgtgggaggccgaggtgggcagatcacctgaggtcaggagttagagaccagcctgaccaacatggtgaaaccctatctctacaaaaaatacaaaaattagctgggcgtggtagtgggcacctgtaatcccagctactcaggatgttgatgcaggagaattgcttgaaccgggaggtggtggttgcagtgagctgagacagcgccactgtactccagcctgggggacagagcaagactccgtctcaaacaaaaacaaaaaacaaaaagcactatctgctcacaattttgtaggacagtcctctgtacctcttccatgccacaaaagattctcaatagctgctaagcaacacggtggtggtgttggggggaagggcatgggcctaggtctcacaaaacaggagcttctagtcccaattcagccattaactgattagttgggtgacctcaagtcactttcccagatcaagacagtcctgggggaactgacatgctacactctgtctggcaaaacaatggtgggcggtaagtagccaaaagttcactgggagacgtcaagctaagtatagcccttggtgcagtaaatctaccggagacaactcagaggtgcctggactacggggcccacatcgcagagcagcccagatggcagcgggaaagggagagtacagcgcctcaccctcgagcagcacgatgcctttacggatgtcatcattgtacttgctccgcaccaggcaccaggcgtactcaaactgcgtgctcttggacaccgagcctgctgccttctcagactgaaatttcttttcaaacttctgccacaggggaggaaaggaatcatttagaaatgtagggcgtcaaccattctctatctggacatgccatctccctggctctgcccctttccctcgcaggtctcggtatctggcaccccagcttctgctatctccatgcccgggacccaggctttcggctcctccgggcctgcgggccagctcttgggacagaggcccccggtctcccctccccgcggcggtaccgagcggagatgccacctggtggcagctccaggcaccgctcccggagcagctgaccccggcggccgaacagtaaacacgctgtcagaactgctcaacagcccacgcggtcctcatttgaggctgctggccccatcctgccccaccctgccgggcctggaccttttattgtccaggaatagaagtagtgcctacctcctagagctacaaagactgagatctggcatgcgatgccttagcaccgtgccggacgcagtaataggtgacaccttatgatggtcactgtattcctccaccgctggaggagcgccctgagctcacagctcctgcatgatcccagatcccgtcagtctaaccacggtcgggctccaggcccgtagtctgaggtgtggggggctcaggacactacaactcccaggagcctctgcggcatagcaggccctccgggcaggagccaggcgctgtggaggctgccgggagccgtagttcggcttccctcggccaagccgatgccgggaggagggttcggcccctacctgactctcctcaggacccgccctccgaccttccctttccctctgtccgggccaggcctcaccagcaggtcctccacagacaccagctcgttcagcacggcctccatggccactgcccccgcgagcctcacactacagtctactgtgccacagtctccatggcccagtggcaggggcggagaaccacttccgg

SEQ ID NO: 2498 - DNA, 15628 bp, Homo sapiens
  source 1..15628: mol_type = genomic DNA
ggctgtttgcggatttaatggcagggcattgaggttgggaggggtcccagctgctgcgtctgcttttcttatagcagagaggctgcctacgggtggcacggggtggccatggagtgcagagttggtgggacaggggacatccagggggctcgagatgttgctggtgacaaggaatgtcaagtggcactgaggctggcgggcaaggccacaggcagattctctcacgtgggtgctcgcccctttcctcccccttgtccctccctcccaccctggccccactcaggagtgagacccagtggccaataagctctgggacagacgaatgggcgccctcctccttccttctgttgggctggagtgagtggaggaggtgactcagctcctgggctcaggcagggtctggaggggccaggatggtctcgagtgcttggcagctgaggaatgtagctgggctcgggtagtagcagcagcgaggggcgggccagggtggccagagcccggggccaggaatgtgcagctgaggtcaatggtcccggagtcctcccgactcggggtcgggcggcgggaaggagggtggccgtggcgggggtggaggtgggtgcccagggctcagagcttgtgggggttcacccacttgtaggtgccctcatactggaaacccactctcttcatcagctcgtctgcctccgtggggcctcggctggagagtgacgggtggaggagaggcatgaggtagctccaccctcaccccgcccctgcccgctgggctctgtccccagcccccaccctttcctcacctgccataaatataggggatgggcttgggcttctccagctcaatctggtgcagcagtggggtgaaaatacgccaggcctcacggagctcgtcgctgaggggacatagtatggcttgggaggccggtggcacacagggagggagggcaaaggccaccccatagcccacaggtatgcaggggccggcagctgggcctcacctgcgcacgaagtgcatctggctcccgcagaagacgtccaggatgaggcgctcgtaggcgtcagggagcttcacgttctgtgagggagagagtgtcttgctgatgccactgcctgccaccatgtggagtcccccgggcccaggccgcccaccctccacactgctccttctctgtagggcaccttgtatctgttgccgtaggtcaggtccagctccgactcctcggggttgaagaacatgcccggcttcttggtcatcatcttggtgtacacggcctcgttgggctgcacgcggatcaccagctcgttgcgcttgcactgctggtggaagatgtcgccggccacatcatggaactgcagcctcacctcggccttgcgctcgttcagggccttgccgcagcgcaggatgaagggcacccctacgtggcggaaagggcagcctcagcaccagctctctcagggtgtggaccagtgcgtgagtgtctcagtgggagctccagtgcccgcacacagggcatgcccagttctgccttgctgggcctcgaaggcatcacctaccatcccacctctcattctccacatagaggacgacggctgcaaaagtggcggtggtggacccgcggggcaccgtggggtcgtccaggtaccctttggtggcctcgccctctccatcggggttccccacgtactggcccaggaccacattgttggcctgcacctctgagatgcatttcaacaccttgacctgagagaaagccaagggagagaatgggctccttgggtgttgagttggggtgcagggatgactgtggccacagatgtgcagccctcagggcaggaggaggcccctgcttggctctgctcaccctgccagaggcccagctcagggcccctccctgaggaccctccaggaccaccctggtccatctcgagtctattctgatgaacaagctgaggcccagagaggcaatggccttccctggtcacatagtgactgtcaggcctgggacatgacaacttgggcttcatgactgccagtccaggtcacctccgggaggccacgctgtgctcagaggtggtgacttctccggggttgaggacacctgctctgcatgcacaccccagctcagtgcctcgtcacagatgggcctgcgacagggcatgctcctggggactggggtgcaccccctaccttctcatcacggacgtcatctgagttggtggaggcgggcttctccatggccaccagacacagcatctgcagtaggtggttctgcatcacgtccctggggacggaagaggccagagctcgccttagctccccgccctgttcacctggttcaagggcatggggaccccaaacaaggcttcctagtgacaagctgcaagactcacttcctgatcccccttgtcttccaggtccccttaaatcaaggaaggacatggtgatgctatcactgaatcataaaaccgtggggtgcttggctgtgtaggggtccagccctttccagcccggtctgatagctcagacacttaggttttgaactgcagggtgaggaggagctcccccaagatagggaagagtagccctgcagggtgactggctctgccaccctgtgccagcctcccaggagagaggaagagctctcaccggatgatcccaaattcatcgaaatagcccccgcgaccctcagtgccaaagggctccttgaaggtgaggataacgcaggcgatgttgtcccggttccagatggggccgaagatcctgttggcaaatctgcagggaggggcaaggtggaggaactgaccttgggcctctgtggtgcaggggccacatgtgaggggtcacccttgtctgagttctggaggaattcgtcctcggggaggcagtgggccaggtgaggctcctgagtaccacccccaccctggtcccccggcccaggcttggccccacctcagcaccatgaggttctgcaccatctccttgcccaggtagtggtcgatgcggtagatctggtcctcacggaacagggaggagatgtggttggacagccggtcagagctctgcaggtccctcccgaagggcttctccacgatgatgcggttccagcctctgctgggagcccggagctgcgttacccccttgaacccctcttcggggagtgaggatcagagctgcatcattcagacgccctcccaggggagtagaggccagaacctcctcgcccccgtggccacctcccgtgccttgtgttcccagatgaccctctggctcaacaccttccgggaagccttcccaccctgggtgccagggtggcattgctggcatgctgccgggggcccgttcccctcctgcctcatgctgggtccccggtgggtctgagtggcctgaaggcctgtaggggagcagggggaggaggcatccaagccatggcttcctcattggttttgaaaatgagaagaggacctttgctttactacccccgcattcaaaaccagccagaggacaagagcctctggctgggttgggaaaccacccagcgcgggccatgctgcattcgcagagcaaggctgccaccctgcggcctggccgggcctttggggaagcagagcggaaaggcggtgtttcgtggagcaacgctgccaccttgtggtcccgctggggatggccccggcaccatggatgctgcccagatccccggccccggacacgctcatagagtggtgggagcactgcctgggccagcctggcaggcgggaagggagggcaacggcaagccttacatctggctcatgcaggactcgtgaatgttcttggtgacggcctcgtagacggtcgggggcaaggccaggtagaagaggcggttggcctgtgaccccaggtggagggcattcatgtggctgttgaggcgctggtaggaggctgcatcatcgtactggccagccacataggagttgcgggcaaagaagtcctccagcttgagcttctcctctggggtggcctgggagacacggacagacagacacacagacagatgtcagcccctctctttgagtccgtgtgtgttctgccccaggggagtggagggtcttccctggaggtccagggagggtgccctcagaagtcagtgtccccgtcccacactgggttcagccccatcttagcagctctgcacatccagagggagggaggccaaagcaggcagcacagacactgccccaggctgggacccctgtgccttaggacagaggccagatttcaggatattttgacctgggagaaatacactggagaaagctctctctccaaaatcatgacacccaactatgattggcggagaaaacgcagcagagcacagcaggaggggacctgtgggtcctggtcacgggggctggtaatgggggtctcaaggaagtacgagagcaggcggggcggggcaggagaggaggagagcatcccgggatgggatggggggaggtccccgaagctggccatgctgggggctggtagagagggcagaaccaggctgggggaggccctgacaccacccaccttgaagaagggctcactctgtttgcggatgtcagccactgtgaggcgggaacgggcatagcccacgatgaaggtgttttcgggcagaaggccatcccggaacagccacctgagggcagggcacagctgtaaccagtgcgggcagggcaggaccaggcctgtccctggcgggaggtcacaggggcagtggtgggacacacttaccagatggtggggtagatcttcttcttggccaggtcaccctgtggcagagggaacaggtgtgtggttagaagtggctggggacacgacctacatacatcatcctccacccttggtgatctgggcactactcaggatcactactgggccacaagcatgtctgtcttgcctgatatacagacagaagagccccgagattcaagcctgtgccagccctccatccctgacccagaagacataaacgcatctcctgcgttccaggagaaaacctgaaaattcaattcagtagaaccaagggacgacagaagtaccatgtagccacatttgtgagacgtgacctcaagtgcttacattagcaaaaaagagtggttcaaaaataaggagctaagcattccacttaagaagtgagaaaaagggccagatgcggtggctcacacctgtaatcccagcactttgggaggctgaggcaggcagatcacctgaagtcaggagttcaagaccagccaatgtggcaaaaccccatctctattaaaaatacaaaaattagccaggtgtggtggcaggcacctgtaatcccagttactcaggaggctgaggcaggagaatcacttgaatccgggaggcagaggttgcagtgagccgagatcgtgccactgcactccagcctgggtgacaagagtgagacttcatctccaaaaaaaaagtgagaaaaagatagaactgcaagccaaattaccaggaagaaaataggaaataatgacaagtaaaattaataaaattaaaagctaacccaaagaaaagatgaacaaagctggaaattggtgtttgaaaaagacgaatagaaacagacaaccccctggcatggttgcttttttaaaagggcataggccgggcacagtggcttactcctgtaatcccagcactttgagaggccgaggcaggcggatcaagaggtcaggagatcgagaccatcctggctgacacggtgaaaccccgcctctaccaaaaatacaaaaaattagccaggcgtggtggcgggtgtctgtagtcccagctactcggaaggctgaggtaggagaatcacttgaacccgggagatggaggttgcagtgagccaagattgcaccattgcaccccagcctgggcgacaagagtgaaactccgtctcaaaaaacaaaaaacaaaaaaacaactaaacagctggacgcggtggctcaagcctataatcccagcactttggaaggccgaggcggatggattacctgagttcgggagttcaagaccagcctgaccaacatggagaaaccgtttctactaaaaatacaaaattggctgggcatggtggcccatgcctgtaatcccagctactcaggaggctgaggcaggagaatcgcttgaacctgggaggcggaggttgcagtgagccaagatcaagccactgcactccagcctgggctacaaaagcgaaactccgtctcaaacaaacaaaaaacagagcaatggacctgagaggggacagtggccacaaatcttcctacagaaacaaccccctggcatagagagtgttgccagtgggttctaccaaaatgcaagcacaagagaattccagcctgaagcaaactcttcctgcagaaggaagaaaggggaacacttcccaagccaccttatggggcctacagagccttggtacggaaacctgatgagaaaggcacatgggaaaacccatacgcctcattcacacacacatgcagatgcagaaatcccacacgaaatatcagcaggccgggcacaactcacacaccccagcactttgggagaccaaggtgggaggaagattgcttgaaatcaggaggttttttttttttttttttttaaagacatggtctcactctgtcacctaggctggagtgcagtggcacgatctcagttcactgcaacctctgcctctgggctcaagcaatcctcccacctcagcctctggagtagctgggactacaggtacatgccaacacacccagctaattttttgtattttttgtagagacagggtttccccatgttgtccaggctgctcttgaactcctgggctcaagtgatctgcccgcctcagcctcccaaagtgttgggattacaggcgtgagccacgacgacccactgaccctgtctctttaaaaaaaaagaagaaaacatcagcaaaccaaatcctgcaatgttaaaaacggtaggttttttatttacagaataaatacatctgtaaataaaaagttggtttgatattaacagaaaaaaatcattgaaattcaccatattaagagattaaaaaaaacctctaagaactctctgcctactgctatgttttgattttttaaatctagcaatcttgctcaacccaacagatgtagatcaagtgtttcagaaatcacctattcacgctaaaactcttagcagagggggaatgcaagggaacttcactaacttgataaagggcatctataaaacaccattctggctgggcgtggtggctcaagcctgtaatcccagcactttgggaggccgaggcggggaatcgcttgaggtcaggagtttgagaccagcctgaccaacatggtgaaaccccatttctactaaaaatacaaaacttagctgaacatggtggtgtatgcctgtaatcccagctattcaggagactgaggcaggagaatcgcttgaaccaggaggcagagactggagtgagccgagatcacaccactgtagcctgagcaacagagctagacgtcgtctcaaaaaaaaaaaccaccaccaaaaaacaaagaacaaaaaaacccccaaaccatcatccttacaaatactacaaatatcacacttataggaaatgctgaaatattaatcatccctttaagcaatcaggaacaagaaaagtgcagtaaggcaagaaaatgaaaatggctgaagttgagctgtgaggtggtgcgggtgctccctctgatcaagtgaaacacacacctatcctgtgacctggccgttccaccccaagagaaatgaaagtgcaagtccacacaaagacctgcacacgaatggtcacagcagccttggttcatagcggccccaaactggaaacaagtcaaacacttgaattaacatgtgacccggcaaactgtgcattcatacaacggatactactcagcaacactgggaaatctcagcatcagagatgcaacccattgtgacagaaatcagatcagcggttgcctggagcagggcagattggctgggaatgggtacccaggaactttctggggagatgacgatggcctttattgtgatgagggtgtacagccaattgtacagttaagatttgcgcaccaacaaaagacggcgagaaaaccaacaatggagcggagggtggggagtgggtcagaaatgaccctttgagggccagtgactgtgagagccccaggtgagggggcttcctgggtgcagagcatattctgtttcttgatctaggagcagtttctgtggctgtgctgagtttgtgaaaagtcatcaacaagctagacctgcaccatctgtgttcttcatgacatgtatttctttttttttttgagacggagtctcactctgtcggccaggctggagtgcagtggcgtgatcttggctcactgaaatctccacctcctgggttcaagccattctcctgcctcagcctcctgagtagctgggactccaggcacctgccaccacgcccggctaatttttgtatttttactagagatggggtttcgccatgttggccaggctggcctcaaactcctgaccttgtgatccacctgccgtggcctcccaaagtgctggcattacaggcgtgagccaccgtggccggcccatgacatatatttcaataaaacatggtaaaaactaatagtctgggcgtggtggctcatgcctgtaaccccagcactttgggaggctgaggagggtggatcacctgaggtcaggagttcgagaccagcctggcaaacatggtgaaaccccgtctctactaaaaatacaggccaggcgcggtggctcatgcctgtaatcctagcactttgggaggttgaggtgggtggatcacgaggtcaggagattgagaccatcctggccaacatggtgagaccccgtttctactaaaatacaaaaaattagctggatgtggtggtgcgcgcctgtagtcccagctactcgggaggctgaggcaggggaattgcttgaacctcgcaggtggagattgcagtgagccaagattgcgccactgtactccagcctggtgaaagagcaagactccatctcaaaaaaaagaaaaaacaaaaattagctggatgtggtggcaggcacctggaatcccagctactcaggaggctaaggcaggagaatcacttgaatccaggagacggaggttgcagtgagccaagattgcgccaccaaactccagcctgggtgacagcaagactccatgtcacgaaaaaaaaaaaaaaaaaaacacatgctcttcgaagcaatcaggcactgcaaccatggatgggtccatttctacaaaccattacagaatgggggccatgccaccaggtcaaacgccctcacccagagccaggcagttaggaagccaccacagggcttccaggagggcaactgctatggtgtgggtgccttgtgtgcttgcgctcttcaggggccctgctccacttctgatgctcctcaggtgagctcggtgccaggactacagcgacacggacctctcactgctgcacccttcaaagtccagcagacaacccctcgccctggggtaggagctcctctactcagctcctcacagcacctgccatcagtggggctggggaggggaacgttgcccatgtcacatcaactcacggctggccccacacagaaagggtcagcttactgggaactaactggaccctgaaataaacggaaagaaccacagcctgcaaatacctctaagcctcactcaaagcaggtcatgtttgctcatgaccaaattccggaagactgggaggcatcgggacagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtaagacggacagtaggggtggggtaaggcaggccgctctctcccatggtgacagggagctaagctgagctgagccggactgagctgctctcctcaggactcaggggtagccctgccctcccagctggctgcgatgctctagtgggactttctggaggaacaaacatgggaagacatcgggaaacctgacagcttggtcaagagtctactcgtgccatgtgggtgggggcaattcaaggggtccttagtgaaaagcagttgggagcttctcatcttccccacgccctcctctttcctgaggaccacagcaggggagggatctgcccaaggacacaaggtgacttagtagaagcagggcatgatgaagatctctagccaccaacatctggctaggccagggcaaagggacctgggccatgacctgtctgttttataaaccgaaatcgctgcagcccttgtcttggcatgagggtttcatggtagagcacgatgcctgctggagggccagcgggggtgggccatcccatccccaagggtcactggggttaaggacctgcccagactccctgggtggagccctgggccttggcaggggcccagctggttcctggccactggggccagagaacctgggggctgctgagttagttcagctgaaaaaccaacaaaagggcctccctgctatacccgggggctcatgagtcaccggggctttgggggagtgccaacatcatcatgacacagcaagaatcttatcagaccaatggggaagtcagcccagaaatgttctgaggaaaggggaggcgggggccgctgggtcatccctcccacaggcccatcattgggatgcgtcctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcagtaagtacctcggctccctttctggtaggggtgggagtcctgagaaggcaggaagtggcccacttggtaactctgaggtgccatcagggcccccaggaaggaagctgggtgtgtgggcaagtgtgaggtaagctggccagggaggaggaagggacagaggaaggccacgtgggtccagcctgccccagggtgtcctgcttgcccaggctgtgggtctgccagccacttgcctgctttcagtttctaggtcatgctgagcttgttcccaactcggggctccgggcatttgctcttccttctgtgtttgtgctctcccggccctctttgtgggatctatgcgctttgggggactggggacacagggcccatgtgtatcttctgaaacacacgtcagcctgaactcttgctggtctgcttacttgccgtggttccctggccgcaatagcacataggtcccatgaggagggcagggactggctgctgtggcccagaagtacccaatcgctgtctgctcaatgaacggagaatgggctgctttcctggaacagcagattctaggatcacgtgccctcaagtgccaccctgcctacctcccgcaccgagtgaggcatcaggcgtggaagaagcccgggagccggagctgttccaggtgctgcctgagcacgccacctcccatctcccccccagcaggaagaggaaaaaacaaaccacgaggctcttcagagagaggaccccttgtcccctacccacagtgctggagctggcacttcctatttctgctttgaaagcctcaggttgtcactctcagaacagaggagagcaaaggggaaccctactgatttcaacaaaacaaagttgcccaacccgaagctggccacaggcggaggcagtgaaatgacaaaatcagcttggaaaagcctaaggaccctgggccctcgtttcaaaagctgtcatttgctacacgaaatgctgaggttcaggaaaaggaagacacttgctccaactcacacagcaagcttggatgctctcaatgaggtgtctaataagagctgaaggccaggagtcataagctatcattgtggcctgggttgctctgttgcagtgccttgtgacagcatggggtggggatggagaaagcaacctcagttaccttctcctccagtctgcttcttggactaagggtttaacggtcagagtcctggctgttaaggtttgtggctgatgcaggtatggctctttttatttttatttttttgagatggagtctcactcactccgtcacccaggatggagtgcaatggtgccatctcagctcactgcaacctccacctcctgggttcaagcgattttcctgcctcagcctcccaagtagctgggattacagatgggtgccactacacctaactaatttttgttattttttttttttttttgagatggagtctcactctgtcacccaggctggaatgcagtgttgcgatttctgctcactgcaagctccgcctcccgagttcacgcctttctcctgcctcagcctcctgagtagctggactacaggtgcccacaccaggcctggctaattttttatttagtagagacgggatttcaccatgttagccaggatggtctcaatctcctgacctcatgatccacccgcttcagcctcccaaagtgctgggattacagacgtgagccactgcgcccggcctttttgttttgttttgttttgagacagagtctcgctctgtcgccaggctggagtgcagtggcgcgatctcagctcactgcaacctctgactccctgattcaagcgattctactgcctcagcctactgagtagctgggactacaggcacgcaccaccacgcccagctaatttttgtatttttagtagagatggggtttcaccatgttggccaggatggtctcgatctcttgaccttgtgatctgcccaccttggccccccaaagtgctgggattacagatgtgagccactgcgcccagccaatttttgtattttaagtagagactgggtttcgccatgttggccaggctggtgtcaaactcctgacctcaggcgatccacctgcctcggcctcccaaagtgctgggaatacaggcgtgagccaccgtgcccggccaggtatggctcttctgaggggaccaggctggggctggggctgaggccaagcccaatctactgtgggctccacctggtacctctcctgggtctcaggcttatggggagtcagaggacaatggcccctccttactctgccactggcagagcccttctccctcggctgcctcctcattcccttttggctctccttttctaagttctgatcagaagtacaaaggtgtcaaggagtaggtttgacaaagtgtgacagcgcgttgttctatgtgaacaaagaaccactgagctcagccagcactgaggggcgcacgatgtggaagaactaactagttttgatagagctcctgctcaaggttacaaggtaagttaatggcaaagatggtcatacagtaatgagcagagagattcttgagtgcatccagggttaaaagtgaaaactgagaccacgtgtaatttgagatgaagcccttgttccaccagcccctgcacagtctcactgccccatgggacacaggggagggtgctctagtctcgggcgatggctgtcctaggaccacccctccctcccctcccatggaaatcctcatgctatactattcttttgtctttcctatgagtgcagaatggcggttctacaagctggacaattggggccaggtggggtgaggcagagctccttggtaggctttcgaaattgaggcaaagagacagtgttcaaagaaaagctaagtgtttgtatcgacggaacttgaagtgttagtgaagaggcagagatcaggcctcagatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctct

SEQ ID NO: 2499 - DNA, 16182 bp, Homo sapiens
  source 1..16182: mol_type = genomic DNA
ggctgtttgcggatttaatggcagggcattgaggttgggaggggtcccagctgctgcgtctgcttttcttatagcagagaggctgcctacgggtggcacggggtggccatggagtgcagagttggtgggacaggggacatccagggggctcgagatgttgctggtgacaaggaatgtcaagtggcactgaggctggcgggcaaggccacaggcagattctctcacgtgggtgctcgcccctttcctcccccttgtccctccctcccaccctggccccactcaggagtgagacccagtggccaataagctctgggacagacgaatgggcgccctcctccttccttctgttgggctggagtgagtggaggaggtgactcagctcctgggctcaggcagggtctggaggggccaggatggtctcgagtgcttggcagctgaggaatgtagctgggctcgggtagtagcagcagcgaggggcgggccagggtggccagagcccggggccaggaatgtgcagctgaggtcaatggtcccggagtcctcccgactcggggtcgggcggcgggaaggagggtggccgtggcgggggtggaggtgggtgcccagggctcagagcttgtgggggttcacccacttgtaggtgccctcatactggaaacccactctcttcatcagctcgtctgcctccgtggggcctcggctggagagtgacgggtggaggagaggcatgaggtagctccaccctcaccccgcccctgcccgctgggctctgtccccagcccccaccctttcctcacctgccataaatataggggatgggcttgggcttctccagctcaatctggtgcagcagtggggtgaaaatacgccaggcctcacggagctcgtcgctgaggggacatagtatggcttgggaggccggtggcacacagggagggagggcaaaggccaccccatagcccacaggtatgcaggggccggcagctgggcctcacctgcgcacgaagtgcatctggctcccgcagaagacgtccaggatgaggcgctcgtaggcgtcagggagcttcacgttctgtgagggagagagtgtcttgctgatgccactgcctgccaccatgtggagtcccccgggcccaggccgcccaccctccacactgctccttctctgtagggcaccttgtatctgttgccgtaggtcaggtccagctccgactcctcggggttgaagaacatgcccggcttcttggtcatcatcttggtgtacacggcctcgttgggctgcacgcggatcaccagctcgttgcgcttgcactgctggtggaagatgtcgccggccacatcatggaactgcagcctcacctcggccttgcgctcgttcagggccttgccgcagcgcaggatgaagggcacccctacgtggcggaaagggcagcctcagcaccagctctctcagggtgtggaccagtgcgtgagtgtctcagtgggagctccagtgcccgcacacagggcatgcccagttctgccttgctgggcctcgaaggcatcacctaccatcccacctctcattctccacatagaggacgacggctgcaaaagtggcggtggtggacccgcggggcaccgtggggtcgtccaggtaccctttggtggcctcgccctctccatcggggttccccacgtactggcccaggaccacattgttggcctgcacctctgagatgcatttcaacaccttgacctgagagaaagccaagggagagaatgggctccttgggtgttgagttggggtgcagggatgactgtggccacagatgtgcagccctcagggcaggaggaggcccctgcttggctctgctcaccctgccagaggcccagctcagggcccctccctgaggaccctccaggaccaccctggtccatctcgagtctattctgatgaacaagctgaggcccagagaggcaatggccttccctggtcacatagtgactgtcaggcctgggacatgacaacttgggcttcatgactgccagtccaggtcacctccgggaggccacgctgtgctcagaggtggtgacttctccggggttgaggacacctgctctgcatgcacaccccagctcagtgcctcgtcacagatgggcctgcgacagggcatgctcctggggactggggtgcaccccctaccttctcatcacggacgtcatctgagttggtggaggcgggcttctccatggccaccagacacagcatctgcagtaggtggttctgcatcacgtccctggggacggaagaggccagagctcgccttagctccccgccctgttcacctggttcaagggcatggggaccccaaacaaggcttcctagtgacaagctgcaagactcacttcctgatcccccttgtcttccaggtccccttaaatcaaggaaggacatggtgatgctatcactgaatcataaaaccgtggggtgcttggctgtgtaggggtccagccctttccagcccggtctgatagctcagacacttaggttttgaactgcagggtgaggaggagctcccccaagatagggaagagtagccctgcagggtgactggctctgccaccctgtgccagcctcccaggagagaggaagagctctcaccggatgatcccaaattcatcgaaatagcccccgcgaccctcagtgccaaagggctccttgaaggtgaggataacgcaggcgatgttgtcccggttccagatggggccgaagatcctgttggcaaatctgcagggaggggcaaggtggaggaactgaccttgggcctctgtggtgcaggggccacatgtgaggggtcacccttgtctgagttctggaggaattcgtcctcggggaggcagtgggccaggtgaggctcctgagtaccacccccaccctggtcccccggcccaggcttggccccacctcagcaccatgaggttctgcaccatctccttgcccaggtagtggtcgatgcggtagatctggtcctcacggaacagggaggagatgtggttggacagccggtcagagctctgcaggtccctcccgaagggcttctccacgatgatgcggttccagcctctgctgggagcccggagctgcgttacccccttgaacccctcttcggggagtgaggatcagagctgcatcattcagacgccctcccaggggagtagaggccagaacctcctcgcccccgtggccacctcccgtgccttgtgttcccagatgaccctctggctcaacaccttccgggaagccttcccaccctgggtgccagggtggcattgctggcatgctgccgggggcccgttcccctcctgcctcatgctgggtccccggtgggtctgagtggcctgaaggcctgtaggggagcagggggaggaggcatccaagccatggcttcctcattggttttgaaaatgagaagaggacctttgctttactacccccgcattcaaaaccagccagaggacaagagcctctggctgggttgggaaaccacccagcgcgggccatgctgcattcgcagagcaaggctgccaccctgcggcctggccgggcctttggggaagcagagcggaaaggcggtgtttcgtggagcaacgctgccaccttgtggtcccgctggggatggccccggcaccatggatgctgcccagatccccggccccggacacgctcatagagtggtgggagcactgcctgggccagcctggcaggcgggaagggagggcaacggcaagccttacatctggctcatgcaggactcgtgaatgttcttggtgacggcctcgtagacggtcgggggcaaggccaggtagaagaggcggttggcctgtgaccccaggtggagggcattcatgtggctgttgaggcgctggtaggaggctgcatcatcgtactggccagccacataggagttgcgggcaaagaagtcctccagcttgagcttctcctctggggtggcctgggagacacggacagacagacacacagacagatgtcagcccctctctttgagtccgtgtgtgttctgccccaggggagtggagggtcttccctggaggtccagggagggtgccctcagaagtcagtgtccccgtcccacactgggttcagccccatcttagcagctctgcacatccagagggagggaggccaaagcaggcagcacagacactgccccaggctgggacccctgtgccttaggacagaggccagatttcaggatattttgacctgggagaaatacactggagaaagctctctctccaaaatcatgacacccaactatgattggcggagaaaacgcagcagagcacagcaggaggggacctgtgggtcctggtcacgggggctggtaatgggggtctcaaggaagtacgagagcaggcggggcggggcaggagaggaggagagcatcccgggatgggatggggggaggtccccgaagctggccatgctgggggctggtagagagggcagaaccaggctgggggaggccctgacaccacccaccttgaagaagggctcactctgtttgcggatgtcagccactgtgaggcgggaacgggcatagcccacgatgaaggtgttttcgggcagaaggccatcccggaacagccacctgagggcagggcacagctgtaaccagtgcgggcagggcaggaccaggcctgtccctggcgggaggtcacaggggcagtggtgggacacacttaccagatggtggggtagatcttcttcttggccaggtcaccctgtggcagagggaacaggtgtgtggttagaagtggctggggacacgacctacatacatcatcctccacccttggtgatctgggcactactcaggatcactactgggccacaagcatgtctgtcttgcctgatatacagacagaagagccccgagattcaagcctgtgccagccctccatccctgacccagaagacataaacgcatctcctgcgttccaggagaaaacctgaaaattcaattcagtagaaccaagggacgacagaagtaccatgtagccacatttgtgagacgtgacctcaagtgcttacattagcaaaaaagagtggttcaaaaataaggagctaagcattccacttaagaagtgagaaaaagggccagatgcggtggctcacacctgtaatcccagcactttgggaggctgaggcaggcagatcacctgaagtcaggagttcaagaccagccaatgtggcaaaaccccatctctattaaaaatacaaaaattagccaggtgtggtggcaggcacctgtaatcccagttactcaggaggctgaggcaggagaatcacttgaatccgggaggcagaggttgcagtgagccgagatcgtgccactgcactccagcctgggtgacaagagtgagacttcatctccaaaaaaaaagtgagaaaaagatagaactgcaagccaaattaccaggaagaaaataggaaataatgacaagtaaaattaataaaattaaaagctaacccaaagaaaagatgaacaaagctggaaattggtgtttgaaaaagacgaatagaaacagacaaccccctggcatggttgcttttttaaaagggcataggccgggcacagtggcttactcctgtaatcccagcactttgagaggccgaggcaggcggatcaagaggtcaggagatcgagaccatcctggctgacacggtgaaaccccgcctctaccaaaaatacaaaaaattagccaggcgtggtggcgggtgtctgtagtcccagctactcggaaggctgaggtaggagaatcacttgaacccgggagatggaggttgcagtgagccaagattgcaccattgcaccccagcctgggcgacaagagtgaaactccgtctcaaaaaacaaaaaacaaaaaaacaactaaacagctggacgcggtggctcaagcctataatcccagcactttggaaggccgaggcggatggattacctgagttcgggagttcaagaccagcctgaccaacatggagaaaccgtttctactaaaaatacaaaattggctgggcatggtggcccatgcctgtaatcccagctactcaggaggctgaggcaggagaatcgcttgaacctgggaggcggaggttgcagtgagccaagatcaagccactgcactccagcctgggctacaaaagcgaaactccgtctcaaacaaacaaaaaacagagcaatggacctgagaggggacagtggccacaaatcttcctacagaaacaaccccctggcatagagagtgttgccagtgggttctaccaaaatgcaagcacaagagaattccagcctgaagcaaactcttcctgcagaaggaagaaaggggaacacttcccaagccaccttatggggcctacagagccttggtacggaaacctgatgagaaaggcacatgggaaaacccatacgcctcattcacacacacatgcagatgcagaaatcccacacgaaatatcagcaggccgggcacaactcacacaccccagcactttgggagaccaaggtgggaggaagattgcttgaaatcaggaggttttttttttttttttttttaaagacatggtctcactctgtcacctaggctggagtgcagtggcacgatctcagttcactgcaacctctgcctctgggctcaagcaatcctcccacctcagcctctggagtagctgggactacaggtacatgccaacacacccagctaattttttgtattttttgtagagacagggtttccccatgttgtccaggctgctcttgaactcctgggctcaagtgatctgcccgcctcagcctcccaaagtgttgggattacaggcgtgagccacgacgacccactgaccctgtctctttaaaaaaaaagaagaaaacatcagcaaaccaaatcctgcaatgttaaaaacggtaggttttttatttacagaataaatacatctgtaaataaaaagttggtttgatattaacagaaaaaaatcattgaaattcaccatattaagagattaaaaaaaacctctaagaactctctgcctactgctatgttttgattttttaaatctagcaatcttgctcaacccaacagatgtagatcaagtgtttcagaaatcacctattcacgctaaaactcttagcagagggggaatgcaagggaacttcactaacttgataaagggcatctataaaacaccattctggctgggcgtggtggctcaagcctgtaatcccagcactttgggaggccgaggcggggaatcgcttgaggtcaggagtttgagaccagcctgaccaacatggtgaaaccccatttctactaaaaatacaaaacttagctgaacatggtggtgtatgcctgtaatcccagctattcaggagactgaggcaggagaatcgcttgaaccaggaggcagagactggagtgagccgagatcacaccactgtagcctgagcaacagagctagacgtcgtctcaaaaaaaaaaaccaccaccaaaaaacaaagaacaaaaaaacccccaaaccatcatccttacaaatactacaaatatcacacttataggaaatgctgaaatattaatcatccctttaagcaatcaggaacaagaaaagtgcagtaaggcaagaaaatgaaaatggctgaagttgagctgtgaggtggtgcgggtgctccctctgatcaagtgaaacacacacctatcctgtgacctggccgttccaccccaagagaaatgaaagtgcaagtccacacaaagacctgcacacgaatggtcacagcagccttggttcatagcggccccaaactggaaacaagtcaaacacttgaattaacatgtgacccggcaaactgtgcattcatacaacggatactactcagcaacactgggaaatctcagcatcagagatgcaacccattgtgacagaaatcagatcagcggttgcctggagcagggcagattggctgggaatgggtacccaggaactttctggggagatgacgatggcctttattgtgatgagggtgtacagccaattgtacagttaagatttgcgcaccaacaaaagacggcgagaaaaccaacaatggagcggagggtggggagtgggtcagaaatgaccctttgagggccagtgactgtgagagccccaggtgagggggcttcctgggtgcagagcatattctgtttcttgatctaggagcagtttctgtggctgtgctgagtttgtgaaaagtcatcaacaagctagacctgcaccatctgtgttcttcatgacatgtatttctttttttttttgagacggagtctcactctgtcggccaggctggagtgcagtggcgtgatcttggctcactgaaatctccacctcctgggttcaagccattctcctgcctcagcctcctgagtagctgggactccaggcacctgccaccacgcccggctaatttttgtatttttactagagatggggtttcgccatgttggccaggctggcctcaaactcctgaccttgtgatccacctgccgtggcctcccaaagtgctggcattacaggcgtgagccaccgtggccggcccatgacatatatttcaataaaacatggtaaaaactaatagtctgggcgtggtggctcatgcctgtaaccccagcactttgggaggctgaggagggtggatcacctgaggtcaggagttcgagaccagcctggcaaacatggtgaaaccccgtctctactaaaaatacaggccaggcgcggtggctcatgcctgtaatcctagcactttgggaggttgaggtgggtggatcacgaggtcaggagattgagaccatcctggccaacatggtgagaccccgtttctactaaaatacaaaaaattagctggatgtggtggtgcgcgcctgtagtcccagctactcgggaggctgaggcaggggaattgcttgaacctcgcaggtggagattgcagtgagccaagattgcgccactgtactccagcctggtgaaagagcaagactccatctcaaaaaaaagaaaaaacaaaaattagctggatgtggtggcaggcacctggaatcccagctactcaggaggctaaggcaggagaatcacttgaatccaggagacggaggttgcagtgagccaagattgcgccaccaaactccagcctgggtgacagcaagactccatgtcacgaaaaaaaaaaaaaaaaaaacacatgctcttcgaagcaatcaggcactgcaaccatggatgggtccatttctacaaaccattacagaatgggggccatgccaccaggtcaaacgccctcacccagagccaggcagttaggaagccaccacagggcttccaggagggcaactgctatggtgtgggtgccttgtgtgcttgcgctcttcaggggccctgctccacttctgatgctcctcaggtgagctcggtgccaggactacagcgacacggacctctcactgctgcacccttcaaagtccagcagacaacccctcgccctggggtaggagctcctctactcagctcctcacagcacctgccatcagtggggctggggaggggaacgttgcccatgtcacatcaactcacggctggccccacacagaaagggtcagcttactgggaactaactggaccctgaaataaacggaaagaaccacagcctgcaaatacctctaagcctcactcaaagcaggtcatgtttgctcatgaccaaattccggaagactgggaggcatcgggacagactccagaaaggtactggtggcaggggactggtctgctgagtcacagcaaccccacgctccaggccgtttgttcctgctgctccctttgggattaactagagattgaaccggctcaccttgtttcagctcaggccctgcaaccgaccgaccgtctgctgggctccaagtcacctgagaggcgaggtgaggtaagacggacagtaggggtggggtaaggcaggccgctctctcccatggtgacagggagctaagctgagctgagccggactgagctgctctcctcaggactcaggggtagccctgccctcccagctggctgcgatgctctagtgggactttctggaggaacaaacatgggaagacatcgggaaacctgacagcttggtcaagagtctactcgtgccatgtgggtgggggcaattcaaggggtccttagtgaaaagcagttgggagcttctcatcttccccacgccctcctctttcctgaggaccacagcaggggagggatctgcccaaggacacaaggtgacttagtagaagcagggcatgatgaagatctctagccaccaacatctggctaggccagggcaaagggacctgggccatgacctgtctgttttataaaccgaaatcgctgcagcccttgtcttggcatgagggtttcatggtagagcacgatgcctgctggagggccagcgggggtgggccatcccatccccaagggtcactggggttaaggacctgcccagactccctgggtggagccctgggccttggcaggggcccagctggttcctggccactggggccagagaacctgggggctgctgagttagttcagctgaaaaaccaacaaaagggcctccctgctatacccgggggctcatgagtcaccggggctttgggggagtgccaacatcatcatgacacagcaagaatcttatcagaccaatggggaagtcagcccagaaatgttctgaggaaaggggaggcgggggccgctgggtcatccctcccacaggcccatcattgggatgcgtcctgaacgcccatcaagcccatggcccttgtgatccaggtggggaaactaaggcccagagaagtgaggaccccgcagactatcaatcccagtctcttcccctcactccctgtgaagctctccagcatcatcgaggtcccatcaggtggggaaagatgctgttccaggcgcacactagtctacaaggccagagctttctggaagggggcagtaagtacctcggctccctttctggtaggggtgggagtcctgagaaggcaggaagtggcccacttggtaactctgaggtgccatcagggcccccaggaaggaagctgggtgtgtgggcaagtgtgaggtaagctggccagggaggaggaagggacagaggaaggccacgtgggtccagcctgccccagggtgtcctgcttgcccaggctgtgggtctgccagccacttgcctgctttcagtttctaggtcatgctgagcttgttcccaactcggggctccgggcatttgctcttccttctgtgtttgtgctctcccggccctctttgtgggatctatgcgctttgggggactggggacacagggcccatgtgtatcttctgaaacacacgtcagcctgaactcttgctggtctgcttacttgccgtggttccctggccgcaatagcacataggtcccatgaggagggcagggactggctgctgtggcccagaagtacccaatcgctgtctgctcaatgaacggagaatgggctgctttcctggaacagcagattctaggatcacgtgccctcaagtgccaccctgcctacctcccgcaccgagtgaggcatcaggcgtggaagaagcccgggagccggagctgttccaggtgctgcctgagcacgccacctcccatctcccccccagcaggaagaggaaaaaacaaaccacgaggctcttcagagagaggaccccttgtcccctacccacagtgctggagctggcacttcctatttctgctttgaaagcctcaggttgtcactctcagaacagaggagagcaaaggggaaccctactgatttcaacaaaacaaagttgcccaacccgaagctggccacaggcggaggcagtgaaatgacaaaatcagcttggaaaagcctaaggaccctgggccctcgtttcaaaagctgtcatttgctacacgaaatgctgaggttcaggaaaaggaagacacttgctccaactcacacagcaagcttggatgctctcaatgaggtgtctaataagagctgaaggccaggagtcataagctatcattgtggcctgggttgctctgttgcagtgccttgtgacagcatggggtggggatggagaaagcaacctcagttaccttctcctccagtctgcttcttggactaagggtttaacggtcagagtcctggctgttaaggtttgtggctgatgcaggtatggctctttttatttttatttttttgagatggagtctcactcactccgtcacccaggatggagtgcaatggtgccatctcagctcactgcaacctccacctcctgggttcaagcgattttcctgcctcagcctcccaagtagctgggattacagatgggtgccactacacctaactaatttttgttattttttttttttttttgagatggagtctcactctgtcacccaggctggaatgcagtgttgcgatttctgctcactgcaagctccgcctcccgagttcacgcctttctcctgcctcagcctcctgagtagctggactacaggtgcccacaccaggcctggctaattttttatttagtagagacgggatttcaccatgttagccaggatggtctcaatctcctgacctcatgatccacccgcttcagcctcccaaagtgctgggattacagacgtgagccactgcgcccggcctttttgttttgttttgttttgagacagagtctcgctctgtcgccaggctggagtgcagtggcgcgatctcagctcactgcaacctctgactccctgattcaagcgattctactgcctcagcctactgagtagctgggactacaggcacgcaccaccacgcccagctaatttttgtatttttagtagagatggggtttcaccatgttggccaggatggtctcgatctcttgaccttgtgatctgcccaccttggccccccaaagtgctgggattacagatgtgagccactgcgcccagccaatttttgtattttaagtagagactgggtttcgccatgttggccaggctggtgtcaaactcctgacctcaggcgatccacctgcctcggcctcccaaagtgctgggaatacaggcgtgagccaccgtgcccggccaggtatggctcttctgaggggaccaggctggggctggggctgaggccaagcccaatctactgtgggctccacctggtacctctcctgggtctcaggcttatggggagtcagaggacaatggcccctccttactctgccactggcagagcccttctccctcggctgcctcctcattcccttttggctctccttttctaagttctgatcagaagtacaaaggtgtcaaggagtaggtttgacaaagtgtgacagcgcgttgttctatgtgaacaaagaaccactgagctcagccagcactgaggggcgcacgatgtggaagaactaactagttttgatagagctcctgctcaaggttacaaggtaagttaatggcaaagatggtcatacagtaatgagcagagagattcttgagtgcatccagggttaaaagtgaaaactgagaccacgtgtaatttgagatgaagcccttgttccaccagcccctgcacagtctcactgccccatgggacacaggggagggtgctctagtctcgggcgatggctgtcctaggaccacccctccctcccctcccatggaaatcctcatgctatactattcttttgtctttcctatgagtgcagaatggcggttctacaagctggacaattggggccaggtggggtgaggcagagctccttggtaggctttcgaaattgaggcaaagagacagtgttcaaagaaaagctaagtgtttgtatcgacggaacttgaagtgttagtgaagaggcagagatcaggcctcagatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctctcgggcacctgcgctggaggccggcccgccggctgcctgccatacccgctgccgctgctctgcatccccaattccggcgggcacgggtgcagctccgcgtagtgctcccgaatccccatcgccggccaggccccgcccctactgtccggtttccccgcctgccccggcggcctcgcgcgctcgcggagggctccacttccgccggcagcgtggccacgcctcctctgggctgtccctcggctcctgggcggggccttctgccgcgccactcccccgggaaccctcgcctgttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcg

SEQ ID NO: 2500 - DNA, 40869 bp, Homo sapiens
  source 1..40869: mol_type = genomic DNA
cgcggagcggaggccgaggcgagagcctggcgctgtaggactagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgtgaggggcgggtagacttggacggggcatgccggcgttgggccctgggctctggggcggggcggctccccgtcagggttcactttcgcaccttgttccctccgagctccggaaaacttgggaagcagcaaaacaaaattcaggaggaaagagaaagcattcatgcttacgctacccagcgatttggtgaatttcctcatctgagcaaattttgcattttagcagttttccttggacagatttgttccggtcccttaaaatatttacaggttgcctgataatttagcatttcttgctcactcaggcatctaatcgtggtcagtaaaagctaggcctctggaacctggctgagattctggttctgtagtgtgactttggggcagttactcaagctttctgtgctctcagttttctcatacgcaaaaatggggatggtgacaataatagtacccaacgcatgatgtagtggacgcaaaatgagtggcatgtgtaagggtctctgcatatgcctcacatacagtaagggctgagtcagtgttagctattaatattacttttctcctgctgctgctgttactattaatattatgattatttgtatttttctatcactgctaccccagggagagtgctaagcacttcatgtacattatcttttgtctttctaataaccctttgagggcccggtaccatggctcctgcctgtaatcccagcactttgggaggctgaggcgggaggatcgcttgatcctgccactgcattccagcctgagtgacagggagaccctgtcccaaacaaaacaaaaataactttttgatgtttaaactattgttttctacttttttcagctatatatgcataggattggggagatttaagtatattgcctaaggtgacacagcaagaaagctaggatttgaaccctggcactctggctccagagcctgcactctaaattgtatatttcacttacgtcatagagcaggcattatgtggatgtcaggacacattctgctggaagatgggcacaaaaacagataatagaattcaccacgctaagtgatactaaggaggtatagcaaggagcacgaaggagaaacaccagtatgagctggggtagaagaggtgatatatgagcctttccatcctcaaggatgaggttactgatctgagaaggaagcgaggcatcccagccaaaggatgctgcagcacaaagtcacgtggtcacactggagagggtgaccaatagggcctgtggggagtctaggaaggtggctcacagcctacatgaatttgttgttcacttataaggcatgctgggagctggtagaggattttagacaaggaagtgatagggtaatttttgtgttttgaaggtaactgcggcagcaatatggggaatggattgaagagaggaaagaatgggacagggagatggctactgggtggctgatagagcaggtgagaggtgtgtggtctgaactgtgtcaggtcagtggcactgagatcagtgtttgggttttagagacatgaagcaaacatgacttgtagctattagagcaggggcagagatggggtccataatgaataagagggaggaattgggatcttggaggatccttaggaaactgggtaaacaacatcagagttcaggagatagagtgtgttgggaaaggtaatgagttttgttttgaacactaaagagcacctagccagacaattagattgtcttacaaatgaagaaactgagctgacacaaattatgggtcaagttaaggaactcgtctgaatttacagcatattggaggtagagcttcaacttgaacacaggttttccagtttctagtcaattgttttttcaacttcagagcagttacctcatttaaaaagttaggcagcagtctgcagctcagtagagatgcttgaatgcagaagtgtgtaaatgctaaaatgtggcctgagaactaggaactttagaggtcattgtacatatcaggacacaggcctagagaacagagagactgtgcaaacaggtgcggccaagctggattttggacctgactctgacacttagtttagctctctgttttactcaaattttaagttaagtgttgggttatcactttgtggggctaggggctggtcttagaagttgtagaatcaggccaggagtggtggctcacgcctgtaatccccccactttgggaggctgaggcgggcggattacagggtcctgagattgagaccatcctggctaacatggtgaaaccccgtatctactaaaaatacaaaaaattagccaggcgtggtgggatgtgcctgtagtcccagctactcggaaggctgaggcaggagaatggcttgaatctgggaggcggaggttgcagtgagccaagatcgggtcactgcactacagcctgggcgacagagagagactccgcctcaaaaaaaaaaaaaagttgtagaatcactgtcttgtaggtcttaatttggtggagcaccttttgtctcactagtgccttccactgacaaacccacctgatactcaaggtgatccagcagcctggaacacttagtcagcctgcagaggctggcctccgactcagcggcacagaggaaggctgacagtggatctgagaggcccaaggaccacacaggcttttctcttttttttattgttttgagatgggagtttcgctcctgtggcccaggctggagtgcaatggtgtgatctcggctcactgcaacctccgccttctgggttaagcaattctcctgcctcagcttccctagtagctgggattacaggcgcctgccaccatgcccagataattttatgtatttttagtagagatggggtttcactattttggccgggctggtctcgaactcctgacctcaggcgatccacccacctcagcctcccaaagtgctgggattataggcgtgagccaccgtgcccggcccaacacacaggcttttcttctggaatcactcatggttaagcgctgtgttcagcaaacagaaaagtgattacaccctttctatatgcagaattgatactttttttaaaaagtacatttttaagaaagttaggccaagcatggtggctcatgcctgtaatcccagccaccactttgggaggtcaaggtggaaggaacacttgagcccaggagttcgagactagcctgggcaacatagtgagaccccatttttacaaaaaatagaattagctgggtgtggtggcacacacctgtagtcccagcaacttaggaggctgaagtgagaggattgcatggctccaggaagttgaaactgcagtgaactgtggtcacgctattacactccagcctgggtgacagactgaatccctgtctcaaaaaggaaaaggtaagaaaattaccttgggctcaggtagaagtcatgcttgcattttccatcaggaattacatcttttgagcagagttgagtagttgattttggaattgtgccatttgtatatgccacagcatttttgccaacacatatattttggccctaaaaatagacagtgaaaaagagatgggattgcttctctttcgattgttggcagacctattgggtaacatttaatcattttgggctggacacggtggctcctgcctgtactcgcagcactttgggagaccatggcaggcggatcacttgaggtcaggagtttgagagcagtgtggccaacatggcgaaaccctgtctctaccaaaaaaaaaaagattacaaaaattagccagacttggtggcttacacctgtaatcctagcactttgggaggctgaggtgggtggattgcctgaggtcaggagttcgagaccaacctggtgaacatggtgaaaccctgtctctactaaaaatacaaaaattagctggacgtgatgggcacctgtaatcccagctacttgagaggctaaggcaggagaatcattgcttggacccgggagacggaggttgcagtgagccaagattgcaccattgtactccagcctgggtgacaagaacaaaactccgtctcaaaaaaaaaaaaaattagctgggcattgctggtgcacacctgtagtcccagctactcgagaggctgaggcaagagaatcacttaaacctgggaggcagaggttgcagtgagctgagatcgcactactgcactccaacctgggccacagagtgagacttcatctcaacaacaacgaaaaaaatcagaattctaatgttttatttttccaagggaaaatttgcccgaaactggatactagaaaaactcctatggccggtttttgcagtgcaaaccaaaaacactattcctttttctttcttttggtattaaccttttaagatcacttttaagctgggcccagtggctcatccctgtaatcccagcactttgggaggctgaggcgggtggatcacccgaggtcaggagttcaagaccagcctggccaatatagtgaaaccccgtctctactaaaaatacaaaaaattagccaggcgtggtggtgggcgcctgtaatcccagctactcgggaggctgagacaggagaattgcttgaacccaggaggcagaggttgcagtgagccgagattgcaccattgcactccagcccaggcgacagtgtgagactccatctaaaaaaaaagaccattttttagtaaattatgaattatttacatatttttctttatacctcatgcttcagtaggacgattgatatctttgttcgtcaattttattgatgtataatttacatacaacatgtgtattttaatagatttttgaattttgactaatatgtacatctttataaccagcaccctgatcaagatttctgtaattatcaaaatatctcatataacccataaatatacatacctactgtgtacccacaaaaataaaaaaattaaaaaagatttctgtaactttgccccccttttgtagctacctcccacctatagccttaggcaaccatgaatttgctttctctgactacagatgatattattctttttggcaaacttttcctgtgaagggccagagggaatcatttcatgtaaactcttgtgtcaggcatctcttgctcagtataacgtatttcagattatcctcattgttgtgtatgttgtcagtagttcattttttttttttttttctttgagacgaagtttcgctcttgttgctcaggctggagtgcaatggcatgatcttggctcattgcaacccgggttcaagcgatttcccctgcctcagcctcctgaatagctgggattacagcctgtcaccacgcctggctaatttttgtatatttaggagagacggggtttcaccatgttgaccaggctggttttgaacttctgacctcaggtgatccacccgcctcagccttccaaagcgctgggattacaggcatgagccaccacccttgacccattctttttattatattagatttttcagataagtggaaggtttatccatctatcatttgatggacgtttgggttgtttctacatttttattgttatgaataatgctgcaaaaaacatgtgttttctgttttcttgagtatatatatacacctaggagtaaaattactgagtcatatggtaattctgtgtgtagcttttgaggaactgtcaagtttttgcccacagggctataccgttttacattcccaccagcaatgtacgagggttccagtttctccgcatctcaccaacacttgttataaccatgctagtggggtgtgaaaggactattgctttttgctaaagtatataaatgaaagatacagttcagtattgatagcatattgccacagaattggtggggaaatcagtggatttcaatatcggtttatatgttctaggaggatggactcagacaagttctggaggagatgaaagctttgtatgaacaaaaccagtctgatgtgtaagtttcataagatgatattctaaaacaattcaataattaagatgttgaaattggccgggcgcggtggctcacgcctgtaatcccagcactttgggaggctgaggcgggcggattacgaggtcaggagtttgagatcagcttggccaacatggtgaaaccttgtctctactaaaaatacaaaaattaaccgggtgtggtagtgggtgcctgtaatcccagctactcaggaggctgaggcaggagaactgtttgtacccgggaggtggaggttgcagtgagctgagattgcaccacttcactccagcctggcgatagggcaagactctgtctccaaaaaaaaaaaaaaaaaaaaaaagatgttgaaatcagataaccttgcattagttttgggatgcgatttttaaaaattatctgtaaaattatctgctctagctgtacaaattagcaaaagtctgaagaaatttgtgctgatcactgcttaataaatatctgttgtttggctgataagagttgaaaggaattagagtggacctaaaataaatgacataccctaaaataaaaaataaaaataggctggacacggtggctcatggctataaatccctgtgctttgggaggccaaggcaaaaggatcagttgaggccaggagcctggacatatagcaggactctgtctctattaaaaaaataaaaattagctgggtgtggtggcacacacctggagtcttagctactcagcagggtaaggtgagaggcttgcttgagtgcaggggtttgaggctgcagtgagctatgatcacgttactgcaccctagcctgggtgacagaaggagatctccatctttaaaaataataaataaaaataaaaacctaacaaagtgaaatacatggttcccactgtttatatttttatcaacagttgccttagtgagtttgttaaaggaagaataggcagtttattaaatggatataaataggagcagcagtgatttctgatagtttgagtggagttctctgagaactagctataaaaggtttcagtgtagtaggtccagagaggtgactagatttattgactctttagaactgagcatggtagctggcacagtggagaatttgggcgtatgacaaacttcgtatgttcctgtgcgacaccaaagggagtcaagtactggatcaaagttgaagtattcagggtctcaactgtctgtgacatgaggtttcctctttgggcttgttcgctacagtgtttttatcagttacttgaatatagaaatcagtgttatggctggtaagatttgtgaggcacataaaatgataggagcatttccaactcctgtgtataaggagagatacagaaaaatctttacaggtggactgaggaagtgaacctcaacagatttgcagtaaatataaggcagatttaaagtcctgaactcaagtccctaagccattcattgatttactcaaatatgtactaaacaaatatgtatcaataagtggctgtgctatttcagtggtaaacaacagtcaagatggctttcccgggctgggcacagtgtggcccatgcctgtagtcccagcactttgggaggccgaggcgggtggatcatctgaggtcaggagctcgagaccagcctgaccaacatggtgaaaccctgtctacgaaaaatacaaaattagccatgcgtggtggcgcatgcctgtaatcccagctactccggaggttgaggcaggagaatcgcttgaacctgggaggcggaggttgtggtgagtcgagatcgcgtcattgcactccagcttgggcaacaatagcgaaactccatctcaaaaaaaaaaaaaaaaaaaagatgcctgtccctggcgctcactgtctagtgcagaagacagacatgaaatatagatatgccaaattgggattcatgctatgaaggaaatcagaagagtgcaaggagaaagaaaaatgaatagaaggtctagcttaaattgaggaatcagggaacttctctccaaagaggagacatttcagctgaggcctgcaggagatgcaagtcttagggaggcagtgactgtgggcatagaacattctaggtggagggaacagcatatgcaaaagcccctgaatcatggaagagaatggggcactcaagaaactgacacttaaagaagacctatgtggctggagtttggcaagtggcaaaggatgacaccagatgaggtgtaagtgtggacaggtggtggtgtgtttgtgtcttaaaagataatgctggttgctgtgtggaggggctgagaggtgggggaagctggtcaccaggttactagagaggtgacccagacttggtagaaagtgagaaggttataaatgttttggaggagaccctataggccttggttcagtaagggaatgattttcttgtattctctgtgtttatgccattcgcaaattcatgatccaaaattctttattccaccttcctagtttcatcagactttcatagggtggcagaagtatatagaacagccctagaagacatgacaggatgggacatgtattttgcctgtattatcagggcctagcacagtgcctggcatagaggcaggcactacatgaatgaattctttttatatgcatatggttgcttaaaaactccaaagtagattcttattcattcaaaagttacatgtactttttatagggtaaaaccaaaattttcagtgtgagaaatactgaagtatagtacgtacacgtatttggagatcaacagatatttgtaagatgagtgaaagaccattttgactccattttacctcactttgttataatgaggatttggaagctccactggaagggaggtactatgtagaatagcgacatgacgtaagaccataacctcatgtccatcatgttagctttgtctcttatctcagcgtgataatggaatcctgaaaagtgaataacacagtgtcttttagaaagaatagagattaatcagtgtgcaaaaatgcaaagtaccaaatgcctaaacaaaatgtatctggtagcatgatcttaggcaagttgtttaggttttggctttttaacatattaataaaagctctgatgtacaaatagttattatttgcttaggttaactgctaatcacaaatggattaaaaacaagcatgtaactcagttgttagttggctttgaaaattttacttatcctgaaaagtacatattttttttctttttaaatgctcctatcaggaatgaagcaaagtcaggtggacgaagtgatttgataccaactatcaaatttcgacactgttctctgttaagaaatcgacgctgcactgtagcatacctgtaagcttctcagtttttgcttggggtggcaggattttctgtgtggcttcccagttgaccatctcaaatgggtaacatgaaatcttagatctctctctctttgtaagcattctaaatttttcctctgtgttttcatttttttaattttttattatgaaaaatcacaacacttttaaaagtagggagaataatactataatgaaccccagtggagctatcatatggttttaacaatttttattattttgccatatttttttcatcgtgtttcacttgttggtgccacactatttaagtgcatcacggtctttcactactgaatacggtagtgttcttactattttttctttgtcttagaaataaggacctttggccaggcacagtggctcatgcctataatcccagcaattttggaggccaaggcgggtggatcatctgggatcaggagttcgagaccagcctggccaacatggtgaaaccctgtctctactaaaaatacaaaaattagctgggagtggtagcgggtgcctaatctcagctacttgggaggctgaggcaggagaattgcttgaatctgggagccagaggttgtagtgaacggagatcgtgccattgcactccaggctgggtgacaagagcaaaactctgtctcaaacaaaaaaaggcgggggaaagaaagaaataaggaccttagggacctttttcccaggactactgtgctgctgtcacacgtggaggagtggacagtgccttcaggtcgactctcagactgtgttcatgttcttcttgttttccctaagatgtctgtttagagctggtgtgtttgcatcaggggccaaatgaagtccacacgtgatcccccgtttattcttatgccacccaataccttcttgatgtcctaggtatgaccgcttgcttcggatcagagcactcagatgggaatatggtagcgtcttgccaaatgcattacgatttcacatggctgctgaagaagtgagttagcattgttcaagtttataaattttgaaaatgctaaagttctggcattgttctataatagtgtttattggtattcctctttttgtgtttaatgtctgtttttccccaatttttggctggtatttagtatataatgtgaggggaactatgtggtgaggagtaattctaaatcatatgtggaaaattctattattacttaacaaaatagagtcccatgatgttacttattagtgatccatcagtgggattaaaaaactggcattattatttggtgatattccatgaaatgtttacatgtgtatatatactttcctaatcaaaattcatatttgcctagtcactgaggcaaagaactagcccattatttaaggacataggattggagtcaggtgggcttaggttcaaatctctgctgtctaatattgagcaagtcacttgacctgttgctgtgcctaaatttccttgttacaggatgaagatcatattacctatctattacaggttgcaatgacttttgacactaactacctgcagttattgtcaactaaggaagctcacacaagctttgatgtccagagtgtttattggggcttcattacatagacatgactgattaaattgctggccctgtgattgagttcaatcttcatccctcttcccctccctggaggtcagactgacatcaggagggccaaaggcccaatactttaatcacatggttggtctttctggggtagccagtcccaactctgagtcatcttgttagcacagactatgtaggggttcaccacgagtcacctgagtagcacatactctcagggcacatcataaataacaagacactcctattacttgagaaagtacaagaatttagaagctacctcccaggaatgagggagagaggcccaccaaattctttattctacaacagtgttattacaaggcctatcacagggttacttcaggtggtccatgtggagcacagcataggatggcactcaataaatgttaacagttactacattacagttgcatagcacagagcttaagaaagaaaatattcagtgcagcaaaccaccatggcacatgtatacctatgtaacaaacctgcacgttcagcacatgtatcccagaacttaaagaaaaaaaaaaaacaaatattcaatgtgtttgccattagattctgcacatttttgaaagtgatctatttgttgtcatagcttcattttcattctgttcattttctgcataaataaatgagtaatctctacctcagatttaccagtgactacgaaattggtaacatgttagtacctcactttatgctctttgtgttcaaatctacttatattaattgaactttggggtacttactgtgtattatggtgagatgaacagaacattatgtttctctaacgacagtagctttaatgatttttctcatacaatattttagattaatttttttgtgtattttttgagatggaatctcgctctgttgcccaggctggagtacagtggtgcattctctgctcactgcaacttccgcctcctggcttcaagcaattctcctgcctcagcctgccaagtagctgtgattacaggtgcgtgcctccatgcctggctaatttttgtattttagtagagacagggtttcactatgttggctaggctggtctcgaactcctgaccttgtgatctgcccctcttggcctcccaaagtgctgggattccaggtgtgagccacagcgcctggcgattaatatgtttcttacaatttagtaaatgattacaagctgcatttattcaagcacatcaattagatttcatattgggcattgtttctgtaagggtggcacttttctgtgattactgagttcccaaagtcagtttctattttaatgaaatataacaatgttaacagcaaataaaatatatatatatttttttgagatggagtctcgctctgttgctccagctggagtgcagtggcacgatcttggctcactgaaacctctgcctcccgggttcaagcgattctcctgcctcagcatcccgagtaactgggattacaggtgcccaccactacacccagctaatttttgtatttttagtagagacggggtttcactgtattggccaggctggtcctgagctcctgacctgatgatctgcccacctcagcctcccaaagtgctgggattacaagtgtgagccacagtgcctggccttatataaaataatattaatgggtctagagattaagttgtttgagaatagtgaaacctgagatagtttcttggaagagtttgtgaattactgcaaaactggcaaatgacttccttctaccccagtgacctcatctataaaaaggaatataccagcctggccaacatggtgaaaccctgtttctactaaaaatacaaagattagctgggtgtggtggtgtgcacctgtaatcccagctggtcagggaggctgagggcaggacaattgcttgagcctgggaggtggaggttgcgatgagctgagatcgcaccactgcactctggtctgggagagagagtgagaccctgtctcaaaaaaaaaaaaaaagaaaaaaagaaaaagaataaaaggaatatacatggtctcgttctcttagtagtgatgttttggaaacactgaaggatgagaagagattaatacagataaactctgtagtagaccacagacatctctgcttgagcaattgcatcgtggcaactgcatcagccattttggaccagtaacaaagaatatttccaggtatccctgacagcttataggagcctatgaggtctgaatgtcatcataggtatctgtattacccaaggatagtgcttcaatgggtgactgaagcacatgggcttgagtctgccacctaaattcagatccctgccttgttaactctgagccctttggtaaattatctaatctctcaaagcttcagtccttcatgaataaaaagaaaataataatagtagttacatcatggggcaatgaaaaagagaaaataatgcatattaaaattttagcaaattcctggtatatagtaagcactttattactgggagtgatgatttcaatattgttgactcaggctagcaataaaagtaaaagcagagctaaaataaggttactaacatgaaacagatgatcatgtgttaatgtttagagaaaacaccattgaaagaatatgaaagcacactgatgataagtaaaaatcttattatctgatttcaaagtagtaacatcttttgttttcaaagtagtaacatcctttatgtttttaaaataataacatcttttgttttcaaagtagtaacatcttttatgtttttaaaatagtaacatcttttgttttttgatttcctaagtttctgtttagaatctttaagccactaacatgagagatagtgaaaataggtatttttttctttcctattaatatttttccataaggaaaactaaaaaatttgtgactatatcagtatgttcttttgtggaagtaacgtgcttattctacatttcccttttatctgtgaatgagactgaatgagggtaacaccctcattgtcaaaacagcttctgatttttcttccacttcatcttctctttggggtctgttacactcttctcagtggagacaaagtagaaaagaccacagtggaaacacccatgtttgactcatttggcaagatctctctcagagaacttttcttcatacttatcaatacaaaatatcattttttatcctttatattataaaaaacaatgcagtttttaccaccttggcatacataccttttaaatcttttaaaatcacttaatttaaccatttgcattgtgaaatctaacataaaaacaggcacatgcaaacacatctgaaaaggtgcagaaaacgaagatgtacagcccaatgatgtgtcactgaggaattcccatgtatccatcaccctgttcaagaaagaacattgctccggaacctttgtgtccctcctcccagtgatcactaccctcctgacttttgtgcagactaatcacttccttatttttaaaaatcttattgctctggatgcagtggctcacacccgcaaccccagcactttgagaggccaaggtggatggattgcctgagctcacgagtttgagaccagcctgagcaacagggtgaaaccctatctctaccaaaaaaagaaaaaaaaaaacaaaaaaaaacttagctaagtgtggtggcatgcgcctgtggtcccagctactcagaaggctgaggtgggaggatcacttgagctttggaggtagaggttgtagtaagctgagattgcgccactgcactccagcctgggtgacagtgagaccctgtcttaaaacagcaacaaaaaaacttgccatttaccacctaagcatgcatttctaaacactataatttagtgttgcccattttttgaactttatatagattcatgcagtatcctttaatgattgatgactttcactaaatgtaatatttttgagattctaatctgttgatatattagcaagagctcattccttgttttttattttgtttagacggagttttttgctcttgttgcccaggctggagtgctgtggcgtgatcttggctgaccgcaacccccgcctcccgggttcaagcgattctcttgcctcagcctcccagctatctgggattacaggcatgcaccaccacgcctggctaattttttgtatttttagcagagatgggtttctccatgttggtcaggctggtcttgaactcccgacctcaggtggtccacctgccccagcctcccaaagtgctgggattacaggtgtgagccaccacacctggccgagcttattcctttttaatgctgaatagtatttctggttttttttttgttttttttgagagacagtttgactctgtcgcacaggctggagtgcagtggcatagctcggctcactgcaacctccgcctccctggttcaagcaatcctcctgcttcagcctctggagtagctgggactacaggtgtgtgccaccatgcccggctaatttttgtattattagtggaggtggggtttcaccatgttcaccaggctggtcttgaactcctggcctcaagagatatgcccaccttggtctcccaaagctgggattacaggagtgagccaccgtgcctggcctacccagaggttattaaggttattaagatatttttcttttcttttttttttttttttttttttttttttttttttgagacggcatctcactctgtcgcccaggctggagtgcagtggctcaatcttggctcactgcaagctccacctcccgggttcaagccattctcctacctcagcctcccaagatatttttcttctctctttttttttttttttttccgagacggagtctctctgttgcccccaggctggagtgcagtggcatgatctcagctcactgcaagctctacctcccgggttcatgccattcttcttcctcagcctcccgagtagctgggactactggcgcccgccaccacgcctggctaatttttttgtatttttagtagagacggggtttcaccatgttagccaggatggtctcaatctcctgacctcatgatccacccgcctcggcctctcaaagttctgggattacaggcgtgagccaccgtgcccggccttttttctatgtaatcttttaggagctatattttaccttttacaaagagatctacagtattgggattaagttttgtgtatactacaggaggcatgcttcattttgaatatagatattgagatgacccagcaccatgtattgaacagatctgcctctcccatcactgtgtgcatggtgccacctttgtcatacattgagtgtcagtattcctgtggattctgaatgggaggactttttcttctgttatgctagtctatctgttcttataccaattccactgttgtaattactgtaactatatagtatagttggagcaagttcccatcttgttcttttttgagagcatttcaactattagccctttgcacttccatgtaaattttagactcagtttgtcaggttccattttaaagaaagttaagattttgattgagattgaattgaatctatagattgttgacgttattacaatattgaatcatccaatctgtgaatatggtattatttaggtctttcattgttttcaactttttttttaaaatagcagatttactgagatatgattcatacactgtgaagtttaccatcttaaattgtacagtgcagtggtttttagtatattcagagttgttgtgcatccaataccacattcttatttgagaatattttcatcaccctacaaagaagccctgtcccctttatagttactctatattttcttccctcctcccagctcctggaaatcccgaatctactttctgtctctatagatttacctattacaggtttttcatatgagtagaatcatgcaatatgtggccttctgtctttcatgtggtaatggcaatacgtttcagaacttcattgttacttatggttaaataatgttccatcatatgggcacatatccattcatcagctggtggacatttgggttttcttaacaatgttttatagttttcagaaatagcatcaatgcagagtttgaagatataattctgaaatggcgtctttttcatggttctgtttctggtcaaagattcctaaggtttattattaagtatgctgaaatgtaagctctctgagaacagagatttttgttcactttattgaatgattcattgtaagtacccagaccaatgcctatatcataggaggcaattaatattttagcattaatgaatgaatggtcacaacagtgatttgtgttgggatgtgtactgttttcgaatggatgatattcagtgtgtgcaagttttcttagaattttgtcaaatgatcatctctatgtttgcagatggagtggtttaataattataaaagatctcttgctacttatatgaggtcactgggaggagatgaaggtttggacattacacaggatatgaaaccaccaaaaagcctatatattgaagtatgtatatctttttaaaatgcatttttctttaatgtgtaaattgtgctaccttttaagaagagaggagtatatgaatatgtgttagcttctattaaaatagaaaagaagcatagaccaaatcaaacaagctacctgtagggggatgacagaatacgatggaacagctataattttctgaatatacctgttttaatagttttgagtatggaaccctataaatgttttagctattactaaaacaaagttaaatcaaaatggaaaatcagtccctaaattttgaaagtaaaatgaaacaaatgtcaaaacaaagttaaatcaaaatggaaaatcagtccctaaattttgaaagtaaaatgaaacaaatgtcaaaacaaagttaaatcaaaatggaaaatcaatgctaaattttgaaagtaaaaaaagcaaatgtctttcaagttggtggattagtcaaaacaagaggtatttttgtttcattttgtttattttttctattttttaaataataaaatacatataaaatctaccatcttagctatttttaaatgtacatttaagtggtattaaatattgtttaacattccatattgttttgcaactttcatattgttttgcagctgtcaccaccattccatatccagatttttttcatcttataaaactgaaactctacccattaaacaataacttctcaatacccctgcctcccatcccccagcaaccaccattctactgtctgtctctgattttgactactgtaactacctcatgtgagtggaatcatatagtatttgtctttttgttttcttttgttctcgttagagaataatttctgagaagctacaaatgacaagttatttgtctttttgtgactggcttatttcacttagcgtaatatcttcagggttcatttctgtggtatctgtggtaagaatttgtgtcagaatttccggctgggcacggtggctcatgcttgtaatcctagcgctttgggaggctgaggaaggaggatcacctgaggtcgggagttcaagactagcctgaccaacatggagaaaccccgtctctactaaaaatacaaaattagccgggcacatgcctgtaatcccagctacttgggaggctgaggcaggataatcgctagaaccggggagaaggaggttgcggtgagctgagattgcaccattgcacaattttttttttcttttttttgagatggagtttcactcttgttgcccaggctggagtctagtggtgcgatcttggctcaccgcaacctccgcctcctgggttcaagtgattctctggcctcagcctcccaaacagctgggattacaggcatgtgccaccacccctggctaattttgtatctttagtagagactgggtttctccatgttggtcaggctggtctcgaactcccgagctcaggtgatcctccctcctcggcctcccaaagtgctgcgattacaggtgtgagccactgcgcctggcccagaatttccttcctttttaaggatgagtaatattcctttttctggctataccacattttgcttatccatttatccatctatggacactgggttgcttctttattttagctatcattttatgatcaatgctgctatgaacgtggatatataaatctctttgagactctgcttttaattttggggggcatatatccagagtggaattactagatcatatggtaatactatgtttgaggaattgtcatactgctttccacagcagccataccattttacattccaacattacgcaagggttccattttctccacatcctcaccaacactaaatattttggggttattttgtttcgtttttgagacagagttttgctcttgtcacccaggctggatgcagtggcgcgatctcggctcaacctgcaacctccacctcccaggttcacctcaactgcaacctccacctcccaggttcaagtgattctcctgcctcagcctcccaagtagctgggattacaggtgcccaccaccacacctggctaatttttgtatttttagtagagacacggtttcaccattttggccaggctggtcttgaactcctgacctcaggtgatcctcccgcctcagcctcccaaaggcatgagtcaccatgcctggccttgttctgttttttaatcatagccatcctaaaggatgtaaaacgtggttttgacttttatttccctaatgattagtgatgttgagcatcttttcatatgcttattagctattcctgtgtcttctttggagaaatgtttattcaaataattggccccctttatggggcccattttcaaatagggttttgttgttgtggagatttagaaatcctttatgtattcagtatgttaatttgttatcagatatatgatttgcaaatattttctcccattctctgggttgcctttttatgctgttgatagtgtctttttttttcttttttttctgttttcttccttcagtatcatgttgatattttaaaattttcatgcagcccagttcgtcatttttttttttttttttttgagatggaattttgctcttgttgcccaggctagaatgcagtggtgtgatctcggctcactgcaacccctgcttcctgggttcaagcgattctcctgcctcagcctcctgagtagctgggattacaggcatgcaccaccacacccagctaattttttgtattgttagcagagatagggtttcatcatgttggccaggctggtcttgaaatcctgacttcaggtgatccacccaccttggcctcccaaagtgcagggattacaggcgtgagccatcgcacccggccaattttttttgttttgttggttgtgccttaggagtcatatcccagaaatcattgctaaatacaatgtcataaaacttttgacctgtatttccttctaagtattatgttgttttacatttgcatttcggtctttgatccatttcaagttaatttttgtatggtgttaggtgatggtccaactttatttttttgcatgtggaaatctagctttccaagcataatttcttttttttttttttttttttttttgagacagagtctctgtctgtcgcccaggctggagtgcagtggcacaatctcggctcactgcaagctctgcctcctgggttcacgccattctcctgcctcagcctcccgagtagctgggaccacaggtgcccaccacgacgcccagctaattttttgtattttttagtagagacggggtttcaccgtgttagccaggatggtctggatctcctaaccttgtgatccgcccacctcggcctcccaaagtgctgggattacaggtgtgagccaccgcacccggcctccaagcataatttcttaataagactgccctttccccattgtgaatggttttgacactcttgtcaaaaatcatttgactatgtaggcaagggtttattttttatctctttatcctattccattgttctgtacatctgtcgtaaaaaaagtttttttaatatatatatacatctgtctttatgccagaactgtagtatttcgattgttgtagctttgcagtaagtttaaattagggattttgggtcctccaccttcattcctctctctttttttttttttttttttttttttttttttttttttgaaacgaagtcttgctctgtcgcccaggctggagtacagtggtgcactcttggctcactgcaacctccacctcctgggttcaagtgattctcctttctcagcctcccaagtagctgagactaaaggcgcctaccaccatgcccggctaattttttatagttttagtagagatggggtttcaccatgttggctaggctggtctcgaactcctgacctcaggtgatccgcccacctcagcctcccagagtgccggattacaggcatgagccaccacgcccggccccattcctctttttaaaggttgttttcactatttgagattttatatggattgtgggatgggtttttctgtttctccaaaagacacttttgggattatagtagggattgtgtaggtcacttagggtgcattgacatcttaatattaaatcttccaatccatgaacatgggatgtgtttccaattgttgatgtcatctttaattttcttcagcagtgttttttagttttcattgttcaaatctttctcctctttcgttaatttaatttctatatattttattcttttcgcactgataaactgaattattttcataatttttattttcagattgttcgttgttagtgtatagaaatgcaactgatttttgtgtgttgactttgcatcctgttactgtgctgaattcatttattagttctaaaagttttttgtggaatcattaaaattttctacatgtaagatcatatcatctgcaaacagataattttagtttttcctttttaatttagaatcctatttctttttcttgtctaattactctgactgtaactccagttttatgttgaatagaagtggcaaaagcagaaatcttttgccttcttagtgaacttagaggaaaagctttcagtctttctttttctttttgagacagagtcttgctctgttgcccaggttggagtgcagtggcacaatctcagctcacttcaacgtccgcctcctaggttcaagcgattctcctgccacagcctcctaagtagctaggactacaggcacatgccatcacgcccagctaatttttgtatttttattagagacagggttttaccatagaggccaggctggttttgaactcctgacctcatcatccacccgccttggcctcccaaagtgctgggattataggcgtgagccaccgtgcctggccagctttcagtctttcaccattgaatatgatgtttgctgtagagtttccatatatggcttttattatgttgatgtatagttatcttctgttcctagtttgttgagtatttttatgaaaggaagttgaattttgtcaaacgctttttctgtatcaattgaaatgatcatgtttttttcccttcgttctgttaatgacttatattgattgattttcatatcttgaactgtccttgcattccaaaaataaatctcaattgatttatgatgaactcttttactatgctgctgaatttgatttgatactattgtggtgataatttttttaatttttatttttcaagacggagttttggtctggttgcccaggctggagtgcaatggcacgatcttgactcaccgcaacctctgcctcctgggttcaagcgattctcctgcctcagcctcccaagtagctgcgattacaggcatgtgccaccacacccggctaattttgtgtttttagtagagatggggtttctccatgttggtcaggctggtctcgaactcccgacctcaggtgatcctcccgccttggcctcccaaagtgctgggattacaggcgtgagccaccatgcctggcctgtgttgagaatttttgcatcagtgttcataagggacattggtctatagttttcttggagtatcttttctggctttggtattagggtaatgctggcctcataaaatgagttagggaggtgttccctccttttatattttttagaaaagtttgagaaggattggtgttcttgaaatgtttgatagagttacccagtgaagccatcagctctagggttttctttattgagagatttttgattagtgattgagtccccttactagctataggtctattccaatttactagttcttaatcattcagtctttgtaggtttgtgtttctgggaatttgtccatttcatctaggttttccaatttgttggtgtacaattgttcataggactcttagaactctttttatttctgtaggattggtagtaatgtcctcactttcatttttgattttagtaatttgagccttcttttattcttagtctgtctagctaaaggtttgtaaattttgttgaccttttaaaataaccaaattttagttttattggttttctctatgagtgtttctgttcttcattttattaatgtctgctctaatcattatttcctccttctagctttaggtttagcttgcttttctttttctggttccttaagatgtaaagttaggtggttggcttgaaatttgtcttctttcgtttttgtttttgtttcttttttctttttctttttctttttccttttttcttttttctttttttttttttgagacaggatctcactctgttacccaggctgtagtgcagtgtcacaatctcagctcacttcatcctccgcctccagggttcaagtgattcccatgcctcagcctcccgagtagctgggactgtaggggtgcgccaccacgcccggctaatttttgtattttttgctagagacaggattttactgtattgtccaggctggtcttgaactccttacctcaagtgatccacccaccttggcctcacaaagtactgggattacaggtgtgagccaccatgcctggccttgtttttgtttttgagacagagtctcactgtattttccaggctggagtgcagtggtgcgatctcggcttactgcaacctccatttcccgggttcaagtgatccttccaccacagcctcccaagtagagtacctgggactacaggcatgtgcctccatgcccagctaatttttgtatttttagtagagacggggtttcaccatgttggccaggctggtcttgaactcctgacctcaaatgatctgctgcctcagcctcccaaagtgctggaattgcaggcgtgagccaccgcgcctggccatgaaatctgtcttattttttaatgtaggtgtttatgtttgtaactataaatttctcagtactgcttttgctgcattccatacattttgatgtgttatgtttttgttttttcacctttaagtattttcaaaatttcctttctttcttttttttttttgagacggagtctcactctgttgcccaggcagtggcacaatctcggctcactgcaacctccgcctcccgagttcaaatgattctcctaccttagcctcccaagtggctgggattataggagtgcaccaccacgcccggctaattttcttcttttttttagacagagtcttgctctgttgtccaggatggagtgcagtggtgcgatcttggctcactacaacctccatctcccgagttcaagcgattctcctgcctcagcctcccgagtagctgggattacaggcacgtgccaccatgcctggctaatttttgtatttttagtagagatgggatttcgccatgttggccaggctggtctggaattcctgacctcaggtgatctgcccacctcggcctcccaaagtgctgggattacaggcgtgagccaccacaactggcagatgaattgttattagatgtgtctatacttgttatatcttcttgtatgtattatatatttatcatatattatgttatatagtatatgtttattatatattaacttatataataacattatatattaatatatattctataatatataatagtcttttttgtctctggtaagctttttaaatttaaagtccattatagctaatattagtacagccaccctggttctcttttggcaggtattcgcatagaatatcttcttctaccctttcactttcaatctattaatgtttgtgtctttgggtctatagtgagtctcttgtagacaacatgtgattggatcgttttgtttaatccattctgctaatctctgtcttttgcttaaagagtttaatccatcccctttaacataattactgataaggaaggacttctgtcattttgctgtttttctatatgccttataactttttttttcttgcaatggactggggaataataacttttttgtctctcatttccttcattattgccttcttcagtatttagttgattttttgaaacatttagatttctttctcatttcctcattaccccccacagataccaagatccatggatgctcaagtcccttatataaagtagtatggtatttgaatagtacctaggtacatgctgttatatactttaaataatctctagattacttacaataccttatacaatataaatgccatagatatagttgttataccatatcatttttagggaataacaataaggaaaaaaagtctgtacatgttcagtacagacacaaccatccatttgtttaaaaaaatttttgatttgcagatacggaacctacagagacagaggaccaactatattctatagctgttttccttgtggttagtgatagctagtacatttaatatcttaaaattataacactttaatttcaacttacagcagcttgacttcagtaacataccaaaattctgatccctcaaatcaaaagctccatccttatttctattgttgatgtcacaaaactacatctttatatgttgtgagccccaaaacataaactaataaatcttttaaatgcattagtttcttaaattgtgtagaaaacaaaatttagggttgcaaagttacaataatactagcttttagactaatcaatgtttttttaaatgtgttagtcactgaaatcatgttaaaaacaaaaaataggggctgggggtggtggctcttatgcctgtaatcctagcactttgggagtccgaggtgggtggattgcgtgagctcagaaatttgagaccagcctgggcaacatggcaaaaccccatctctactaaaaataaaaaaaattaactggtgtggtggcacgagcttgtagtttcagctactcaggaggctgaggcaggagaatcacttgaaccaggaggtggggattgcagtgaactgagatcgcaccattgcactccagcctgggcgacagaatgagtctccacacctccccgctgcccagaaaaaaaaaacccaacaaaaaatagagttataaaatgttacaatattgctaggttttagaattttccatgtattcactgtcttagtccatttgagcagctaaaacaaaatacctgagactaggtaatttctaacgaacagtaattttttttcttttttttttaaagagacaaggtcttgctctgtttgtcatccaggctggggtgtggtggtacaatcatagttcactacagccttgaacgcctgggctcaatcaatctcctgcctcggcctcctaagtagctatgactacgggcatgcactactgtgcctggctaatgtttacattttttgtagagatgtgaccttgctatgttgccaagggtagtcttgaactcctagcctcaagcagtgctcctgcctcagcctctcagtgttgggattataggcttgagccactgtgcccagccagcctgtctcaattaattctggaggcctggatgtccaagatcaaagtgccagcagattcatttgtcttctgtgggctacactctgcttccaatgtggcgccttgaatgctgcatcctctggagggatgaaatgcagtgtccttgcatagcagaaggtggaaggacaaaaaggaccaaactccttccatcaagtcattttataatggcataaatccatttatgaaggcagagcccttatgccctgaccacctcaccaaagtcctcacctcccaacactgttgaattgaggattaaatttctaccacattgatttttggggatgcattcagacatagcatttacctatattgagatctttatttcttcacatgggttcaagttactatcttgtgatagttaccatatataggattcttggttggtgatgttgttcttttagtactttgaatatattggcccactgccttctagcctccaaagtttgtaataagaaatttggtgaaaatcttattgaggatcccaggtatgtgatgacttacttatcttttgctgctttctttttgaattttttagagacagggtctcactgtgtcaagcaggataaaccgcagtggcacaatcatagctcactgtaatctcaaactcctgggctgaagcaatccacctcagcctcccaagtggctaggactagtggcgcatacctccaagcctggctaatttttaaagtttttggggccaggtgtggtggctcacgcctgtaatcccagcacttttggaggccgaggcaggcagatcacaaggtcaggagtttgagaccagcctgagcaaaacgatgaaaccccatctctactaaaaatacaaaaattagccgggtgtggtggtgcacgcctgtaatcctagctactcggaaggctgagggaggagaattgcgaattgcttgaacctgggaggcagaggttgcagtgagccgagatcacaccactgcactccagcacgggcaacagagtgagattccgtctcaaaaaaaaaaaaaaaaaaaaaaaaccaactttttgtagagttacacttttttttttttttttttttgagacggagtctcacactgtcacccaggctggagtgcagtggcgcaatctcagctcactgcatcctccacctcccgggttcatgccattctcctgcctcagcctctcaagtagctgggattacaggcacctgccaccatgcccagctaattttttttttttttttgtatttttagtagagacggggtttcaccatgttagccaggatggtctcgatctcctgaccttgtgatctcaccttggcctcccaaagtcctgggattacaggcgtgagccactgtgcccggccgaattaaactttttctagataacagggtctccctatgttgcctaggctggtctcaacctcttggcttcaagtgatgctcccaccttggcctcccaaaatgctgagattataggtgtgagccaccctgcccagccctctcttgctgctttcaagattctttgtcttttgaaagtttgattataatgtgtctcattgcgagtctgagatcatcttgtagtttgttgagcttctttgatgtttatatttatgtcttttatcaaatttaaggagttttcagttactatttcttcaaaaattctctctgcccctttgtctttctcttcttggtttgcttgatggtgcccttcaggtctctcaggctctgtccttttcttcggtctttttttatttttgttcttcagacttagtcatttctgttatcctgtctttaggtttgcttgttcttctgcctgctccaatctgtctttgaatccctcaagtgaatttttcatttcggtttttatagttctcagctccggaatatctttttggtctttttaggttttctatttctctactatttccattttgttcatacattgtttccataactttctccccatcttcctgtagttcttagagcatctttaaaactcttgttgtaaagtctttgtgtaatagatctaccatcaagtctttttcagggaccatttcttatttttctttttcctttgaatggaccatacttttatgtttctttgtatgtcttgtgatttgattgtttttgctgaaaaccagacatttcagtctaataatgttataactctataaatcagattctcccctttcccccagggtttgctggttttgttactgtttttgtttttttggttgttgtaagctgtcgctgtgcttagaatcaacctgaggtataaccttaaggttttctcaaatctttattgaacctgtgcctttccttggtcactttctaatttttcctgtatacacagttgcttttcactgccctagtctttaatgtctggctcctgaaagggggaaaaaagaaaaatgaatagaggtgggaaaacggtgctagccctttaaatcccctggaattcacttcagtggaatgcgggaggggcttgcagcctttgagaaggtgtgacaaaaatgtctgccagcctcatcatttgcacctctgtgatcagaaacagcaatcagcagtgaggagcagggtgctttttgcacactctgcaccagcaacctgtgtacaagctactccaagaacacatgcactgtggcctgccacaaagctaggaacaggggatggttagctgctgctatgctaagaggcaaaatggacagtaaattgcagtgaatgtttgtcaaagctccaacctcaagccttcagtagactccagagttccaaaatactgacgtcagacagagtctgcccgtgcagttgttgtggaggtaggcagacagattcctgatgtttcctactccaccattttacctgaatccaggagttatttacattactttaaaacacataaattgtatattcctggtatatatgttctgaggacaaaagaattacaaagagttcttaacctgtttttactaatcatattattagtaataattttgttactgttattttgaaacagttttcatattgaagaatagagcaaaagggtaattgacattaccaacagttttcagaataagagaaaaggggccgggcacagtggcttacgcttgtaatcccagcactttgggaggccgaggcgggtggatcacctgaggtcaggagtttgagaccagcctggccaacatggtgaaaccccatctctactaaaaatacaaaatttagccaggcgtggtggcgggcacccgtaatcccatctactcaggaatttgaggcgggagaatcgcttgaacccatgagaaggaggttgcagtgagctgagattgtggcattgcactccagcctgggcaacaagagcaaaactccgtctcaaaaaaaaaaaaaaaaaagtattgattagctctgcctaccgaaaaggcctagaaacaatgaccaagccaattagccatgagtgtccagagtctatacctaaatgccatttcccactaaagtaaaccaggactccttgcacaaaaatagctgattccaggttctgaattaaaaatgtacgaactgagcatgaaacatcttgtcttcccagaaaggaaggaaggtgtcaaggactaagcggggactactggaaggatatgggggccaatttgaaggagctcttgctaaccaaaaaatggacaattttagcatcaacatgactaataactgcggtgaattggatcacatcaattacgttagaagtatgaatgcataatgacaccaaagaacaacacttttttttttttttttttttttttttgaggcagtatctgggtctgttgttcaggctggagtacagtggtacaatctcggctcatttgttatttaggacctggaatcagctattttagtgcaaggagtcctggtttactaaaacctccacctcccaggctcaagccatcctcccacctcagcttccacagtagctgtaactacaggtgctcacaaccacacccagctaatttttgtattttttgtaccgatggtatttcaccatgttgcccaggctcgtcttgaactcctaagctcaagcaatcctcttgcctctccctcccaaagtgctgggaatacgggcatgagccactgtgcctggccaacaaaaattttaaaaaataaaacatttttgaggtttccttggagaatgtgagggatccaactcatttgaaaagtggcaagttagagaatggaataaaagcatccattgtctttactatacaaactctatcttaaggtagcccaatagtttacaaaggaaatttgtttttatagaagaattccagctaacaaatgtagcaggaatataagaattagattaatgcttgtaaccctttatttactaaaacctttcagtagataatggagatctttataatgcatgagtatggatgacacttgggcccactgattaatctcaacatccaaaaagagacagccaggcactttgtgttttatggggtcttgtaacagaaagtacataacaccatttgccacaaaatcaccttatctgatgtagacctaacttccattttataggaaactcagggacaaaggaacaatgttaaatgaccccaaagaaatccacaacaaaatcttgattgtgaaaagttgtactgaccctgtgcagtgactcacgtctgtaatcccaacactttgggaggccaaagcaggagtattgcttgagaccaggtgttcaagcctgcagtgacaaactactcacccaattttttcaacaaataaaataccaagaggaaggaaaaaataaagaggaagtgaaacctatagattaaaagagacttacaagacatttaaaaaaaaagtaatgtgtggctttgttggattctgatttcaacgtggaaaccttaaaaaaaattcatgagacaagtgggaaatttggatactaactagatagttcatgatactaaaaattattaattaaggctgggcacggtggctcatgcctgtaatcctagcactttgggaagctgcaggtggatcatttgaggtcaggatttgagagcagcctggccaacatggtgaaaccccgtccctactaaaaatacaaaaaaattagttgggcgtggtggctccctcctgtaatcccagctactagggaggctgaggcaggagaattgcttgaacctgggaagcggaggttccagtgagccaagatcacaccactgcactctagcctgggtgacagagtgagactctgtctcaaaaaaaaaaaaaaatgccaatactatctcatcttaataatttttatttatttatttgagacggagtctcattctgtcacccagtctggagtgcactggtgtgatctcgctcactgcaacctcagcctcctgagtagctgggattacaggcacgcaccaccacacccagctaaattttgtatttttggtagaggcggggtttcaccatgttgaccaggctggtcttaaattcctgacttcaggtgatccacctgcctcagcctcccaaaatgctgggattataggcatgagctgccatgtacagtcagtattgggatttttaaaattatctggttttatagaagtagacaatagaatatttacagatgaggtgaaatgatgtctaagatttgcttcagaataacccacaaatgggtgaggggaataaacttggccatgtgttgatgtcagttgatggggacatggagtagtctttttacttttgaatgtgtttgagatttcccaaaataaaagtttatttagagaagcaaatgcggccaggcgtggtggctcatgcctgtaatcccagcactttgggaagcggggacaggcagatcacttgaggtcaggagttcgaaaccagcctggccaacatggtgaaaccccatctctactaaaaatacaaaaattagttgggtatggtggtgagcgcctgtaatcccagctacccaggaggctgaggcaggagaaccgcttgagcctgggaggcagaggttgtagtgcgtggagatcacaccactgcactctggcctgggcaacagagcaagactctgtctcaaaaaaaaaaaaaaaaaaaaaagaaagaaaaaacagcaaatgcaaaggactcaggggatttttctggagtggtatttctcatatttaattaaaatactttgggtgtcttggtaaggttccggagggatggtaggacatgataaaattatctggaaaagtggaagacatagtcgttgctggcgttgactctcctggcaacaacagcagttcatcactagtactcgtgagagtaaacttcagtctgaattctcctagaagaggaaaagtgcccccttacttcctgtggcagcacttagtgctgtagcaggtctataacctgtacctgggaacacctttgtagttgcagaggtagatatcagaatgctaccactcctgaatcctgtcacgtgaggtggcatctgctcctccatggtgtacttgtaagtattcctgggaaattatctgaattttgaatgggattggaagaattgcttccaaaaacgaatactgcagacttacctgtgtcccattctcagatactgatattttatgggagggatctataagaagcaggttggagcagatctaaaacattccttgtggatagatatttcacctgcttaatttttcaggatttcagaggggaaggaggcaacatcgttgtctccctgcatcgccttgctgtcagcgctgacatttactagcagagattttgcggttcttcttcctccctgtcaaaactggacacttggaactattagaataccacaatagtagtactaggcctaagtacatggagaggaaacaaacaaagtccttattgtctgtgtatttgtataatgctgatttattttttggtcactgcatattaaaaactaatttagataaaacatctctcattttttctttcaggtccggtgtctaaaagactatggagaatttgaagttgatgatggcacttcagtcctattaaaaaaaaatagccaggtatttcttatcttcagattctttactttaaatcttatgagtgttgtatggtggaaaagttggaatagcaaaataaatatcaacttttgatgatcgtttatatattaggcattatcttttagtataatataccctgttctgtactttttctgaatattaagactggaagcaaatgttgcatataataaaagattcattaatttagtaggatattgcttatatttaaaactaggtgttttctaggggaattaccataatcagccttattctgggtaagtgatagattattatctggaggctattgaactgttggatttagctcctttgttcatataatttattctaaaagttcctaagcagtttttttagcttacactttgccttataaatcctagttctttagcaagcaaatagtgatacagatttttctgttttcaaaagaagaattttcaagtatttggtatataaacataacaatttaatagaggaagattaaaattgtaaagttgtaacttaagctaaatttgtccttataaggaatctttatccatctatctatctatctgtctgtctgtctgtctgtctgtctgtctgtctatctatctatctatctttaaagaaaatagagatggggccttgctatgttgaccatgctagtctcaaactctcctgggctcaagcaatccaccttccttagtatcctaaagtgcgaggattacaggtgtgaaccaccatgccttaagtaatctcagtatattaattatttccctagaaatcttcatattcacattagatgaattcacgttaactatattattactattattattattatttttttttttttttgagacggagtcttgctctgttccccaggctggagtgcagtggcgggatctccactcattgcaacctctgcctcctgggctcaagtgatcccccacctcagcctccccaagtagctggaccacaggcacacgccactacacccagttaatttttgtaatttttgtagagacggagtttcaccagttggccaggctggtcttgaactcctgagctcaagcaatccacccacctcagcctcccaaagtgctgggattacaggcttaagccactgtgcccggccactaaattttttatcctatcccaattttctgaagtcgtgaggaggaaaaatgacctaataaaagctgttctctttctttccttgcctgctgtcttggggtcagccatttaggatctgttgaccctaaggatttggtgttcactttgttcatgccagggagcaaaagaatgtttcaggtcatgtggttcttgagcttattttcctaacagggtgagttgatctcttattttactaatacccttggatctttaaaactattttactaatagttgactaaaattattttactaatacccttggagcttctaaaacaaaggttgaatatttttaaaaaagattttgagggttccctaaagtcttcagttgttaaggcaacaatttctgtcccaagtattctcttaggacactaatgaatttaaagcagataatgaattaatgctctgataagcagctatatttctggagggcccaggaggaagctctggcacaagaacaagaaaaaagccatcctcataaagcaagatatgtgaaatgtcccttcatcccaaatgctgtcctgtggttgaatttctttttttttttttttttttgagacaaagtctcgctcttgtcccccaggctggagtacagtggcatgatcttggctcactgcaacctctgcctcccatgttcaagcttttctcctgcctcagcctctcaaatagctgggattacaggcgcctgccaccacgcctggctaatttttgtatattttttagtagaggcggcgtttcaccatgttggccaggctggtttcaaattcctgaccttaggtaatccgcccacctcagcctcccaaagtgctgggattacaggtgtgagccaccgcacctggcctggtggttgaattttttaactctgtttctcagctgtgaccctaccctcaattataaaaatggaggcatgaaaaagaaacaatatcagccacagttgatggttggtattaggggcttctaatgttcaaccacatccaaactttctgtagaatctgtggtgtagatcattcacatactctaaaatattagtaggaaacatttatctatctatctatctatctatctatctatctatctatggtttttttcgagatggactctcgctctgtcacccaggctgtagtgcagtggcgtgatcttggctcactgcaacctctgccttctgggttcaagcaattctcctgcctcagcctctcgagtagctgggattgcaggcgtgtgtcaccatgcctggctaatttttgtattttttttagtagaggcggggtttcaccatgttgatcaggctggtctcaaactcctgacctcgtgatccacctgccttggcctcccaaagtgctgggattacaggcgtgagccactgcgcctggctgggaaacattttctaatatacattcttttatatttgtcactatggcaagcactgttactttttatccagaaatcaatactctccatctgtttaataccagcattagtatggacattaaatgaacaactcagttattttgtttttgttgtgtttttttacatttttcttggctcatgtatcttcaagattggtttagaagaatttggtcatgggtctcttgccaggcctttgagtttgtgaggcaggaccttcaggtgcacatggctactgaggttacattttgcttccttgagatcttcctttgagatttctttgaccacctatgaattgaaaagccttcctgccttgcttccttaacctccctcctccaaggcagtcagtgttttctgtaagtcctggtatttgagagggaaggagacatctttccacctgcccctggttccctcagagcaagagcgatgtcctcttaggaagacacaggacaagcaatacctgggtaccggcatcttcccatgtaccatgtgaatagcacccacgcggtgggtcatgaatacttttcaaccttgagacatacaggaggaaagttgtcacttgttattagaagaatgttcagactctgaaatccaagaacaggttttatggagaaatgagcgtttcatgggtcttcttgataggctgttgagccagtgataatccaaatcgcacctatctggatttctctgtgcataaattttaaaaatataaacactaagtacaatacctactagaattcagaagtcttagttgaattgaacttaagcaaactgaattcatttgtaaaagtcagaattccatacagctctaaatggaatcaatttcaatggattaaaacagcaaatatagtttaactttttttttttgagatggagttttgctcttgttgcccaggctggagtgcaatggcacaatctcggctcacccccaggttcaagtgattctcctgcctcagcctcctgtgtagctgggattacaggcatgcgccaccacgcctggctaattttttttttttttttgtgacagagtctcactctgttgcccaagctggagtgcagtggcacggtctcggctcactgcaagctctgcctcccgggttcacgccattctcctgcctcagcctcctgagtagctgggactacaggtgcccgccaccatgcctggctaatttttttgcatttttagtagagacggggtttcaccgtgttagccaggatggtcttgatctcctgacctcgtgatccacccgcctcggcctcccaaagtgctgggattataggcgtgatccactgcccctgggccaactttgtattttttagtagagacgcggtttctccatgttggttaggctggtcttgaacccccgacctcaggtgatccgcctaccttggtgtcctaaagtgctgggatttcaggcatgagccaccgtacccagccccttaagtttaactttcaactacttacttgttggagtttgaaaactaatcagtgctactttttaatgatacaagaaataatttcaaattctttcccaatcatttattttactctttctccatcccttcttgtcccctcagcactttttacctcgatggaaatgtgagcagctgatcagacaaggagtcctggagcacatcctgtcatgaccatgcgccgaggcacttccaggcttcactcaactcatggactcctctgtactcactctctccaccactcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccggcccctactcctttttctaataagctgtatctgtaatcacagcattcctacagttgttacagtgtgttttttaaatgaaagtaaacatggttacatttgaatctcttaaataagcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagtcttgttctgtcacccaggctggggtgcagtggcgtgatcttggctcactgcaatctctatcccctgggttcaagtgattctcttgtctcagcctcccaagtagctgggattacaggcacaggccgccacgcctggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgtgtcatatttttgctgttgtttgtattttttgtagagatggggtttcaccgtgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcaaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaatttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttc

SEQ ID NO: 2501 - DNA, 49052 bp, Homo sapiens
  source 1..49052: mol_type = genomic DNA
tcagtagctgaggctgcggttccccgacgccacgcagctgcgcgcagctggttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtccgcgcctgagggaggagagcccagaaggccgcagacgcgcgcctggctcggatagtttcgccgacggcgcacctgagctgtcttttatcccggtcagtgtcaggcgcggggtgagcgggatactggcgaccagcggatcctccgctcagcaaagtggccggtgcggggcatgcgggcaccgtcttcatccttttagccagtctggctttctcataggtttctgttcaagtttgtacccccgtcccccgcccgccgcatctcccactgtctcgttttgagaaagtagtcactgctccaactttgggagtcgttctcagtgatgggattttaccttggccttcagttgcacttctcccacattctcatcgaagtgggggaaatagttgcccgcgttctttaaaattttgcccatctgtggagtgaagaaattggtatcttgctgcgagtttattttgcgtttaactactggacgtttgcgttcctttttcggtaaattgcctgtttatctttgcctggcttttagaaatttgagttgttaaatctttttcttatttgtatggaagaggtatttgaatattgaataagaatagccttttgcacgtcgtacatgtaatatttttctcactttgccttttgtgcatgttgtttttagtgcattttttggggggtagtctgtcaatttttttgtctgttaaggcttatgggttttatgttaggctggaaagctatccacactcccagtgttttaaaaaatgtactcatttttgtagtaattttaaggtttttttttttaagttaaaatttttcgtacgcttggaattttcagtactgaggtaggaggggagctagatttatttgcttttccaaaggcttagcctatgtcccaataccatttcttaatacttcctttttttcaactgatttgaaatgctgagactctttaaaagaaaccgttagtctgctggaccatttcttattaccaaactgttttggttcccctagcatttgtaatatggtttgtgctttgagatttttacacgaatagattctatttcattagcactgaagatgaaacaaggtcccaaaactatcctagtttaatttttgtgaacaaattaaataagagtacatttttactagtggacagtttaatctcttaacttcagaaagggccaaatgtgcactaatgccaatgaaaaatgttttcaacagcatcctctttaaagatagtcccccaaacataatccttccttttaagaatataggcattggtttctattggtaactgtcgggaagtgtttattactgttatttgctttttgggagaaaggaatgtgtttcagaatacactatttgttcttgaaatgagattatgttgtcttaaagttatattttcttatagaccttttcatctttgtcatttcaaatttcgttcgtcttaataaacaagaacctaaaagcagatatttaattggatattttaagggtatgttccatttacaacaaagtatacatcaatattttttctaattaaaaaaaatctatgtcaagaccgttgtctttcctgatttgctttgcctacctgaattttcttaagagaagttcatggtaagtcaaagcttgtctagttgaaatttttcccagatgttttaagtgtattataatgaagttagtaatacagtgggtaataatcaaagtgacaatagttcctggttggatttgctctgtagaatgcattaaattaggaaaaaacatgaagatacattccgtggaccaaggagcagagcacatgctgattctctcatcagatggaaaaccatttgagtatgacaactatagcatgaaacatctaaggtagggaacttttttcttttattaaaaattaattttaatcaaaagacaataataatttctgtaggaaatatctgattcttgtcccctgctttatatagtagcatcttaagtaaataataaattctgaactgaccagtaaagtccttatgtcccccagggcaggtatcatgtgttgttttggcatttaaaggaaatgattaaatagtctgcctagccctaaattggactttcctattcattaactcatttgatcctcacaataatcctataagttaaatttctggaaataaaagtttttaacctagaaaaaatacacattatcatgaaataatttgtgagacttttccctagtagattatatgaattagaactcattttcatcttgcatttattcctgcatcctaaaattgtttgcataatattttattataattatgtaatgcatattttttcttaattaaaacatagtatttaaaaaataattttagatgtactgaatgtgatgcagtaaattgaaagttttttcttgagcttcatttctaattaaatactattaatagttctaaaatccatgttgtaactttcattatggtgattaacacaaagtgtattttccttcatcaggtttgaaagcattttacaagaaaaaaaaataattcagatcacatgtggagattaccattctcttgcactctcaaaaggtaatttttctgtaatattaatagttttgtagaagtaatacctgtgtgtatatgtggagccagtagaatgtctatatttcacttgtaacaggacagaaatacagttttgaatttgatatggttccgagtacgattcttaaagtaaatacataatgagagaattcttggatctgtaaaatgttcaggtttccaaaattactattcctaaatttggtttcatgtttttatttttcaagtacgaaacagtgaaaattttctgaataatcaaaactgttttctctacatctgatccaggcctggggccacccttttccagaaactgcttcccttttcctaacacctttccaacttccactcttccggctcagaatccccttttgtggccaggctgcagacctctgatacgttttaacattgcttttgaattcaaggatctccctagccctgtagtatttcccattttctatcagacactgtcatggtgggaaatggaagcagtgaatatgaattatttcctaaagaaacttgactatgaggccaggcttggtggctaatgcctataatcccagcactttgggaggctgaggtgggaggatcacttgtagccaggagtttgagaccagcctggacaacatggggagacttcatctttacaaaaaaacttaaaaattagctgggcatggtggcttccacctgtagtcccagctacttgggagggtgaggcaggaggatcccttgagcccaggagtttgaggctgcagtgagccatgatcgtgccactgcactacagcctgggtaactgagcgagaccctgtctcaaaaaaaaagaaacttactgtgaatggaataattaagatagaagtagggtaatagaggggaattcgaagtcaagggaatttttgttaatatataggacagatgtaaacatgttcataaactgaatagaatctgggattcaagggaagttaataattagtgagtatttgaccttcattgcaaggcctgttgagatttgatagtatgaacttgtattggaagaaattgatcatttgacttcattcattcatgaacaaatatttcatattatctactgtgttcggattatgaagatgaaacacacaagccctgcctttaagaagcccagggtctagaggcgtgtatgtacaagggtaaagggatattcagagtttattactagtaaatcacagtacagaaagaataaaagttggggaagcaagaaaagaaactggtcatgctcatcattatattcctggtggttgacaggtgcatgaaaattgtgtgtgaaggagaggctctgcttcccaccacatcctgcacaatatcttgcaaagagattccagtaaaccttaattctctggtgtatttttttagactctattagatattgtcagctctatcagataacatctaagaacgctccctaaaaaatgtgctccatatattcagttaatggaagaagaaactgactcgttcaagaaactgtaatttgaaattaattttacagttgtttatttgggatcttgtaatttcaaatgaattttacagttgtttatttgggatcattaggcacatgagagaaaacagtagcgctggggtttttcatagaggtagattgcttctgtttttcatgggcccgtcctctgagtgttttaaagtaaatatttcttgaatttgatttataatcaaatttattatgttgaagatattatttaatatgttcaaatagcttcacttttgaagtgagggataaggaagtgtaactgtcactgctaaagagaagattctgtgtttttctgtggcagacatagggtaactgagagtaccatcagtgcaaaggtacaatattgtgatattatactaggtagagcatgcataatgctttagggtaatgtctgctgcattttaaatggaataaaacagcatttgctttgtttatgtcaaggtggtgagctttttgcctggggacagaacctgcatgggcagcttggagttggaaggaaatttccctcaaccaccacaccacagattgtggagcacctcgcaggagtacccttggctcagatttctgccggagaagcccacagcatggccttatccatgtctggcaacatttattcatggggaaaaaatgaatgtggacaactaggcctgggccacactgagagtatggaacacattctcagattcctattaccaacagatatacttgttagatgaatttaatggacctccctgtcaaaaatggttcaaatcttcactttcattttcactgctcttcctgattacctctctgtcttcagggcagaatcagtccaagaggcatacatagtgtggaagttgttactgtaattgagacatgtttcagggctgtgtgtgagacgggaaagggcattgaattagggatgagaacctggattctgattcccactttgcagtttactaactgcaagccttgcccagtcactaaacttttctctagacctcattttctttttctgtcaagtgacaagtttggatgagatgacctttaaagcctttgcacttaaagtctgttagtgtattattacaaaagaatactaaaattatatttaagaactcacatatcctgatcttattctataaggtatcaattatgtctgtaaacacacatgaagaaacatgtaatttccattattgaacaaagctgatggtgaaatttctcatgatcccaaacaactcattaagagttttcaggtgtaagaaattctgctgctttacccagctgtggtactgtatgcattaccctggatcactggttactcatttctccctgacacagtgcaatggtcattacacagaatagcccataagtcagtgttagaaaaatattcaaaggagagaagagaataaagcggccattaaactactttggctgaatctctgagtgcttttgacatgaaaataatcatgaagaaaagaagaggtagtgtcaggtgatgacactagtagataatttgaaagaaaggaattgctatgttcattaaaagtaattctagatggctgttggaaatatctaatgtgctgcaattaaagtgaatcaagtcataactgagaacaggctttgggaagtggtttgaccctttcacaggtgggtgcccctaagtgtgatccttttggccactggtcccaccttcaccctgaggcgtagaacttgatcctaaacatggcaacatagagcctttcttgtcagaatatcatgagaactgttgtcgctgggttgagaagcagcagtccaggtaactccactgtgaaactcagcatttccttttggtcacttcagctatttttttccttacataggtaaagatgatccatcccttattgaaggactagacaatcagaaagttgaatttgtcgcttgtggtggctctcacagtgccctactcacacaggtgggtgtacccttgtctctttttggctgtatttttagaagaacagtttgtatgggaagttagtgtttcccagagaagaaaggtcatcacttcctgtatgtaggactgtccttctgatatttaggagctttactttgacagtgctatttattagtgattcactttgcatcagtgaatactacttttttattttatttttctagcatctgatatgacattccctttccttaggatgggctgctgtttactttcggtgctggaaaacatgggcaacttggtcataattcaacacagaatgagctaagaccctgtttggtggctgagcttgttgggtatagagtgactcagatagcatgtggaaggtaagttgtaaagtatcaataagaattgataaaatgagtgcagcaaactagatagtaatttaataaaatttctttcagtttctttgagatgtatcaaacattttcaaatcagtgaaaatgcttaatttatattatttagataaatgtaataccccttttactatacatggttgttttctttgatttttttttttttttttttttttaaatgagcagatacaattcactttctgctgtctccttagtgaaatacctttgtaactattcaggtgcacttttgtcttaaaaaaacaagtcattaattgtttatttgggaaaaataaaatgtaaatcacaaaggattattcattaaatgtaatcaccctctctgacaatgccttgtggccaacatactttttaattaccagagttctttcattgtagcctgccctgatcacagtaaagtataagacatagtcagtgatggtttgagtgaaatattcctaagaagtttaattttcacagctcctttttagaaaagaaaggtaaaatgtcttgctcagactccttagtttatttaaaggttttttggttttcttgtttgtttgtttgtttgttttttggtttttggtttttttttttgaggcagagtattgctttgttgcccaggctggagtgcagtgacgcaatctcagctcactgcaacctccgcctcccaggctcaggttattctcccacctcagcctctggaatagctaggattacaggcgtgcactgccacaactggctaatttttaaattttatttatttattatttttttttgagacggagtctcgctctgctgcaaaggctggagtgcggtggcgcaatctcggctcactgcaagctccgcctcctgggttcacaccattcttctgcctcagcctccggagtagctgggactacaggcgcccgccaccacgcctggctaattttttgtatttttagtaaagacggggtttcactgtgttagccaggatggtctcgatgtcctgaccttgtgatccacctgcctcggcctcccaaagtgctgggattacaggcatgagccactgcacctggccacaaccggctaatttttgtatttttagtagagtcggggtttcaccgtgttggccaggctggtcttgaactcctgacctcaggtgatctgctcgccttgacccctcagagtgttgggattacaggggtgagccaccacgccactatttaatttttttgattatcagatatatcagtccacgtcttgccagagggatgttggaagttggtaggattaaaaaatattttcccccatatacacttattcttttgggcagtttttccctcactaaacgtagagcaaaattcagactgtatttgaatgctgggttcatttgttagtttactgaaaccattcttataaaaaactagcatgaatactttcagtctgtaggcatattttcttatgatcttggagtagaattacataaatgggtaatattattaaggtagaccaaattatcggaatatgagtctcttcaccaaagaagcgttctcttcaatatttatacctcattcggtatctcttaaccaaagcagtcttatcacctctttggattcttcattacatacagtccttttgagtagcatgtattacaagagaaggaggcaagttggagatctgtcttaatgcacatcagggcaatacccctactaacaggacaattcactggaaagactcacgaacttactaaaagctattatgctcatagtcacatttattacaagaaaaggatacaaactagtaccagtcaaaggaagacacataagggcagggtataggagggctgcaaatgctgagcttgtggctgtcacctccccttggagcaggtggatggtgttatctcttctggcctgataatgtgacaggacatacagaatttgccagccaatcagagaaattcacccaagttgagagttgtttttgttttttctggtttttttattttggagacagggtacaggatgtacataatctgccatctagtcagaggagttcacccaagtcaagaccaagtcaagagttgtttttggtttggtggtttttttttttttttgagacaaggtctcactctgtcacccaggctggactgcagtggtgctatcatggcttactgcagccttgacctcccaggctcaagcaatcctcctgcctcagcctcctgagtagctgggaccacaggtccaccatgcccagctaatttttaaatttgttgtagagatagggtctccttatattggccaggctggtcttaaacttctgggttcaaagtatcctactgccttggcctcccaaagtgctgggattacaggcatgagccaccacaccccacctaaattgaggggttttattgctgaggcatgattggttaaatcattgcccggatagttaaacttaatctccagcactgccctcctgtaggtctgatttacatcacaggccaggagagctctcccaggatcctgccatgaataataaagactctcctctatcacttggggaattctgtgggtttagaggttacctcctaggaacagggcaccagccagacctctctgggcaaggcagattccttgctacacaacagtatagtggaatatacaaaccagcaaatcaataggaaaatcagtgtggtaaaggtctttgagaaattaagtgggaactcaactgagtcttccaggatggaaagtgaagggactcagagatggtttccaagaggtggtgactcaaactgatgttgaaaaatgagcagagggcaaggggaggtgcttgtttcaacaaagggaacaccatttgccaaagtatgacatcatggtcttgagtggcctttgggttccaaagtcttttcaggtacatgttgatttcttggtttccagatgattttcatcctctaagagatgtttagtttcactctcactgggtaacatagttttggcaatttactgtattgctaaacactctcatcattgtggataattaagaattgaccatatgtgcttttatttaataggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttggtaaattctataggaacatagggtttggcatagtatctttttagagaaaatgatttttctaactaggtaatgtggcaaagaaagcaacatatgactatgaagggagtttctctaaatactggtttcattttttactggtaaacaattcaagagtcagtctaatttactgaggcaaaataattattctatattactccttcagattaggattaatgtgaatttaaatgataaaatagacaatggattcagaggcatatgcagctctcattccagtttgcaagagacttactaattcttgtaattagttgtttactaattcttgtaattggctggttgccctggttaagttgatccacagtcatataaaaccctcagaataatgagcaatcaacgtatacctggcactgaactgtgctcagcacttacttgtgttatctcaccaatccttgtaacagttcctgggaggtgtattctgtcactcctcttttactggaggataaagagacttggagagaaaagggttagccacttaatcatggccagtaagtggtttgtctggagttgaacccgtgccctttatgacctcagagtctgagctctgaaacactccattgtagaagcaccttggagcatttctgttacttgtttctgaaagcttagtggtgacctcaagtaacaaaatctactcatttcttgtaggaaaacgaacagagttatttccttaagcagcatgtattatctttgattccttataacagttacatgggcttaaagtacttatattctttatagccagcagtcattgcttaaatcttgaaaacatggtttttagtaatgggagttgaattaaactgataacatttagctaatcaaatatttgcattttatatataaatatttgtattatgtatattaaactgatgtcacatgtccaccttgtgaattacctatgtttgccaactagactttactccaaaggatatgtatttcagctgcttaattggcagaaaatgtactaagttttgtctattaagaagaaaagatgactacgtttaagaagaatctgaagttatttaaattgaacatgcatgtttgtgccaaatgactttctaaaactcttactctttgtgcatcctttcagaaagccatacctcagaaaaggagttaataatgattgctggagggaatcaaagcattttgctctggataaagaaagaggtaaaaatagatctccaggtgttctataacctggtattttaagcaaaactaagggttctagtatcccagtttggtgaattccaaaatcatcagtttaccaggctgactttttgggggatagctggacattactgatcctttattgtctaaactacatcagtattttcccacaaaaatcagcagatttttctctggtgaatgtctaatcagtgtgatttccataggctatacttaccttttgggggctacttgccaatgatgtttggtcagtatccttgcaaacaacagagtgacagattctaaaaatgactttgcaggccagtactaagaaagacaccaaggttcatgggcttgcaaataaaaagtccataacttccctgccctacttcaccaagtgaaatcgagttcctcacacttctgcacacagctctttcaggatcttcccttcccttcaaggctgtctgatgttcagtttaatttgattgtatttgtataaagtgctgagtgttgagtcctcaaagaaatttactttcagtctaagcccccttggacaagaaagtggcaaccaggcaaatgattgattacttatttgttgagtatcactttgtgattgtcccagggctgtattacacatatttaaaagtcagttttactctctagagtgtacctaaaagttgggtgcctatctctgatgtgtctaaattattgtattttactttcctgtttgtttacagaattcatatgttaatctgaagaggacaattcctactctgaatgaagggactgtaaagagatggattgctgatgtggagactaaacggtggcagagcacaaaaaggtacaccccacagtctgactctctgcttatatatcactctcaagtatcatttcccaaactggttctgcacagcaatatgagattttgtagtcagggttttccagagaaacaaactcataggatatgtgtgtatttctgtctctatctttatctctatcatgtctgtctgtccatctatgtatctatggaggggagagagagagattattttaaggaattggcttatgagattgtaggggctggcaagtccaaaatctgtagggcaggccagcaggctggagacttggggaggagttgatgttgcagctcaagtctgaaggcaatctaaaagcagaatttcctcttctttgggtgacctcagccttttctcttaaggccttcaactggatgaggctcactcacattatggaaggtcctttctttttattcacttgttcaagtgctttactcagtttaccattttaaatgttaatctcatctaaaaaaatactttcatagaaacatccagaataatatttgaccaaatatcttggtaccatggcctagccaagttgacatataaaactaacccatcacaactagcatgtaagcgccatgaggacagctttctttactgtagggcttctccaggcctctgtttatgtatattgtgactctctggccagaaaatagagtctatagtgtttcccagtcccatttgatcctggaaccattagtttgtgtacctgttattcttagctgaacaatttgtaccattcttctctaaaccatagaactcctataggtttacagaactcctacctattcttacaaacatcatcttttagaaatatttttaggtatggctttctaattctggaaaatgattgtacaaagtagttgcacaaaatagttgcatcataatttgcagagcataaataattaagaactgtacaactacttctaagatgaaactgagcatactccttcccccatttaatttctggtaatttatttctacttcagtggaatagaaataaataggacttgcatagttggtggggtgggagtattttgtttgttcaagaaagttctgaccataaatcaagcctttcctctttatttgaggcttctctgagtatgtataaacttttttatttcccatgtttgccactgaaattttgagatttaccaaacagaatggacttttagaagccaagccaaggtaatatgcatacagataggagacaaatggagaggttggaaggatagttataagatgtggtatttatcatgtctcatgctgtaaagaaagaggctgtatgtatgtataccatgtgatttggtttaaccagtgtcttattactaatatagggaaatccaagagatattttcatctcctgcttgtctaactggaagttttttaaggaaaaggtaatatatgtaataaattaattgtattaaattgtattaagagtaccgtgaaagaggataaaaaaatgattggagagtaaaatagctgtgtgttcatccctttttaaaaattttttttaacaaaagtaaatatatgtttgctgtagaaaatgtcaaaaatacacacaataaaaagaaagtgaaaatcttccataatccatcacttaagagtaatagctagcacttacgtatatgattatattttttcatgcaaatgtattcttttaaaaaaaatgagatcatactggttctttgtttttttctttttttttttgagacagggtcttgccctgtcgttgcccatgctttaatgcagttctgtgatcttggctcattgtaacctctgcctcctaggctcaagcagtcctcccacctcagcctgagtagctggggcttcagacacatggcactacacccagctaatttttgtatttttttgtagagccagagttttaccatgttggccaggctggtctcgaactcctgagctcaggcaatctaccagccttggcctccccaagtgctgggatttcaggtgtaagccaccatgcccagctggatcatattgtttatacattgttttctacctaatatttgcccattttacattttattctatcttttttggtaatttttttttttttgagacaaggtctcactccatcacccaggctggagttacagcatcttggttcttgggctcaagcatcatcaaactcttgggctcaagcaaaactcccaccttagccttccacgtagctgggactacaggcacgtgccaccacctcctgctaattttttagcttttgtaaagacagcagctttgctatgttgcccaggctggtcttgaactcctggcctcaagcagtcctcccacctcagcctcctggtgttgggattataggtgtgagctaccgcacccagccggtaacataatttaatggctgcatgaccttccattagaaggtcttccatgagaagatacttaaacatttcattaataactttatattgaagtactaagaaattattggtcagaagccctctcttttggttcccacttttcagtccatttaacgggaagaaatggatgtattttttagaaatgggaaaaatgtttatcttttttctgtcttccttccttccttcctgtggtcagtcctttcttccttccttccttccttcgaaaaacctttatcttttttctatggcccgcccttcttccctcccttctttcctccctccctccctccctccttcccttccttctttcttttctttttttctttctttctttttctgaggcaggatcttgctctgtcacccaggctggagtacagtggcatgttcacaactcactgcagccttgatctctcaagctcaagcgattatcctgtctcagcctccctctgtggctattttttttaaactgggaaatattaatttttttaatctattacagataagacagcatctgagttaaagtcttatggtatatacagttaaagcagccttgatattttttggtattttagaaaaaatcatgtttactacattgcatttggatttagacaatttattatagttacacacttgagaaaaaaggtaattttgttgaaatggggcaagctctagaagaaactttgcatctagggagataatctaacaaaatacttaatttatctttcttctacagaagaactacagaaatgatgcctgtttatttggacttaaataaagcaagaaacatcttcaaggagttaacccaaaaggactggattactaacatggtatcttcagattgttatgtggagaaagaaaatacaccagaatatttcttaaaagaactcaaaatttcagaagaaatgttttgtgttaagggattctccgagaccttgtagcatattcagattaagttaaactcagataacatttaggagtttgcccttttagggtgaaatagttggcatagtagtcacacaggttacagatattctaaatagtgtgtctgtacacaaacacacatacacatatatgcatacacattcgtagagggaagtttttcaactcagggctttaggaagatgattaaggatttgttgagattggtacactagaataagaacattttatatgcaaagcataaatgtagaaatgagaacattttttctgatatgaatatccctctcaccagggactgcctggattctttttttttttttttttccattctacttttctgtagattctagaatgttcttgttccttatgggatgattgtttcctgtttcagcactgttactgctatctttaggttttctttttgcaggtgctccaaacatgcttcctttatttttatttttatttttttggaaacggagtctcgctttgttgcccaggctggagtccagtggtgcgatctcggcttactgcatgcttcgtttattaatttagtttttcttaatgtagtttttattatttccctattttattttactggttgatatggggatactactttctgttctactctccatttttttctctctgggtcgcactgtagttccttctttctttctctctccttccctcctcccctccttcctccctctagcctcaccccattttttaatctctctctgtgttcatatccctcttctctttccctctcaatctttgatctctcacccttcctcctttcagctcccgcacttgctctgtttgccacaactagcattttctatttcagctgcaagttttctcattcgctcctttctttcaaggaaagatggaaagttcagttctcttaactttggcagaaccacagccccactgggggtccgaggtgaaatggttccctaattatgtacctttattgggaccctacaacacttagtgctgcctgtatcaacaacccagaaactactcagtggactatttcatcaacatttgttagagctcattttcttttgttttctaaaatcctcctgtgggggccagtttaactttctttctgtaagattctgagtcattgctactaaatacaaccatggaaagattaccaaaaatagaagcccttttgtgcgtctgtgaagggaagggattggatcagttcatcattaagggctccttctgtttactaattataccttgattgtgccacaaaaagaacatatggtatgtaaatgaaataatcatagggcatccttgacctccattgtttcagaataagatgattggattagaagacctgtaatgtttctttctatcttgaggttctgcgatacggactctcagacctttggcatgtgttcatttattcagcaaacatttgaatacttgctgtgtgctgggcactgtaatgatgactcgatgaagaataaaagagacatactccctgtgctttagaagctcatggtgtagtaagggagacagatacatacatgcatacatcagtgcaaagacctggtgtgttttacacttcactgtcttcgctagtgcctggcttagaatgtagcctgtgtgcaatatttttggatgaattgagtcattattagggcagtgaatggttagctctttttactcaaaacaagttgcccagaggaattaagatcttaccaggtgctcacgtggaaggatattcgaggcagctagaaaagcgtatgccaaagcacagtgtgtcagacaataggactggctcgagggtatcacagtaattctaagggtttggaataggtgaggaggcttgaggttgtgtctgatgatgagcaaggaggtagaatgcgtgtgtactaataagatgttgaaatagagttgtcaggtatacgtaactccaaagaccgaatctcatcgtaggagtccaatataatgttttaatataaaaataggtaattataacaattcgtacatttacagatatcacttagccactatctcataatataatgattaagaatttgggctttggagtcagaaagatccagagaaattcccacttagctgtgtgaccttgagcaagttacttaatttctctgaatcacagatttctcatcagtaaaatgggattaataacatctgtgttagggagaaactataataagggttaaatgacctaattaatatatgtacatcacttagcacaataattgacaagtaataagtattccataaatactagcttatcttcatagtgggattttaaacaaatgattactgtgatctaagcacacataacaaaaattcagaattccattccattttttcctaaacagttgcattctgaattggggaaactataaggaaattggaggggctagaaactagagtctgtggtagagacagttgctcttatggaagataatgagaattatgttaaattttgttcttgaaattttcggattttgtcttttttttttttttttgctttgttttgtttttctgctttttggagttctgatgcatttttactcttgaaaaaagaaacccacggtgtgatagtgtaaaccagagggtagaatatggtacttatgactgagaaggctgtttattagttctgaatctattgttcattgagtgtaattcttgcacatgtttttttctttttctttctttcttttttttttttttttttgagatggagtcttgctctgtgcctggagtgcagtgacacaatctcggctcactgcaacctctgcctcccaggttcaagcgattctcctgcctcagcctcccaaggagctgggactacaggcacgcaccgtcacgcccagctaattttcatattttaagtagagacagggtttcaccatgttggtcaagatggtcacgatctcctgaccttgtgatctgcctgcctcggcctcccaaagtactggttaggtgtgcttgatctccttcatgcaccctgataattgaatggagagaatactaattgtatatcccaaatacctccaatattttggaggctaggtgagaagggatgtaaacaggggttttagaaaactcaatgattattctcatttagtagtagaatgacattccagcctctacaccttgttttattaccatcagttgcaccctgcttctactgagttttgaatcccttttccctgttcctttctgaccacagataaccacctgcctcaaagataatctgctcaaaagacttccatttcattctccaccccaagaagctttagaaattttcttccttctcccagaatgtcctatgatgcatatttccaacaactgggagagccttgtggttccatttgcaaaggttgtttgtaaaatgagtgaccagtcttcactggttctgggtaagtttgatcatttgaagatactttacctgtcttctcagtggaaagacatgtctagtaaagttatggcaaaactaagatacttagaaatgtattcatttttttttagttcgtattgttagcatactctaaaggtactataacaattaccatggtcatctaaaatagattattctaatacttttttagattccttggatacacacatggctttgtcatgatttccttagtttccaacttttcactatgaaaaatttcacagagaagttgaaagaatagtatggtataccatatgcaataaatggtacaccttgctggagtgcagtggtacagtcatagctcactgtaatcttaaacccctgggctcaagtgatgaggatgctaagttctaaacttgtaatagtaattgtatttattcactgaaaagtttattacaattgtgcttttgtaattatggtattagagtcagcaataataagtatgttgtcatttgtgctttctgtttatgtacagattacattttatttttactgaactatttgaaaataagttgaagacatgagatttcactcataatatttcaccattcatctaagaacatggaatctggccgggcacggtggctcatgcctgtaatctcagcactttgggaggctgaggcaggcagatcacctgaggtcaggagttcaagactagcctggccaacatgacaaaaccctgactctactaaaaatacaaaaattaactggacttggtggtgcatgcctgtaatcccagctactcgggaggctgaggcaggagaatcgcttgacctgagaggcagaggttgcattgagccaagatcacgccattgcactccagcctgggcgacagagtgagactccgtcccaaaaaaaaaagaacatggaatcctgtattaccctggcatcattatcatatctaagaaaattaatcataattttataatattatccaatatctaggtcattcaaatttctcttcttttcccaaaaaaagtaaaaagtatttatagcttttttttttttttttaagaatctcatttgaggccaggagtttgaggccagcctggccaacatggtgaaacttcatctctactaaaaatataatcagtcaatagatagatagatagatagtgaaaccccatctctactaaaaatacaatcaatcaaaagaaaggaaggaagggaggggaggggagaggaggaagggggaggggagggaaggggaagggaaggggaagggggaggggagggggaggggagggaaggggaagggagggggaggggggagagaaagagaaggggaggggaagggaaagggaaggtgaagggaagggaactgaaaggaaaggggaggggaaggggaaggtgaagggaagggaaagggacggggaggggaaggtgaagggaagggaacggaaaggaagggggaggggaaggagaaggtgaagggaagggaacggaaaggaagggggagggggaggggaaggggaagtgggggaggggaaggggaagggaggggaggggatgggaagggaaggaggagggagggagggagggaaggaaggaatgaaggaggaaggaaggatgaattctggtcagttgtcttgtagactgtcccacatccagatagtctgaccgtttcctatccctgtatttccagtacaccgcaagtaagttctaggggcatgaatagagtttaatgggatttttgacatacatagcatattcagctcaaggaaatccattctttatgttttattaaatctggataacatgataagtgatgaaaagctactttaaaatggtttttgttttttaaaatgctgaaatatgttttctgtaagagttaaacacctcagactggaagcacaaaaagaaagttgtgcattcacgaacgatttttaatttaatttttaacacattatactatttcatctgcacaaagaatgtgattaattttgctcatattttttcacaaattaattacatcaagtttgtagttgtattaactgtaaaggaacttttccaggatgttaaattattagtagtattttttaatagagacaggacctcactgtcacctagctggagtacagtggtacaattgtagctcactgtaatctttgaactcctgggcttaagcaaccagaaagttaaattctaaacttgtaatagtaattgtatttattcagtgaaaaatttattacaagtgtgcttttgtaattataatatatactaaaatattttgttatgtgtatcaaaaaattttggctactttttaccttcaacaatctaagtaaaattacgtgataattatatttaccttccttgtgaaggtcaaatatgcagagatagataataaaatagtggttactagtggatgggggtggaaaggaaatgtggagatgtaggtcaaaggacacaaagaagcagatgtgtaggatcaacaagtttagagatctactagataagacaacaggaggactgtagttaataacatatcgtattagggattttattgttgttaaataagtagatgttagctgtctttgctttaaaaaaatatttttttttttgagatggggtcttactctgtcacccaggttggagtgctctggcacaatctcagctcactgcagcctccacctcccagtctcaagcggttctcccacctcagcctcccgagtagctgggccacagacatgtgccaccacgccctgctaattttttgtagttctggtagagaccgagtttctctatgttgcccaggctggcctggaactgctgagctcagacaatccacctgcctcagcctcccaaagtgctgggattgtaggtgtgagccaccatgcctggcctaccaaaaaaatgttaatttgcttcactatagtaacaattttactatttatatgtatcccattacattttgtagacctcaaatatacccaataagctggtgaggtggctcatgcctacaatcccagcactttgggaggcaaaggtgggcggatcacctgaggtcaggagttcaagaccagcctggccaacatggtgaaaccttgtctctataaaaatacaaaaattagccgggcatggtggtaggcgcctgtaattccagccactcaggaaggtgaggcaggagaattgcttgaacctgggaggcagaggatgtagtgagctgagatcgtgccactgcactccaggctgggcaacagggtgagactctgtctcaaaaaaaaaaaaaaaaaagcacaataaaactcattttttaaaaaatttgctttccttgtgttcctcagaagagtattgggcaactctgcaagaatccactttcagcaaactggtccagatgtttaaaacagccgtcatatgccagttggattactgggatgaaagtgctgaggagaatggtaatgttcaagctctcctagaaatgttgaagaagctgcacagggtaagagttcctttagaaacctctgtgtttttatctagctgtaaaaattcccttcctttcagctggcttgaatctttaagtagactcgtgtgagacatacgaagtttatattgctatttttttaatttttttttaaaattacatcatacatataaaggaatatatatataatacctatttagaattcaaggaaaaataataaaataaacattagtgtccttaccacccatgttaaaaaaataaaacatttccagtactttagaaatacctgtgtgctgggccgggcgcgttggctcacgcctgtcatcctagcactttaggaggccaaggcgggcggatcacgaggtcaggagatcgagacaatcatgactaacatggtgaaaccccgtctctattaaaaatacagaaaattagctgggcgtggtggcgggcgcctgtagtcccagctactcgggaggctgaggcaggagaatggcgtgaacccgggaggcggagcttgcagtgagcagagatcgcgccattgcactccagcctgggcgacagagcgagactccgtctcaaaaaaaaaaaaaaaaaaagaaataacctgtgtgctttagaaataccgtgtacccctcatgggttgcaacccctccatctcccagaggtagtcatgatcttggatttcgggataatcattcccttgctcttactattttagaactatatgtatgtatttctagacactatgatgtttaattttgctattttcaaaatttatgtgaatggaatactgcttcttacactcaatgttttatagattcatccagattaatgcttatggctgtatttcattcattttcactctgcagtatagttcattgtatgaatataccatacttagcttatccattccaatattgacagatatatatgctgtttgcaattcttgtgtgtgttttttttttttgtcttgttgggagttcctctatgagaaaacatgctgctataaacatttttgttcatatctcttggttttcttgtatcaaggattggttctgggtttcatacctaattctagaattgataagctacggatatgtgtgtgttgttctttactggtagtgacaaacttctaaagcagttggaccaatttaaattctctccagatgatgagaattcccattgctccatgtctgactttaacattttgaaaatatttttgataggaaatgataccaaattatggttttaattgtatttccctggttcaaatgcactagagcatattttcatgtttgtaattgcaatatttgtttccccttctgtgaaatgcctgtccttgacttttgttcatttaaatgatgtttgactttttcttactgattatagaattcttttattttggacactactcttttgtcaatgatatgtgttgcaaatactgtatcctagtcttttgctttatggtattttttgacaaacacattcttaattttattgtagataaatttgtcaatccatttctttttactccttgtgtcttgttttaaacttcttttctcccataaagggttttgattcgagacaggttctccctctgtcatccaggctggagtgcagtggcgcagtctcggctcactgcaacctctgcctcccaggctcctgtgatcctcccacttcagcctccaaagtagcttggactacatgtgcaagccaccaaaccttgctaatttttatattttttgtagagatggggtttcgccatgtagcccaggctggtctcgaactcctgagctcaaatgattgacccacctcagtctcccaaagtcctggtattacaggtatgagccactgtgccaggccaatatttgactttttcttagtgcttacaagaattctttctattttggatactactcctttgtcaatgatatgtgttgcaaatattttatcccagttatagcttgtcttttgcttttatggtgttttttgacaaactcacattcttaattttaatgtagataaatttgtctgtccgtttctttatataattttactccttgtgtcttgttttaaactttttttctcccataaaggttttaaattattaccctaaatcaggggtcggcagcttttttctggaaaggaccagatagtaaatattttaggctttatgaggcatgtggtttctgtcacaactgcagctattcagttgttcaggagtagcatgaaagcagccacaggcaatacaaaaatgaatggtcatggctatgttccaataagactataaaaataacagagggctagattaggtctgcaaaactgccctagatagtattctaagaggacaatagccaaggccagaggaagagtacaaatggaggcctaaaaaggttaaaaacctatctaacaaactgttaaaataaaatatactgtcctcctcttttgacaaataaaccttcataatgacagggagggccaggtttgaatttagaaatctcagtcttcttaaaattctacattgaaaaatggtggcttgctgggtgtggtggctcattcctgtaatcccagcactttgctcggaggctgaggcgggcagatcacaaggttaggagttcaagaccagcctgaccaacatagtgaaacctcgtctctactaaaaatacaaaagttagctgggtgtggtggcgtatgcctgtaatcccagctgcttgggaggctgaggcaggagagtcgcttgaatccaggaggcagaggttgtagtgagccaagattgcgtcactgcactccagcctgggtgacagagcaagactccatctcaaaaaaaaaaaaaaagggaaaagaaaagaaaagagaagtagtagcttaaatgcagccctctgctcttcttttcctcccttgattttgtccccacaccagaaggggtgtcacatgcccgtatgtggacacctcagcccatatgtctgaattccatcccatctcccaccacagaccctccgtagccaaccctgagactggaggatctcagttgtgacatagttcactctctagagaccaagcacggggagaggcctgtgccagaagcaggcttggaaccatttgaacatggaatcccaggtccttggtatatgcagcccaatctagaaggggatgtgtgggctgaaaatagacaggtccccctggccctgcagaccccttattctgggggaagaggcttggctggaggagagccactgcaagaaccatggtcctagggctgtattcccaagtacctgggattacaggcgtgcaccaccatgcctggctaatttttgtattttttgtagagacgaggtttcaccatgttggccaggctggtcttgaactcctggcctaaagtgatctgcctggctctgcctcccaaagtgctgggattacaggtgtgagccactgcacctggcctgaatagtgattcttatattcagcaaatttgccaaattctcatgttatatctagtatttacttatagattcttttgaattatttatgttttctttttccagtccatatacgttttattattttcctttgtcttgctctaggtagggcttctaatatgatgttaaatagaagtgggggaacagtggatacttatttgtgattttaaaggaaattttttttcatggactattcttagtttccaaaggaaatgcttttagtatcatttacttataggggtttgctgttgttgttgttgttttgagttggagtctcactctgcccaggctggagtgcagtggtgcagtcatggctcactgcagccttgaactcctgggctcaagtgattctcctacctcagcctcctgagtagctgggactataggcatacaccaccatgcccagctaattgtttcatttttggagagacagggcctaactatgttgctcaggctggtcttgagctcctggcctcaagtgattctccacctgggccttggtctcccgaagtgcaaggattacccgggtaagccaccacaccggctctataggcttttttttttttttttttttttttcctgagacagagtctcatcctgttgctcaggctggagtgcagtggcacgatcttggcttactgcagcctctgcctcctgggttcaagctatcgtcgtgcctcagcttcctgagtagccaggaatataggcacatgccaccccacttggctaatttttgagttttttgtagagatggggtttcaccacattgcccaggctggtctcccaactcctgacctcaagtgattttcccaccttggcctcccaaagtgctgggattacaggcatgagccattgcgcctggccttctattaggtttttgaaaataacctttgtaggttaaggatatttccctccttttagaaattgttccacattttaaatctaaatgaatattgactctcttttttgaaattccagttattgacatgttagactttttcagtctatttggcatgtcccttaagctttctgtcatattttccgtctcattgtctctctgtaccccattctggatggtatttcttcagccctatcttccagttcatgaattctcttttcagatattttggttgctattaatactaccttttaagtttttatttcaagtagtaatgtttttcatttctagatactcgaatttgttctttaaatttagtttcttgctcattatttataatttcttcattcttttcacattttccttttatttatctgaatatatatgccttataactcaggtatctgaagtctttgcaggtcagtttctgctaatcttcctcctgatgtctttatgctcatgtatgttgtgatttgtgtatgtgtgagagctgtctgttttccttggaactttatcttttggaattacttgagggctggctttcttcgcagagaattttcttctgccaggctcctagagataccaccagtttggtagtactttacatttttggcttgaagctttttagaatttggtggcaaagttgaaggagagctcttttgtaattacagatcctataggggataatttttccccaactcagcaccatttgaacttggaacagtttgccttgtggtcctggggtcaaggtggaggtggagtgattgatatggcagtggaggaaagagcttattcatttctagttcatccttacctgatggtttaacccttttcggtctcagacttgtggggataacttctcctatggactccctaatttgaacagtctaggctttgcctcctttccccaaagccccaaccattgaaaattgaagtttacattcaccaggttgggcagatgctctcaaggcaaatgccactttcatttaagtttttgacctgattattccatatctacctaaaaaatcagtaatgcctttaaacatgtttgttacagcttttcctgtatttctaggtgttttcagtggatcagggtacctaatatatcatactgctgaagaaaaaaatctgccatactattgaaaaacaatggctattttcaacaatttttaaaggttttttttttttacaaaagggaaaggttaatgaaaaataatttgtgttttgaaaaaatgagaaatttattgaagagctctgggaaggtatattctaacaagcttttgccacttacaaggagaatcacaagaaatactgaagcagcaacaaaagaaatcttcaggggatcccgctttgtcctttgaccgtaatagataatatcagaatattttatatttgtcaggctccccacctcagcaggaggccaccaggaaccatgaagatgaagtacccactttctctgtgactctggagatcttaaggctaataatgataaatgtaaggccaagatcatcagatccagagggccatagttacagggtgaaacagtctcaccagactttgggtggtagtactgggaggcctggaatatttgaggcctggacgagagtcaataagaacattctagacacatggtttcagtgcatatagccaagatgagtttttagaagaccacctgagagtaatttatttcaggataacgcccatccaagtcaaatactaacagtcactaatgtctgaagtgtctagtgtcattattattcattgtcttcacgacatgccagggtgttcatgtgtctgtcataataaccctgatcatatcatatgggatggagggttggaaaatttcctctcggtaggggaatgttccacaaatgcctcagcagagtgaatgtctataagtggtatattattaagtcctaaagactaagacatgaagaactggaccccagagtactttgggatattgcattgtttttttttttcttcctattgaaagttctttaaaaatttcctatgaattaaaaataactagaggtttatcattacatcatcaatctctactcttaaatcttagatattctttatgttcatgaaaatttggggctctggcagtggaggaattggatagaattttattctggtcattataagagtgtttcatttataatttaatctgataatctaattaacagctattaagcaaaattgtctttaaatataaaactttttcacaagtcatattttatttaaggtaaaccaggtgaaatgtcaactacctgaaagtattttccaagtagacgaactcttgcaccgtctcaatttttttgtagaagtatgcagaaggtacttgtggaaaatgactgtggtaggtatagcatgtttaaagggggaaattgataatcagtgagttaatacaggcatttcttgtcctctgcaaaattgcacaatagaaatagcaggacttgtgggaaacattaagactcctcaaaatctatgcaattttgcagtcagagttccagcagaaaagtgattggcaccttgggagatgactatgggagtatgaaaaatgcacaaaaaggaaagggtagaaatctgtctatactgtaattagagaaggactagtggagctctgatacccttaaagtggtcataacaaggcagtgagactcatcaggagccaagagccaagaccctgtgggtagagtgtcttgggtgtaagcactccttttttattttctgaaaatacagttgaagggctcctgctgccaaggtagcagttgacccgaagtgtttctccctttctctgaaggttataattctccttctagcacatcaagtcttgcccagcaaaattcatgtatgagctaaccagctacccatgttatatcattctccgtttatcaaatgcaactgagcttattcacatggtagaaactcaggtttcagcagaacagactctttgggaaagcatccaaagtttataattaattgctaaattaaatgggcactaaacattctctttatatacctttcattgatacatataaaacacattttctactactggtactatggaccagtaatttggattgcttttgttggaagtactgagaccttaaaccatcagggatgtaaggctatgaggtaaagtgtaaggtttctctgtcctttaacttatcagaattattgtcatttccatttttaggacgcttcagaaaatgtacaatgctgcgtcatattcagtcactttccatttatctttaataatctgtcgaaaattaaactactacatacagacacacttttaaaaatagaggtatgtatgcctatttgtcttcattagcataaatcacatgctaagcgccttcttaatcatgcagtattttgggggtgataagagaaccacctaccagtgaaaccaatggttgtggcattcaaggagcttatactctaatgaagacggcaaggcagactgtcataatttgaatcatcttcaccttaaggcaaattagggccttggtagcaagggatggagcttggacaactggcctagttgtcgggtttttacctgaagttggcagtggcagcctgtagtcttctgaatagtactcaaagaggtataacaaacttgggcttgattaggtgtaacagacttgggcttgactagcacctatgtaaggaggcacaatctaatgaaaagatacggtagcaggaatagaagtggctgaggattcctgaaattaggagcccaataaatggctactactctgtgatggtgccataaaagaggtttgtacagattcctcccttttccatgtacggtactgttactagctgaggtggttatgtttgtagatgtatccagcaaagtggatggatattttaccaaccattaacaaaatattttaccaccaaagtagtaaaattgggcaattgaaaattcccaaggaattgtatcagataatccctgccgcattgcaatttaataatgattaaatttgttaatataggtaaagcatttaaaactgcctcacacaaagcacccaaagggttgggtattattatcacttttacatatgcagacatatgttatatgtatgtataatattcaaatatatgtccttaaagcagatagtttcatataatgcatttaccataataaaaatgggaaattgatttatgagttctgagtatgactgtaatgaaatatttaacaaagggaaatcaaagataaaaagataaaagaactttgttttgcttcaactcttataacctattctctcctgattttaaacaaggttccagagataatttcgtagaagtaatatttgactactcctttttctgctaaaagcatagactttttttttctttttttttttttttgagagagagtctccctctgttgcccagactggagtgcagtggcatgatcttggctcactgcaacctccacttcctgggttcaagcgattctcctgactcagcctcccgagtagctgggattacaggtgcccgccgccacacccagctaatttttgtatttttagcagagacagggtttcaccatgttggccaggctggtctcaaactcctgacctcaagtgatccgcccgcctcagcctcccaaactgctgggattaacaggcgtgagccaccgtgcctggccctgaaccatagactttaatgacctaaaattgccatttggtttcagaatggacattctgtctgtctgtctgtctctcccactctctctccctgcttgtctctcttcaattaacttcttaggtaaattctcccttaaaatctcttgtcttggttttttttttcctggagtaggctctttggtgacatctctcataacctggattttttttcctgcagcctgtttgctttctaaacatctgaacttctcttcggaatgagagagcatcatgttgcagtgcactgtttcagtggataccaatacatctcttagcctgttaataagtagctttggtatcttaagcattaataattgtgtgtataggagaaagtggtcctttaaaacctgcagttggtaacttacttgctcatccagcttggctccacaaaggctttgattcttcaggtcccttgtttcctctgctcactgagactaaatactgatgttatcatttatcttcagtggtgcatataaggttcttttcataaatgtgacctgcacttataagcagaaccagtttattctgctttccaaatttttacttagagagggccaatggtaaaatgaagtgtaatatttctgtttctgttttcctagagtaaaaaacataaagcttatcttaggtcggcagcaattgaggaagaaagagagtctgaattcgctttgaggcccacgtttgatctaacagtcagaaggaatcacttgattgaggatgttttgaatcagctaagtcaatttgagaatgaagacctgaggaaagagttatgggtaaggtgtaattctcacttaatgtttttgctgctgagaaaagaaaaacataaaagaatgtggcaaagggtttcatagagaggaagttatcttcctttgccacagaggttgtttattttagggttcctctgattccctagttgcctttgagttttgggtgatagctgtgggcactcactcagtatgtttgggctaaggagcagcaggcaaagtggttgttctccccacaccctgctcaggtagatagttcagtgttggccctaagaggtccagtcccttctgaggtctggcctagcctggctagcaccacccttgaagggtttcaatgagatggttagcatagaggagaattaaggggttgtttttgttcttatgcaataacctaaattgggacaggcatggtgactcacacctgtaatcccggcgctttgggatgctgaagcaggtggatcacctgaggtcaggagttcgagaccagcctggtcaacatggtaaaaccctgtctctactaaaaatacaaaaatgaaccgtgtgtggtggtgggtgcctgtaatcccagctactcgggagggtgaaacatgagaatcacttgaacccaggaagcagaggttgcaatgagccgagatcatgccactgcattccggcctgggtgacggagcgagactctgtctcaaaaaaaacaaaaataataacctaaattgctttgtagaaaagagaattttctctttaaatcctacagttattttggggtataattgtagatttgaccatgttcggaagatctttaactgattttttgtttaattaccatataatttgtcttattagtaaatatttgatactgaatcataatgaccagtagatcttttgagtgctgtccttgtggcaagaactgttttaagtgccttatacctaattttttaaccctttcaacaacattatgtggcagattctgtttttccctcattttacagatggggaaactgaggtacagaactattaggtaacttatccaagagtaacccaactgataagcatcagaggatttgggcctggccattaagcactagactttctgcttaatgaagacggataaagattggcctgataatatttagtaaatggagtattttttattggggaccttagtttatcacttctcctactcagattaaagaaagattgactttaccaagtctcaagataccaatttaaaagcatattgccccagacacagtggctcatgcctgtaatcctagcactttaggagactgaggtgggcagatcacctgaggtcaggagttcgaaaccaacctgaccagcatggtgaaaccccatctctactaaaaatacaaaaattagttgggtgtggtggcgggcgcctgtaatcccagctgcttgggaggctgaggcagtgagaatctcttgaacccaggaggtggaggttgcagtgagccaagattaccccactgcactctagcctgggcgacagagcaagattctgtctcaaggaaaaaaatatatatattgcagttagagttggtatttccatgtatttttgcacacagataattgtataactctaatggactcgttatgtgattctatgctttgccagtcagtctactcgattatttgagttccacttttatatattgttcattcagtttttaaattcaggtaacactcagcatttaccatttgcaggctctgtgtgaggcattttacatgtatgacccctgtaatctttctgataatcttgtgggaaaactgaggttttatgaggttgggcagcttgtccttagtaagaagagggggaagggtttgacacctggtcttgctacaaagatttttagtatttcactatttcaccaagaggaatggaagaggcagcatctaaataaataaactggtaagaggagatttctggggatgctagtataacatctgggtagaaatgttgaacaggccgttggaagtgactgtcaatcaggagagaaaatgcactgaatctgaaggttaaatacgtatgggtggtaaacaaagtttaaggagaaaatgagcatccagggaaagaacagagagaaaggacagaagtgttaggatagaactgtctgcaattctgtttctagaaattaagccagcaggaaaaagaagagataaataaaaccgtgaagagtgcttcataggagaaagcaagggagaagattgtgtcaaggaaaaggacatgatcagaagtggaaaatgagttaacgaaatcaaggagatgagatatgagaaaaagtccttggagcttggggatttacagttcttgttcttcttggagagacccatttaagtggagaagtgggtttggaagttggcgtatatctctgaagtttggcaagagtggaaggagcccgtgtttgtattggagacaatgtgttgggattttttttttccttttaaggttaagggggaccttaacatgtttgtgaatggaagtgaaggattccaggaaaaggcaggaatggaggggtgactgaaggagcaaagatgggttatgatagcatcctcttgggagggattggtgtcagcagtaggggtgcagcctcctcggggagcaaacagccacttcagcaaacaccttatgtgtgctctggttttttgaatatcctgatttttattatttatttatttatttttgagacagagtctcactctgttgcccaggctggagagcagtggtgcgaccttggctcatggcaaccttcatctcccgggttcaagtgagtctcctgcctcagcctcctgagtagctgggattacaggtatgcatcaccacacccagctaatttttgtatttttagtagagacggggtttcaccatgttggccagactggtcacgaactcctgacctcacatgatccgcccacctcggcctcccaaagtgctggcattacaggtgtgagccaccacgcccggccaatttttatgatttctttctgtttatttttattatacttggatctggtgactataatagtgatgccagttgaggtcaatttaggtaaaacttttacctaaagtggtaaaaactttaggctctggggtttgactgataaaggattaaatttaggctgtaggccgggtgtggtggctcatggctgtaatctcagcgctttgggaggctgaggtgggtggatcacttgaggtcaggagttcaagagcagcctggccaacacagtgaaaccccgtctctacttaaaatacaaaaaaattagccaggcgtggtggtgcatatctgtaatcccagctactctgggggctgaggcaggagaatcgcttaaacccaggaggcggaggttgcagtgagccgagatcagaccactgcactccagcctagacaacagagtgagactccatctcaaaaaacaaaacaaaacaaaaaaactaggctgcaccacctgactattgtataaacttggaaaagttatttaaattctcaaggcctcgttatctcatagaattaatgtagagattaaatatgataatataagtaggatacttacctcagtgccttccaaatacttgggtccacaattaatgttagctatttactattattaaatgagacttcatatatagcaatatagagccctggaagtgatgtattatttgctctgtttcctcaggtttcatttagtggagaaattgggtatgacctcggaggagtcaagaaagagttcttctactgtctgtttgcagagatgatccagccggaatatgggatgttcatgtatcctgaaggggcttcctgcatgtggtttcctgtcaaggtaagttccctcttctttgcttaaggtattttgcgacagaaaaagtacaccatataccatagaaaattagtttgtctagactatttcatgttagaagaggagtattgatataattatggagataatgtataattctaataaggtgattattttctttaaaatggagtttccttttcctgggttcccatgtctgttcacatcgaactcaagcaatatattttttgatcatttatataatgcatggattaaaaaggaaccctctcttttttaggtactcattctttgtgtcagttctgttttcctaatgaatttgaagacaaaggctgtggaaagaaattgtgaaaactagtttataaggattactgaacctaatgtatttttattgctggtatgcttttaggaaccaaaactgtggcagggatttatttggttttttatttgtttgtttgttttgttttgctttatttttgagacagaatctcactctgtcacccaggctggagtacagtgccatgatcttaactcactgcaacctccgcctcccaagctcaagccattctcttgcctcagcctggcgggattacaataactgggattacaggctcctgccaacacacctgggtagtttttgtattttttgtagagatggggtttcaccagtttggccaggctggtctcaaactcctgacctcaggttatctgtccaccttgacctcccaaagttctgggattacaagcgtgagagtggcagggatttaaattgacttaatgaccaaatattaggttggtgcaaaagtaattgcaggttttgcctttacttttaatggcaaaacctgcaattacttttgcaccaacctaatataaaccctaaacattcttatctcaggctttaaatttttcaatttgagatttgattttatgaaagagaaacaaagatttatttaatataaatatttcattgtactggtaaaaactcataatactttaagatttttttttcgcttttcagcctaaatttgagaagaaaagatacttcttttttggggttctatgtggactttccctgttcaattgcaatgttgccaaccttcctttcccactggcactgtttaagaaacttttggaccaaatgccatcattggaagacttgaaagaactcagtcctgatttgggaaagtaagtaaacagagttcctgagaaaggaccctttctaacatatatttaggcaaatatttaagtacacacgcttcataatatttccatgttcaacagcagcattttaggtactttagaccagttttaactttgacaagaattgttggatgataatttcgttttctaaaattaggaagtgttgattattcccataactagacttcaatgtttgcattaatctttcaactttttctgtgtaggaacagtcatgcacagagcacaggttacaccttggtgcaaaatctgctagtgatatttatgttaaatgttgtttcatgtcatcacctttaaaatggaaacttatttctaagttaaaagacaagccaccacctcaccaaaaaatggcaacagtaaaagggttttcatatccctgctgtgtaaagcattcctacacatccgtaagaaatattcacaaagtatccaagaaggcaacctggcaaagaagcaatagaaatgcttcctaaataaaaatgtcttcaatctcaccagtgctcatagaatgcatattaacgtgagaggctaatttatacttcaagttgacagtggtttgaagtgttgatgctatatagtattagcaagggcttgaaaactttcattttaatttcaggtattattcgtggaaatataaattggtactccttttcagagaacagtgtggcaggacttagcaaaatcaaaacatatttgccttttcaactcaacaattctacttctagacatttaactttcagaaatacacaaccatgcaaggatcagtgtatagtaatatatactgtatttatagtttataatataaagactccctaaatgtccttcactaagggaatgatatatttttggtatacttatgcaaatggaatactacagagatttttatttttaaagagtaagaacaggccaggcatgatggcttatccctgtaatcccagcactgcggggaggctgaggcaagtggcttgcttgagcccaggagtttgagacctgcctgaccaacacggcgagacctcatctctacaaaaacaaacaaacaaaaacaacaaaaattagctgggcatggtggcacatgccaggaggcacacctcagaaggctgaggcaggtggatagattgagctcaggaggtcgaagctgcagtgagccgtgatcataccactgcactccagcctgggcgacagtagaagaccctgtctcaattaaaaaaaaagaataagaacagtaatatgattctagtattattatcatccctcttttacagattcagaaactaaaacacagaaagattaggtaacttgctcaaggccccataatggcagaacgatgatctgaacacagtctggctccagagtctattaatcgtttatactaactgtactaataagacaaggaaaaaaaaatcaaaagcacaagatttagaaagaaggagataaatttgtcattattattttactggaaacatcgaagataacctaaataataattatgcctcaaaagactgataattaacaatgtacatgaactaaaagatctttaaatttgtatcattgtttctcaaacttttaggtcttaagattctcttaaaaatattgaggactccaaagcgcttttagttaggttggttacatctgtcaatatttacgggattagaaattaaatattttaaacacaggaatacacaaatatctgttagcagagcattccacaatatcatatagcctcatgaaaactcttctgtttactcacagcagaatgtgaaaataggcaaataacatcttaataatgttatgaaaatagttttgacctcatgaactctgtaaaggcccaaggattcccaagaattgctggtctggctcacattttgagaaccagtgatctctgtgttcagtaaaactcaattttaatcccaggaggctttttattaaacttcacaacctggttctaaaatttatatggatgaacaaagggtcaagaatagccagaaataattcttaaggcaaataaggatggagaacttggtctgtcagctatcaagaattattagaaagctgtattagtcaggacagtatgatgtatgatattggtgcaggttttccgatagaacagacgatagagctcagaaatggacccatgcctatgtggaactttattagaggtgacatatttgatcaaggggaatagcagtactactcaataaatggaactggaaaaaaatgatatctatctggggaaaaaaatgaaagtagatctttgtcttatgccatacatgataatcacctccatgtggatgaaggatttagatattaaatgcaaaaatcatgaaaatacaggagaatgatctttctcacctttgagatttcttaaacaagacatgcagtgtaccaacagtaaagaaaagatttaatacatttaattgcaataagattaaagaacttctttcttcatcaagagggtgttagaaaaatgcaaaagggaaggtgttgtcagggtctgaatgtgtcccccacaaaattcatattttgaagcctcatccccagtgtggagccctcatgagtagaattcattcccctatgaaagaggcccaagggagcctgttcgccccttccaccatgagaggacacagaggacaccattgaaaaggaatgggtcgtcacctattccctttagattcagacaccgaatctgctggcactttgatcttgtacttccaagcctccagaaccgtgagcaataaatttctatttatagattacccagtctaaggtattttgttatggcagcgtaaatggactaagggaaattgctaccaagaagtgtggtgttggaagcaactttggaactaggtaattagtaagtagtggaagagttttgaggcacatgctagaaaaatcatgtattgccctatagagcagttctggcaagggctcagaagaagaggagacctctagagaaagccttggtcttcttagagattacctaagtggtcatgatcagaatgttagtagaaacgtagacaataaaggcaattctgatgaggtctcagatggaagtgaggaacacattggaaattggaggagaggtgctccttgttactatataaagtggcagagaatgtggctgaattctgttgtatcctagtgttttgtggaaagtcagattcttaacaatgaaataggatatttggcagaagcaatctctaagcaaagtggtaaaggaacaatatggcttttcttgactgcttataccaaaatgcaagcagggagaattatttaaagtggaatttatcattagaaaaaaagccaaacttaaagatttggaaattctcaggctggccatgttgtaaagaatgcaaacgtgtttggaagagagcaccaagggtatggccaggtgactctttttattaataaagaggttagtgtggatgggtggaagcctggtgctattcatcacgacaatggaagaatgatcccaaaggcatttcagagatcactgggggctgtcactcccatcataggccctgagtgccaaggcctggaggacagaactatgtcaagagtggctttgtgtgcccacaggacctggacatttgatgtccagcgctgcctcaagtccctactcattgcattctggcacagtgctcctcagctgacccaggtgtgactccagtggccccaggtgtggtgtggtcacagtggctgtgccatctctgctggcacagagtgcacaagctgtggggccttggcttctcccacctagatatcaaaggatactccacagagccatggggtccaggcagagaactggcacagggttgaggcaactgcagagagcccccactaaggcaatgcctagtggagtcatgggagtgaggctgctctagagacccgagaagagccaccagtgtgcagttccagcctgagggagaatcaaaagcacccaacactaatgtgtgagagcctctaggggtgggctttgcccagcaaagtcatgggtgtagggctgcctggaaacttaggagcccaaccccaaacccagtgtgtcctgaaagtgggacattgagtcaaagattattctcaagccttaagatttaatgttgcatgccattttgagttttggacttagttgggacctattacccctttcttatttctgttattcccttttgaaatgggaatgtctatcctatgcctgttccactgttgtattttatttaatttatttattttgagacagagtctcactctgtggcccaggctggagtgcagtggtgcaatctgggctcactgcaacctccacctcccaggttcaagcgattctcgtccctcagcctcctgagtaactggaattactggcacatgccaccatgcctggctaatttttgtatttttagtaaagatgaggttttgtcatgttggccaggctggtctcaaactcttgacctcaagtgatccacccgcctcggcctcccaaattgctgggattacaggcgtgagccactgtacctggcctaccattgtattttagaagcaggtaacttgttcgatttcacaggatcacagctggagaacagttcaccgccttccccacaaaaacaaaaacaacccacaatgaataaaacatggtctgttacttcacaatacagtaatttaaaaacccagtggggaaaaaaaatcagttcagattccaccttatcccagaggcctttcccaatgtcatgtatcccttcagaaaaatttaactgtgctcttttaagcctatacctgtgtgatttccatagttctctggctgcacatacctcactgtattgtaggtgagactcccatcagcatacctcaccttcaagtcccagagtattggcagtgatatcttagtctcaactttacatcccctatgcctgctatagtaggggctacttaaatgtttgttaaataaatatttgagtgaatgagcaaatacaatgagatgtgttatttcaaaagcatgtataaagcatcataggatgataggatggaaataatttaaaaattggttactgtccattttgatgtgacctctattctcacaaatgccctgaaattattaaggtagtctaatttcaggtgtttcttaagcttgatgatattgggacaagaggtgcagagaaggtcctttgacccacctcagagttactgatacctgaaatttaatatgagacctattctgtaagtaaagttcaaaagcttcaataaaggtaacaccagtttgaatgaattcactatcagtgaacgttagaatccttttctaaatagaaacctacaatcattaggtagggaatttaaggtaaaggaacaagagctgtgaagcaggcaggcagcctgcagaaatgcagacaagcttcttaaatttgacatgtttagttgaggtctggccctgtttagactatcagtacgcagagaaagaggtgctgtgaactatacctgacctcataccttcagaatagctatacacttgacatttattttagatgctgtgtctagtgatcatggttattacctttttaaaagcaagattattttttccttaggaatttgcaaacacttctggatgatgaaggtgataactttgaggaagtattttacatccattttaatgtgagtaacaataaaagcagataacagattagttttaatctgattaaccctttacatatttaactaaacatgtcaacttttacttaaaaaaaaaacctgaataaattagtgaaaaaggtattgttcttcatcatgatctaggtgcatcagttagattttactatgtaacagccaaccctaaaacctagtgccctaaaagaacaaatacaattttgtgggtttctgaactgggccgacttggccaggctggatggtctacagtggtatcactcacatgcccagtcactggcaggctggttgggttatagggtatcagctggaacagcttgtctctgttccctgtggtctttcattctccaataggctagctgaggcttttgaagcaagactgcagtctttattcttcacatggtggccttagggttacagagaggaagcgatagcaagccccaccacacatgcttctgcttctgtcagatcccattggctaaataaagtacctcacatggccatgccgagattcagtggctgaagagatagcctctccccttgattgcaagtgttgcaaagccactaggcaaaggggcaggagaactaggatgggaagaattcatggccatttttgtaaatctaccatactgggtctatgctgtatgaagtgaatactgagatgtagcaattttccaattaatttgtttaatttgatcagttaaaataagagaattcaagctttgaaaaaatttatttttattcagtatgatagggtgtaattttttgtttgtacattccttgctagcttttatgacaaaaatgtacattttaacacattctttttagaaagtatgctccaaagtgtttttattgatgatagattgttcagaattatgttggagatattatctgagttcatttgcggttacaggtgcactgggacagaaacgacacaaacttaattcctaatggaagtagcataactgtcaaccagactaacaagtaggtacaaaaaatgaaatagttggtttgtatatgtactatttttattttactgagctctaaaaattccttttagctctttaatttttcattctcattaatcatttttcactaaggcagagaagttggtgtgtgttgtatgtgttttgacatatatatcatggagtttatattgtggtaaggaatggaaatggctttctcagagagacctttctatttcctcctgtccaaaattacaacaccaacatctgtccctctttatccactcgttctgctttttcttttcatatcacacattacctacctttagggtttatttgcttatttatttctcattgtttctccaatgatagtgaatgcggcagggacttggtatgtattcttcaccgctgtatattcagtacctagagtagtctacagtggtgcctgatacattgcaggcacatagtaagtatttgttgaaaaggttactatgatattttgacttcccaacatctaatggaatgccatttaaagccatggagtttggaattatagaaccttcccttgatagttggtcagagtggcaaagagatctctaggaagcgtgctggcctacatcacatctttttccacgatttcttaatctttttttttaaactttgtattgaagtataacctatataacagaattttgcacaagtcataaatgtacagtttagtgaatttcacaaagcaaacatgcctatgtaattactgccagatcaagaaatataacatttccagctatatagttgtgtattgtatgaatatatcacagtttatttatctgtagaattttttttttcttttgagatggcacctcgctctgtcacccaggctggagtgcagtggcgcaatcttggctcactgcaacctccgcctcccgggttcaagcgattctcctgcctcagcctcctgagtagctgggactacaggcgcccgccaccacgcccaactaattttttgtatttttagtagagacagggtttcaccgtgttagccaggatggtctccatctcctgacctcatgatccacccaccttggcctcccaaagtgctgggattacaggcgtgagccactgcgcccggcctatctgtagtatttttgaccgacatagtgtatttcaagttttggactattatgaataatgctcttgtgaacattcttgtacatgtgttttgtttatgtgcaggcatttctgttggtatgtaactgggagaagtgcttggtgccttgtggttgccccttgctccatgcaggcagaatcaatgctcctacctgaaattcatttggatattgatatggatgatgccatatgtaagccagagagtatgaaaatgtttagtacataatggggctttttggggagagctgcacaggcatccaagctgatctgtttggcttaagtgaagagagaggcaggtggctttagtttttatggtggttccgtggggccagggtcagggttctcatgcaacccagagcatgcgtggggaaatttaagccacgcagccatcagtgggtgcccagggagtgagcctgtgttgtgcagatttggaggcgaaaggggaaaaaggaggagtgggacttgaaagctgttagtaagcaaacataaaaaatggaggcacactttcatcagtagggtacgacagttctaattgctctatatccactctaatagtattactagtcttttttaaattagccattctggtgggtatatagtagtattccattgtggttttaatttgcatttctctgattactaatgttaagcactttatatgcttattggctgtttggatatcctcttttcagaaataattattcctcatctttagtctatttttctgttgcttttttttttcttgtcagtttatgagagttctagatgcaagtcttttgttggttatatgtactgcagatatcttcttacatactgtggcttgtcttttcactttttaaatgtgtcttttgattaaccaaaatttgtaattgtaatgtagtctactttatcaatattttccttaatgcatagtgtttttctgttttctattttatgaatacttccctatcctagggctatgaatatattcccctgtattttcttctagaagcttatcattttatttctcacatttagatctatgatccactttaattgattttttagtaagatgcaaggtatggatcaggttttattttttcaatttttgaaactgattatactgaacctatagatcaattttttgaaaaaattgacatcttaaaataatgaggctttaatccatgaatacagaatctccatttgtttaaatcgtcttttgtcattcttgaaaaaatgttaggtagttttctatgtagagatcttgttgcaatattctaaataggtttcttggatcatttattgtatttgaatcttctctgtccttaaaaatttttttgtctgcttttctgttagttactaggagaggtatattagcatctatactatacatgtggatatgagtgtttctttaagtttcgttattactaagcacataacagatttttgaattgttttaccttcctggtatatgactcggttgtcattagtaaatgtacttttctatccttgtcttgtttgtctgattttagtatagttacaccacattcattttggttgatgtttgcatagtgtatctttttcccttctttgactttaatctgtgttttcacatttaagttatatatgttataagcagcatatgatggagttgttataaaaattacattagggccaggtgcggtggctaacgtctgtaatcccagcactttgggaggccgaggcaggcaaatcacaaggtcaggagtttgagagcagcctggccaacatggtaaaaccccatctctactaaaaatacaaaaaaattagctgggcatggtggcaggcacgtgtaatcccagctacttgggaggctaaggcaggagaatctcttgaacccaggaggtggaggttgcaataagctaagatcgcaccactgcattccagcccaggtgacagtgcgagactccgtctcaaaaaaaaaaaaaaattacattagataatctctagtaactatgacagtccatggcacatggtaggtactcaataactgttaggtattctagcttttatttttagcccctcaccattttgttcaggatattgcagtaagtggaaataacattttgttttattaaaggagagactatgtttctaagtatatcaattacattttcaacgactctgtaaaggcggtttatgaagaatttcggagaggattttataaaatgtgcgacgaagacattatcaaattattccaccccgaagaactgaaggatgtgattgttggaaatacagattatgattggaaaacatttgaaaaggtacatcatcaagtctaagttgattaaattcagttttccttcctatttcctcaataacttttttttgtattttctctagaatgcacgttatgaaccaggatataacagttcacatcccaccatagtgatgttttggaaggctttccacaaattgactctggaagaaaagaaaaaattccttggtaagtattatatcaaggaatagatctgtaatcgtatgtctttttaatgggataaaaatttcctttatgataagtaccatttgcaacagatcatagtgtcagagctacgcctagtccaactgaacatcctctgtgtcccaacatcaaaaaacaaatgttaatatctataagcaatcttttcccctgtgatttcatcccttcttattgcttttaaagttttcgtttcttcatccaagctaaatatcaagccttctttctgtagccctgtcatcattcacttattcagcctttttgggattaactaaaatattttatttggctaatttttactgttcctatattattaatactatatttgctattactgtacacagctattttatttgtatctttaggcttaatgactttctcattttctatttccttacttttgagaaatatttatcttctatttttatttttgtggataacatgtatgttagaagatattcagacttaatagaagcccaacctacctttccagtcttaactcctagaggaaatttttgtcccaaccaaataatcccattgtctgaacactcctgagctcaccttgcaccttcccacctccaggcctttctgtgaagttccttctcctgccttgaacctcacctacctccttgttgcctttctaaacctttccatccttaaaggtccggcataattctgaactcttggaaatcccctcagtcatcccagcctggctctctctccttattctcaagcatagcattgactcaggaggcacttaactccatgacacctcttcgggctgtcttataccttacagcttttctcttgctattatgtgtctttttcttcacaagaatctaatattcccagtcagactttaagctgcttgaggacagtgactatgtgtcagacattgttcgaatacaatccccaatgcactgtcaaatgtaggacactgcacatgggctccagtgaagttttgtgaataaatagatttttttctctgtaaagagattttggtctccatgtaaaacagattgcctaattttattcttctttttagtatttcttacaggaactgacagactacaaatgaaagatttaaataatatgaaaataacattttgctgtcctgaaagttggaatgaaagagaccctataagagcactgacatgtttcagtgtcctcttcctccctaaatattctacaatggaaacagttgaagaagcgcttcaagaagccatcaacaacaacagaggatttggctgaccagcttgcttgtccaacagccttattttgttgttgttatcgttgttgttgttgttgttgttgttgtttctctactttgttttgttttaggcttttagcagcctgaagccatggtttttcatttctgtctctagtgataagcaggaaagagggatgaagaagagggtttactggccggttagaacccgtgactgtattctctcccttggatacccctatgcctacatcatattccttacctcttttgggaaatatttttcaaaaataaaataaccgaaaaattaacataa

SEQ ID NO: 2502 - DNA, 64358 bp, Homo sapiens
  source 1..64358: mol_type = genomic DNA
agcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcagggcgcgcagcgcggggagctgccaggtgagcggggggccccaggtgcagggtgtgaggaccccagtacatgggcgcgggggcttgggtaccgggcgcagggaaccgggtgcggagcgctgggacccgggtgaggggcgcgggggcccaggtgcagggagcggctcagatgctgggcgccgcgggccaggcagggaggggtgctgggagccttggattcctcggggcccgaagagccacaggaaccaggaaaatggtgccctgtgctaccgaagagcaacttcctcagtttcgttttcccaacgcccctcggatttgtttcggtttccaattcaagttcaaagcgaaactgagagccgaaactaacctggtcagcgctgctctggaaagagatgtggtccctccggcttgccttgcagataaatcctcgcctgcgcggttctacctggagaaggcagcctgaccttacaaacgtggtttgtgggtcagacacctgtatctcccttagaaatacactggggcattaaaaaatatatatatataaaaatatatatataaaatatataaatatatataatatataaatatatacaaatatataatatataaatatataatatataaatatatataatatataaatatataaatatataacatataaatatatataatatataaatatatatataacatataaatatatataatatataaatatatatataacatataaatatatataatatataaatatatatatagcatataaatatatataatatataaatatatatataatatataaatatatataatatataaatatatataatatataaatatatatataatatataaatatatataatatataaatatatataatatataaatatatatataatatataaatatatataatatataaatatatataatatataaatatatatataatatataaatatatataatatataaatatatataatatataaatatatatataatatataaatatatataatatataaatatatataatatataaatatatataatatataaatatatatataatatataaatatatatataatataaatatatatataatatataaatatataatatataaatatatataatatataaatatataatatataaatatatataatatataaatatataatatataaatatatatataatatataaatatatatataatatataaatatatatataatataaatatatatataatatataaatatatatatataatatataaatatatatatataatatataaatatatatatatacacataataggccggacgcggtggcttacgcctgtgatcccagcactttgggaggccgaggcgggcggagcacgaggtcaggaaatcgagaccaccctggccaatatgatgaaaccccatctctactaaaatacaaaaaataaactgggcgtggtggcgggcgcctgtagtcccagctacttgggaggctgaggcaggggaatcgcttgaacccgggaggcagaggttgcagtgagccgaaatcgcgacactgcactccagcctggcaacagagcaagactctgtctcaaaaaacataataataataaatatatatattatatatgtgagataatacaataatcgttatggattattgtagaaatacgagaaagcaatcaccgtagctccaacacccaaagataactcctaacattttgatgcattttctccttgtctacttttttctatgtacatatttaatctttataaaaatcatgtcattatagatttgtatatgcagtatttatgcaactctgtacattgtgttttcatcaagcataatcttatgaacatattaccctttcattttgtatgttttgaaaatatgttttaaattgctgcataacattctaaactctgagagtaccataattattctctttttgtggaaattagattgtttcccactaggggcttttataaataatactgattgatattctcgtaagcaaatatttgactacatttttgatgacctgctgagaatagtttcaaaaggtgtgtggaggaggaaaatttttcctctaccctcttaggttcagcggctgggtcctgcaaacttaactgacaaaagacagattgacaggagaaaaagcatacaattttattaatcttttacatataggggaatttacatgcgtgggaatttacagaatagaagtgaaactcaagtgcttcgacttaggagcttgtgtaccatgtttaacaaagaaaagggggtttggactttaaaggatgatgaactcagggaaagtgactagaaaatatatgggaaaatctaatggaagataagggttattttaattgacttgtttatgcaggctcacctcagtgccaagtcttcatcttaggtgacccttctcttcttttttttttttttttttttttgagatggggttttgccctgtcaccaggctgtagtgcaatggcactatctcggctcactgcaacctccgcctccccagttcaaacggttcttctgcctcagcctcccaagtagcagggattacaggcactcaccaccatgcccagctaatttttatatttttagtagagacggggtttcactatgttggtcaggctggtctcaaactcctgacctcgtgatccacccgcctcggcctcccaaagtgctgggattacagttatgagccactgcgcccggctgacccttttcttggtgccagagatgggagcttctcacaaaaggatatttatgacctacttttaggtagataagaagagagcagagacctcttcctgcatctgttgattctcaattgccttcagctcaaattcttaaagtagcatgttttcaggtcttatcaccctcatttggaaatgaagggcaacatgatacttaaccccaaattgttctctagaaaaatggtaccaatttctatctttgtgagtgcatgaatctttgggaaattttaaccttgcataaattgacagtaaatagttgaaaaagataagattacaaagataaaaggaaaaacaaaatcttaaatgttgcaaaaactttactggtatgatgttctcaactccaaacctctaataattcagagacagacaccttgggaaagcagtttaggttggcttgtagggaaatgtgatccggttttcatttgtgggcatatttagggcctccataggggcatatttttcacttttcattgtaagaggatccagcatctgcctctcacactcatgaggtaggctcccttccaatttccttctgagcaagggattcactgctttcagtgtttagggtgggaagacagaatagcaaaatggaggagatcccaacttttttctgggtctctttattttgctaggttttgctagagaaacatttggtcatgtgtcatagtccctagaagttaccccctccgtgatgcctactcctttaaataacagccattaaaagatagacttgggtaattgaatgtttttaagagtcaatttgaacattcagcagttcatgaattgagcagcaccagacctcaagcagttgggctccactaagggaggtgcaaggagatgccagggggaacctttgataacgtgttccaggaagcaagacaaagaaaatacttgattggttaaagtggaaagtcccttgtttgaagtagtcagcagtttctggttggtaaagtctctagttagatgttagttggtggtttctgattggttaaccttaagtttcattttcctaggctatgatcaatcactctgagttgggttttggtttgcttaggtaggaacccaaggtgctggagccatctcaacctgatagtctccctgttgattattttaacagagctgtatcctataaagacagggtaacatacattgaatttacttccttcagacatttagaatggacttaaggtcttgattcaaaagaccattggaggagacaagaaatctggatgatccttctttttgaagaaaagtgctgtcttaaacttgtgttaaattaataatctgcagtggtggttggggggtgttttgttttgtttcccaaagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagtaagtgtttcaacccactccttcatttattcaatatatatagtaccatgtgccaggcactgtgcaagatgccaggatacaaagacgactatgacaggccagctgcagtggttcatgtctgtaatcccaacactttggaaggctaaggtgggcagatcacttgaggtcaggaatttgagaccagcctggtcaacatggcgaaagcccctctctacaaaaaagacacaagaaaattagccgggcatggtgtcaggcacccgcaatcccaactactcaggaggctgaagcgggagaatcgcttgaacctgggaggcagaggttgcagtggtgctgggacagcgccactgcactccagcctgggcaacagagggagactcagtctcaaaaaaaaaaaaaaaaaaaaaaaaaaaaaagactatgacaaacacagttcctaacctgaaggactacagtgtagtgagggaagaagggaggaaaaaacctacaacaccaattattatttaattagagcagagtgaaatgagatgtgaccctttgatcttaatcttatctcttggaatataactgtgggggccaacttagacctccagagtgggtataaagaccactgtaaagtagaaacatttgagctgcaaaagatacagatataaatcttacctgaacttcctttatcatactaaaacagagcctcctgaaaatgcagttcccagtaacttccttgagtgagagtttcctgggaattcagttgtcattaagatagaccacccattactattaccatcaaaaagcccaatagaaccttctatactttcccactgaagtcccaaaaccccgccttttattaaggtgacatatataaaactttactttgggatattctgcaatagcgagcatgcttgtaaataacctttgtcttttctcttgttaatctattgtcagttaatttgcaagcccccaaatattggaccaaaggtggaagagaagtttttttctcaacacaaccttttggcttgtcataaaccactgggccctaacattttacttagtaaagtggagggaaatatcacatttcctcacaaacaacttcccaggacagatatgacaagtagttggctctggattatgtgtttatgaattacatacttaggggattttcaaacgcatgctttttaatattaggaaatcacctcttgttacctcttctggtcattaaattctagaagagatcaatttgacttggggaaatgagcattgaacttggaatgaaaagaccagaatttgagtctggttctacagcatcataactatttgacctctttgagttccattagattcaccttatgaaattgctcatagtggccaggtgcagtggctcacacctgtaatcccagcactttggcaggccaaggtgggcggatcacctgagatcaggatttcgagaccagcctggccaacatggtgaaacctcgtctatactaaaaatacaaaaaaaaatagccggacgttgtggtgcatgcctgtaatcccagctacttgggaggctgaggcagtagaattacttgaacccgggaggaggaggttatagtgagccaagatcgcaccactgccctccagcctgggtgacagagcaagactccgtctgtgaaaaaaaaaaaggaaattgctgatagttatctggttttgatccacaaaaatggcaattttgtatgatttaacctaatgatttcttcattaaattagggcttaaattagatgatgaagttgttggtgttctataaattctaaggccctatactatatatgcagaaaaaatttatttctcttttaggctattaagtgtagaataaaattagtatattagatattgcattaaagtccaatagcaatggcttttgcatttatatactgttttggattctgtcctataacttggtacatgttaatgtcatgttaaaaacagtttgagggctttgaaataaaggtactatagaaatacaagaaaataaaatagttttcctggaccagatgtattatttgagatacttttaaatatctgtagtccaccggacaactcgctctaaataaggattaatcaattttgtattatttgtattataggaaaataatgactctgaatgatataaaaataatacaagtttcctgtggacactaccactccctggcattatcaaaaggtaagaaacactttttggatctgagtgtgagtaggaagtaattttttgaataggaattatagctgctgatttttaatgcactggggttcatttagaagtttttcattccccaggtttcataagatatattgttttcctatttttttctcaaatttcttggtcctaattatactctaaacagtgcctaattcatagtgccataaggggctgtctctggttatttgacctaactggccaactctctcagagcttagtagtggctttatttccagccctttgctctttatgctgaatggcctgtccacactggcagacttatttgtctatttcacttagatcaaagaaagagaagtcaaggtgtcaaaatcatgactctatattttttctttttaaaaatttttacttatttatttttattgacacataacaattgtacatctacactttttctaccaacctccaccctcctttgtccaccctcaatccaaatttctcaatggagagtctgaaggaggaaaaatttttcctctaccctcttatgcgtagtctttgggaacctgcaaattaaattaacagaagacagattaaaagagaaaaggcacccaatttatcttttttcttttctttttttttttttttttcttttttgagatggagtcttgttctgtcacccaggctggagtgtggtggcacgatctcagctcactgcaacctccacctcctgggttcaggcgattctcctgcctcagcctcccaagtagctgggatcacaggtgtgcgccaccatgcccggctaatttttgtatttttagtatagacgaggtttcactatgttggccaggctggtctcgaactcctgacctcaagtgatccacctgccttggtctcccaaagtgctagggttacaggcgtgagccactgtgcccggtccccaatttatattaatatttttgtgcacaagagttcacagaaaataagtgaaactaaaagtagtggttagactcaggaacttacatactgttttaacaaaaaaagggagtttgggcttcaagggataataaattgtgggaaagtgactaggaaatatatagggaaaccaatggaagatacgggatattttagtaagattcgtttctgcagattcatctcagtgctgcttcattgtcttcagtgataaaagttactcttctctccctggtacagtagagtggagataactccacaaagggaaacttatgccttgcttttaggcaggtaagagaggggcagaaacctcttcctgcatctcttaattctcaattgccttcaactcaaaacaatccttatgccaaagtagcatattttggtgtggcatatcctgacccccttcaaaggactataacatttgtatgttcctcaggtaatgtcttatgtgtcattgcaactgtgccatggtctatggacagctaacatttattggtcagcttctatgtgccagctgccatgttaaatgttttatgtgtgttttttcacataattaccttacaaacacatgaactgggctgggcatagtggctcacacctgtatttccagcacttagggaggctgaagcaggaggatcacttgaggccaggagtttgagaccagcctggccaacatagtgagatcctgtctctacaaaaatttgaaaaattagctgggcatggtggtatgcacctgtagttccaactaatcagggggctgaagttggaggagtgctcgagctcaggagtttgaagctgcagtgagctatgattgtgccactgcattccaggctgggcgacagagtaagactgtttctgaaaaagaaaaacaaacgaaaacaggagcagggtatgatttatatcctcatttcagaaatggaaaaaattgagttcagggattttaaattatttacccaaagttacacactaagaaacagaatagtcaggatttgaacctatagtgtttaggtctcaaccctaagtgcttaactactacgctgcactgactacaaatccagggcatatcccgtggccattgtgtgattccttctacctgtcatttctagctgtttgatcatgggcaagttatttaacttggctgagtctcaattttctcatctgtgggaatattgatacctaacttgaaggttatttagaagattgagtgagagaagataccctgtataccttgtacagtccttagcatatagcagaggcaccataaataggaacgtcttttcctttctcacactccttcttaattatggacatggtgtgaattctttccttggggcactgacttgcctttgcattggtctggactgtaaagtctgggcagagcccaggcattcaatgcatttgctatggtgaaaggtgagttctcatagaccttcgtgagagtttaacgttttgcattttgccctcaaaattatttttagtgttagaaattaactttagaagagttaaaaaataaaagatgtaataacttattaaaaaatctctgagatatgttagcatttcactgggtatatacttaggcattagataagcttagattagattttttttttctggctgggtgcggtggctcacgcctgtaatcccagcactctggaaggggatcacttgaggccaggagttcgagaccagcctagccaacatggtgaaaccctgtctctactaaaaatataggctgggcacggtggctcatgcctgtaatcccaggactttaggaagccgaggtgggtggatcacctgaggtcagcagttcaagaccagcctggccaacatgaggaaaccccgtctctactaaaaatacaaaaattaaccgggcatggtggcaggtacctgcaatcctagctacttgggagactgaggcaggagaatcacttgatcctgggaggcagaggttgcagtgagctgggattgtgccattgcactcaagcctgggtgacagagcaagactcgtctcaaaaaaaaaaaaaaaaaaaagacagattaataggagaaaagacatattaatttattaatatgcataggggagaaccatagagcaattaccccaatgctccaatggggtagagaagcttatataccatcttgaggcagaggtggtcctgttgtgtagatgaaggcttacaggtagcagccctcaaagagaatagatggtgaatgtttcttccagacctttagaggtgtgggactctcagttaatctttcctagatcagacacgggagggcctcagagaaagcctgcctgcatcaatgcagattttctgtacaggtgcaaatctcccacacaaaagacagctttttagctatgcttgcacttccagccctactgaatagccatcttgaaatatgttaaagaagtgggatgagatatattggtttggtaccccttcaagagtaaggggacagagagtgagtacctgggtggaggaaaggagtctttctagtttatgaggcggtcagggaagatatctctcaaaaggtgacatatgagcagaaaccaaatgaaaagggagggagagataggatgctaaccatgaaagaattacccagacacaaaggccatggggttggggcatgctcagaagtgtactccaggaatagcaaagggtcttgagaggagtgagcagggggagatgaagtccgggaagtgggggtgggccagactggtgatgtggggtctgtgatgggagttggtccgtcattgagtgagacagcaagctcctgaagtattcagttggacttagatttttaaaaggatcactctggctattctttggagaacaaactgatgggggcaaaggttgcctcagggagatcagtgaggtgctattgtcattttttaggagagaaaagttggtgacttggctaaggtggtagcagtggagaggtgagaaatggttggattctggatagattttgagggtagaagttttgaattttctgggtcaaagggtgtaaaagagaagagttaaggatatctgtaagatttttggcctgagcagctgaaagaacacagctgcccttaactggagggagaagagtggacattgtttgaagggacttttgaaggtgacctggaccgccccgcttgcctttagttgggatactttaatctcatttttttcttcatctctgttttaccttttaaagatttgtaaaattaaatagaagtagaatagaaatagaaggaaatcctaccatttgcaacttggaagacatcatgctaagtgaaataagccagacacagaaagacaaatacctcatggtctcacttagctgtagtatctgagaaagtcaaactcagccaggcacggtagctcatgcctgtaatcccaacactttgggaggctgaggcaggtggatcacctgaggtcaggagttcgacatcaacctggccaacatggtgaaaccccatctctactaaaaaagcacaaaaattagccgggcgtggtggcacgcatttgtaatcccagctactcaggagcctgaggcaggagaatcgcttgaaaccaggaggtggagtttgcagtgagccaagatcgcaccctgcactccagtctggatgacagaatgaaactctgtatcaaaaaaaaaaaaaaaaaaaaaaaagaaagtcaaactcaataaaaacagagagtagaaaggtagttgccaggggctgggggttggggggaaatcagaagatgtgggtcaaagggtataaactttcagttataaggtgagtaatttctaatgtacagccatgtgactatatagttaataatagtacattgtatacttgaagtttgctaagagggtagatcttaagtattctcaccacacacacacacaaaggtaactatgtgaggtgatggatatgttaattagctgattgcgacaatcatttaacaatgtatatgtatttcagctcatcatattgtataccttaaatagatgaaatttttatttgtcaattatccctcattaaagccacaaaaaagatttgtagaattagtagtttctatttgaatttggtattctaatatgtgtacaattcttaatttctcgtctttgttgtagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccaggtaaggagatagtcttgtttgtgcagtaaatcattctttctttccaggtggaagaccaacttggcaaagggcagtcttaacgcttaaaacagtggttcccaaacttgtgacacattcgaatagcctagggagctatattagtttcttgttgtagcggtaacaaatcatctcaaacctagcagcttaaaacaacacaaatgtactatcatgtagttctggaggtcaggattctgacacacgtctcactgtgctaaagtcaaggtgttagcaggttaccttcttccctacaggctctgagggagaatccattttcgtgccttccccagcttctaaaggccacctgcattaattgactcatagacctctttcttcttcaaagctagcagtggctgatcaagtctttctcaagtcacattactttcacatagactcttctgcctccctcttcctcagttaaaagacccttgattacagtgtgctcacctggataatccaggcgcatctcccttgttttaaggtcaactgattaacaactttagttccatcggtttccgtaacttcactctgccatgtaacttaacatatttacaggctccaggattaggaagtgggagaccattattctttgggaggccattattcagcctaccataggatcctttaaaaatcccgatgcccaggtcagaccccatacctattaaatcagaatgtctgggggtgaaacccagaagcatccatcgtcattagagacctcacagttgatgccaatttgcagcaaagtttagaaactgctggactaggagactgctaacattaggtcaaacaaccagttcctctaggcaaaagaaaacttctctaaacaaccagttcctctgaacacaaaactcgtcaagatgtactccccacaaactccatcctcctctattcaattccttacagtcagctaacatacagttaacacctaacctgtgccagtcccatgctgagcacttataccttgtttcatttcaccatttcagcattagctaagtttttctttcctttcctttccttttcctttcccttttcctcccctccccactcctttcccctccctttcccttccctcccctccccttctccctcccctccccttctctccctcccctccccttctctccctccctcccctcccccttcctcccctccccttctcccctccactcccccctccccttctccccttccgttccccctctcccctcccttcccctctcctcccctgtcttcccttctgtcctcttcccttctcttctttcttttttcttttcttttcttcagacaaggtctcactctgttgcccaggctggagtgcagtggtgtgatctcagctcactggaatctcagctcccgagtagctgggctcacaggcacacaccaccacacccagctaatttttgtattttttgtagtatcaggcatgagggtcttgaagcttagctttctaggtcaatagccttggggtttcaccatgttgcccaggctggttttgaactcctgcgctcaagtgatccacccgcctcaacctcccaaagcactgggattacaggtgtgagacaccatgcctgaccagtttttcttatcatctcaatttttataatacatttgcagagcatctattgtgtgacagaaatatgtgaaaattgtcagaatcaatatggagtcacttatttcaaaccctaataaaatggagttgggtggcctgggggcatgaagggaggatcctcacacagagctgcctgataataactaccccagaggactctaccaaaaccacaaccttgcagttaaggccacctctatgaggacgtctttccagtagcagtgtttcctaactgcagccttgcaagtaaccttactaaatggcagccttgcagtcagggtggcttatttgaagacgctcttctagcaatggccagtacacatgtcactgcctgcaataattccttgtaaccaatgaacttgtttcgaaataacctatgtgtacttctcctttttgcctttagaagttcccccttgcctcaacctccccagatatgcccatggcctgctatggcatgcatatcctggattgtaatcccatcattcattcccaaataaacttgttctttgagagcctctctgttgttattttaggttgacaaatgaatacaacagatggcagtagtatcaggcatgagggtcttgaagcttagctttctaggtcaatagcctcgggcattccggaagattagatagcttccagaaataaatgttgaaggagcacttctttttttctctcccaaggtagggtttttcctctgtcttatacttcggattgtttacttttaaaattatgttaatgaattataaaaataagaaaagatataaaagataccccttacataaaaaaaaaagatattaaaaatataaatactcatgaaatctgaaaactatgttagtgaattataagaataataaaatatatctcttacacaaaaaaagaaatataaaaagatattaaaatgtaaatagtcatgaaatctgagtctgtttcttatactctagagattctgctttctttcaacagtgcaaagcaacaagcctctctcagtcggtgcactgaagaatctaggtgtggtttatatcagctgtggtgatgcacacactgcggtgcttacccaggtaatccaaaacgtgttgctatttttttgagttccagagaaatggtaacaagatacatatgtactaattattgttgaaagacagagacattagcccatttgggccactataacaaaataccataaaaagagtggcttatgaacaatagagatctatttcccatagttctggaggctgggaagtccaaaatcaaggtgccagcagatttgatgtctgatgagggccaaacttctcattcacagataccatattttcactgtgtcctcacatagtgaagggagtgaggggtccttcctgggcctcttttgtgagggcactaatcccattgatgagggttctgccttcatgacctaatcatttatcaaaggccccatctcctaatatcatggcattgaggtttaggacttcaacatatgaattctggggggatgcaaacattcagactgtagcataagatatatataccaatatctagacagagccattcagtgtacacatatctaaagaggagatgtgaaccaaacataaatcataaggttttcaagatacataacaaaagctaatttcagctttaggaagtatctttagatacctactaaattaggttaatagctgggtgtggtggctcatgcctataatcccagcactttgggaggccaaggcgggcagatcacgaggtcaggagttcaagaccagcctggccaacatagtgaaatcccatctctactaaaaatacaaaaattagctgggcatggttacgggcacctgtagtcccagctacttgggaggctgaggcaggagaatcaattgaacccaggagtcagaggttgcagtgagccaagatcgtgccactgcactccagcctggttgacacagcaagactctcctgtccaaaaaaaaaaaaaaaaaaaaattaggttaatacaggaactaatcccttttagcaattattattattattattattattattattttttgagacagaatctcgctcagtcgcccaggctggagtgcagtggtgcaatctcggctcactgcaaccttcgcctcccaggttcaagcaattctcctgcctcagcctcccaagtggctgggattacaggcgtgtgccaccacgcctggctaatttttgtatttttagtagagacagggtttcaccatgttggccaggctggtatcaaactcctgacctcaaatgatccacccacctcagcctcccaaagtgttgagattacaggcatgagccactgcgcccggcccctttagcaattattcattgacaatgtgattctacagataaaaattattatagaagcaacaaagtaatttttacagttttcaataatccactttacagcctagaacattatttcatttcatttcttgcttggcataggtatgacacagcttcctgaatgttttcttcccattcttgtcctcaccatacaatatattccaaagggatggattctttctggagccataaggaatagacttgaaaactacttgtgtagttgaaatgtttgtttaaaaactatatgcccccaattatttttgtttgttttaaatgcatatcttaaattagaaaaccctcaattgtttggattatattattctcaatataaagaataaatagaaataaatagaataaatagaaataaagagaaagctagagttgtttgtaatcatagaatgttttgggaagacagtatttttaggaaaatgctcaaataaattcaacctcatacttaaatgttggttttactcttgaaccagttaatttatctattcattcaataaagacttattaagtacctaattctttctttttccagctttattatggtataattgacaaaaattgtatatgtttatgctatacaatattatgttttaatacctgtgtacattgtgaaatgattaccacaatcaagctagttaacatatgtatcacctcacatacatatctttttttgtgattagaatctttaagatctactctcttagtaattttcatatatgaaacacattattaactatagtcaccatgctgtacaatacatcaccaaggtgcccagtttttaaggaaatgctaatgattttttttttttaaatttgtgtagagattgggtcttgctatattggccaggctggtctcaaactcctggcctcaagtaattctcctgccacagccttccaaagtgctggtattacaggtgtgagctactgtgcctgaccccagtgatttttcatgtttaatgtgttaactcaacatacactattagaaaaaataaaggatctctcctatttatgtagagcttgtgtttcacagagtgctcccgtattaactcttgtatgacacttaatcagtaagcttttagttaccttgttaaacctgaaattaatttgattcttcctttgctaagcaggacgggaaagtgttcacatttggagacaatcgctctggacagctgggatacagccccactcctgagaagagaggtccacaacttgtggaaagaattgatggcctagtttcgcagatagattgtggaaggtaataggcttcttcttcttctttttcttagcatgtgtagaaagtgttatattttattacttagaaatgactcatatggaatgttatcaaaccttaaaattcctgcctgaaaatttacttatttcaaatatagtttaatttttcagtttttaatctttattctagatattttatttatttaataagaaataattggaagtctactgtgtatagaacactgtaccaggtgctggagaatgggaagtagattgataaaaatagcagagctttcctgcttaagttgataagacaaaattaaagtaaattaatctcatgcatgcagaagatgatgtatatttacatatatattttcggagttctgcgtaacctaattatgaggacactttgagtgtttaaatatctacccaatgcattaaaaaagaaaaaaaatagaaatgcctgcatttagaacacaaatgatagaaaccatagtaaagacctatcaataacattctgtttttaagattagtagtaagttaatattgactgaccgtctgtttagccacatcctttgatgccctctaacactgacattgtgataagggagctgcgtacttagtaaaagtaaattgggctttttgtgtttgttattttgtcttaagggacatcatctttctcaaaagccatgagtgccttagtcttcattatggtgtattctctttcctgtagttatcacaccctggcatatgtgcacaccactggtcaggtggtatcttttggtcatggaccaagtgacacaagcaagccaactcatccggaggccctgacagagaactttgacattagctgcctgatttctgctgaaggtgtgaatcccactaattcatgattttgtgttcatcaatgccactggaagagaactagtattcagcttcctttcaaaggatcctacagaactgtagttcccctagtacttttatttttatttttatttatttatttttttttgagatggagtttcgctcttgttgcccaggctggagtgcaatgacgtgatcttggctcaccataacctccgcctcctgggttcaagcgattctcctgcctcagcctcctgagtagctgggattacaggcatgcgccaccatgcctggctaattttgtatttttagtagagatggggtttctccgtgttggtcagactggtcttgaactcctgacctcaggggatccaccagcctcggcctcctaaagtgctgggattacaggcatgagccaccgcgcctggctgtacatatatatatggtgcatttttttcttatgcagtgactcttagggtatttggtaatcatttctaaagattaaggtaagttcaagaccagcctggccaacagggtgaaacccgtctctagtaaaaatataaaaattagccgggcgtggtggtgcaagcctgtaatcccagctacctaggaggctgaggcaggagaaccccttgaaccaaggaggtggaggttgcagtgagccgagatcgtccagcctgggcaacagggtgagactccatctcaaaaaaataaaataaaataataaaataaaaaagattaaggtaatacagaagactatcctaacttgattacttaaacatcagaacaatacactttttttccataaagtgaaagcaagtttattaagaaagtaaagaagcaaccagaacaatccactttcatatatttaatcaaatctcttctaaagcatggccacctggctgcattatgcaagtgcatgaaaaactaaattttagactaagtgaatatatgacatgtaatctgatcaaaactgatcttttatttcaatatgatgggagggaaaaaaagaaaaaaattaatcttttatgcatttgtagtcaaaatccatttaggagaatataaattgccagtaagtaaataaatttttggcttgataatacatcagatttatttttacttctagaaactctaagcatggatttatgactttcttttagacttcgtggatgttcaagtcaaacacatttttgctggaacatatgccaactttgtgacaactcatcaggtatctattatactttttgttcctcttaaaaattattttttctcaagatttcagaccggtatttgaaatactgtattattcatacatattcaggtcttttactaaaacaataaggtcctatattagaatgcttatgaaaaaaatattacataattctcacttccttatttgtcaactttcctaacagattagacccccccaccaccaccatttcagatttattttttctttatgggtaagtgtgtttgttgaatttgcatcatgtaaatgcacatacacatgtaacttgtgtcaacagcagctgtttccatcttcaggagggaactgaattttccctgtccaggactgtgaaggaagggtttctgacatgtcctggagggaatttcccagtggcacctccttcagtaggaggattgccatgtgtgtgagtgtgcaggggtgtgtgtagcaggggtggcatgtagcgtctcagctgtcctgtgttgcaagggtcacatcaccgagtccccaactcaagtttattgcttaataaaattaatgatgatagataacagtcatgactaattttaactgcagtcaccaagtgtcaggcagcaatcgaagttcttcaaatggatcaagatgtttaatgctcatatcaactctcgttgattttatttttcacattgacagatgaaaaaacggagtctcagagaggtgaatttatgcaaagttgcactgttagtaagtggtagagctggattcaaatccaggcagtccaacccagtagcttacaccattatccaccatgctatagtgccttcctaattgttaacaggagggattttattattacatttctgggtgagttctgaaatatgtttatggaaacaaaggccttcatagttatttttctaatttgtactttttcctattatgaggaatgttttaaaattgatgtttaaacttgatgtttaaaacattcctgacgacaggaaaaagtacaaattagaaacataatagactctgtctgtagtccctggcacagaatgtggtcagaggcaaaggtttctgtgctgttgggatagttaggagactatactttggttgctctatcatagccattcaatcagccactcaacaaaaattgagaccctttttatatatcaggctctgctcttggtgcctgggacaaaagtgaatagtacagacaaagttaccctcattcatagcatttggactccacaggcagggccggaccataaatatgtaaatgcaaaataaataagattgtattagaggcccggcatggtggctcacgcctgtaatcccagcgctttgggtggccgaggcaggcggatcacttgaggtcaggagttcgagaccagcctggccaatgtggtcaaaccccatctctagtaaaaacacaaaaactagctgggagtggtggtacgagcctgtaatcccagctacttgggaggctgaggcaggagaattgtttgaacccaggagtggaggttgcagtgggctgagatcgtgccatgcactccagcctggcgcacagggcaacactttgtctccaaaaaaaaaaaaaaaaattgtattagatagtgacaagtactctgaagaaaacacattgattgtttgagattggtgaggtggccttctttagaaatgtctgtcagaaaaggccttgtagaggctgtgacagttgagcagagattttagccatgcttaggtccagagaaagaatgctcagagcagagggaactgcacacagaaagcctgtgaggcaagaatgagtttggtgtgtgtgacagaaggccagtgaggcagaaccataggaagaaaggacaaagagctcgacaagatggagccagttctgtatgctggggtcagctatgtgaggggggacccatctgaaatgtgcttggaaaggagacctagagactggccaaacaagccaagagaagaaagcacctgtatggaggtcctctcttttgtttttgtttgtttgtttgtttgcttgtttttttgttgttttgagacagggtctcactctgttacccaggctggagtcttggctcactgcagcctcaaattcctaggcttaagccatcctctcgcctcagcctcccgagtagccagggctacaggcgcacaccacaatgcccagctggtttttttttgtagagacggcgtttcgccatgttgctcaggctggtcttgaactcttgagctcaagtgatctgcccaccttggcctggcaaagtgctgggattacaggtgtataccaccgtgcctggctcccagtagtacctcttatctacagttttgcttttcacagtttcagttatccacattcaactgtggtctaaaaatattaaatgggaaattcagaaataaacaactcataaattttaaatgacatgttctgggtggcatgatgaaatctcacaccattccacttcatcccttcatcacaagaagtagggtgaatacagtataataaactattctgagagaaagacaggggcaccacgtttacatatgttttattacagtaaattgttataattgtttcattttgttattagttattggtattaatctcttactgtgcttaatttatacattaaacttgatcatatgtatggatgaacaggaaaaaacagtcaatatggagtttggtattatttatggtttcaggcatccactgggggtcttggtggaacacatcccccatggataaggggggactgctgtatttccagaaggagaaagtggctaattctgtcaaatacagccgagtggtcaagtaagaccagtgcatagtttatttttgctttggtaagattgtgttattgcagaggagagagaaggaaacctgacccgagtgggctggacagagaataaaaggggaacaagtgcaaacaatgcctgtgacaactctgagaaattttgatgtgaagagaatagagaactgcgagagggtttctcatgctgcataagaaagagtgaataggccaggcatggtggctcacgcctgtaatcccagcactttgggaggccgaggcgggtggatcacaaggtcaggagttcaagaccagcctggccaatatggtgaaaccccatctctactaaaaatacaaaaattagccgggtgtggtggagggcacctgtaatcccagctactcgggaggctgaggcagagaattgcttgaacctgggaggcgaaggttgcagtgagctgagatgcgccactgcactccagcctgggcgacagaacgagactccatctcaaaaaaaaaaaaaaaaagaaaagaaaaaagagaaacagtgaataattgcagaagcaatgtctgagattaggagagaggaagcagaatctaacgcgtgattgaggggtttgaacagatgtgtttattctgctgtaataagaaacggtacaggtgaaggtaggttgatggtgggaaggtgattagttcttgcttaattgcttcaattttcagtgatgcataagacaaggtccccatctgagcatgactaagcagaggagtatgaaaggtttaggaagaaaaggaagggttgtgatagttgtcttggggaaaaagcaggtagccttggaatccattagacaatatcacgtgcccatttgaaatctgtggtcatagacttaaagtgaaatcagtctgcacagttgtgcagctttctcccgtgatgttaggctgcttcagttggattttggagtaattcagagtcaagtttaattacagatggaactttgctaggtaagtacaataggaaatggacaaaagagttataggtgtgattatagtgatgaaccatggaatctaagctgggtaaggaggatgaaagagggtgatgaatcatggacaaacaacagggctaattgattggagatccaggcggacaaaagaatcttggactgcaggttttactctaaaggaggtgaatctgtaagatggtgtatgatggtcagagaagagaacatttccaatagaaatttagaagatggaacaattgataattataacatccagcttctcacctgtatctagggcagtggttttcaactaggggtgatttcatgctccgggaaatatttggcaatgtctggagacattgtagtttgtcataactaggggagagcatggtgttgggagtggctgctactggcatctggtagacagaggccagtgataccactaaacatcctatggtacacaggacagctgctcacaacaaacagttatctgacccaaaatatcagtagtgtcagtttaaaaaccctgatccagggcatgtgtggctggggtggagcagaggaaaatagtggagatgattaagaattgagagatgaaggtgggagatagatcaggttcatcagttctgaagtaaccaagagtgagggcaggaagggtgaccatgggaatcgtggtatgaagaagacagcaaggtgccgaagctttcaatgaatgaaggggagtgaccaggacagtgggagaagattacaaaacaagaagaggcagatgacatagtctcatgctgtgcatttgggaggagctagggattttgaagcagaaaatgaagaaatggtatgtaactgccaagagggagcacctcattgtcccaagtttcctgggatgtggggggaaaaactcttcctcttgatcaaactacagggaaaacccaggactcagatcaagaagctgaagggaactttaagagccgtggttacctgtcttcttcaagaggtcttttatttcagcattaaaccaaaatgatgcaggatttcctggctcataacaagtgcagtggaggcataggtataagttatagcagagcactaatgcctttggaggactgtattgaaaatggatttttctttccagacagtgatttttgaaacccctgtttgggctatttggtctcaagtattatatagagcaatggttctcaaagtgtgatctccaaaccaacagcatcagcatcactggagtattttttagatgcaaattctcaccctctaccctgacccactgaagcagaaactatggggtggagcccagcaatctactttaacaagctcaccagaatcacccaccaggtgatttggatgcacattacaatttgagagttactgacataaaagtaaacacttgtgggtgattaaagggaacaagaaaactaattattgagtgcctattataatcccaaagctttttatacttactataattgaatcttaagaacccagataggccgggcgaggtggctcaagcctgtaatcccaggactttgggaggccgaggcgggtggatcacgaggtcaggagatggagaccatcctggctaacgcggtgaaaccccgtctctactaaaaatacaaaaaattagctgggcacagtggcaggtgcctgtagtcccagctactcgggaggctgaggcaggagaatggtgtgaacctgggagacagagcttgcagtgagccaagatcatgccactgcactccagcctgggtgacagagcaagactctgtctcaaaaataataataataaaataaaaataaaaaaaattttaaaaaggaacccagagaggtaggtattattatctttttatttattgtggtaaaatatatataaatacaatttgccatttttatcattttaagtatacaatttagtgacagtgacattaattactttcacaatattgttcaactgtcaccattatccatctccaaggctttttcattaccccaaacagaaattctgtaactattaaataataactccccattccctctctccgcccccagctttaggtaatgttgaatctaccttctgtctctatgaatttgcctgttctagatacttcatataagtggaatcatacaatatttgtcattttgcatctggcttatttcattcgcttgtcttcaaaattcatccatgttgtagcatgtgtcagaatttcatttcttttttttttttttttgagatggagtttcgctcttgttgcccaggctggagtgcaatggtatgatcttgtctcactgcaacctccacctcccaggctcaagcccctgcctcagcctcccgagtagctgggattacaggtgaccaccaccatgcccggctaattttttgtatttttagtagagacaaggtttcaccatgttgaccaggctggtttcaaactcctgacctcaggtgatccgcttgcctcagcctcccaaagtgctgggattgcaggcatgagccactgtgccagccagaatttcattcctttaaggctgaataatatttcattttatgtatatttaaaaaatctattcatctgtttatggacatgggttgtttccatcttttggctattgtaaataatgctgcagtgaataatgatctacaagtatctgtttgaagccctgcattcacttttttttttcttttttaatgatgaaactaaggctcagaccaagcaaagtggcccaggctaggaggtggaatagccctaccggtctgacgccaaagctcctcccaccaaatgctaccacccaagagggcagggcctatttaccacccatgccaggtgatttactgtataatttactactgaacgtgtgtgtgttcctgatcattcttgtttcttccttccctgaaggatactagttccacacgtgctcccgggaaaaccctgccagaaataagccgaattagccagtccatggcagaaaaatggatagcagtgaaaagaagaagtactgaacatgaaatggctaaaaggtggctctgtctgataaattataagccacttttatctggttctggggctttggtcattttatcctaagatagaggttttggttttgttgtgaaggtatttgcattttgaccatgattctcttctacagcctcttagtgtgactaggtcatcagtgtactcatttacagatatatggaggacatgtgatatcccaggtgacttactaggtgagggagttgcaggagtgaatcaaaaaagctcacaaagcctttaataaggtggactgttttcatatcttcatagtttacccctttggagttttatgagttttggtcttcacagggataggttttatttaaacctacgtgacttgaacaaatcaactataaagggttttggtgagatttagaaataatatgaacaaagtatacccaggatttgggagactcttaagagagtagttattttcattaataattattccacgtcatcatttacttattcagacataataagattttcaaaaggcatgctttattatatgttgtgacttaccccttgttattacttttacagtgaaattagaatgatattttcatctcctgcttgtctgactgcaagttttttaaagaaaaggtaatacttacataagatttaccttcatttaaaacactggaaaatatttaaaatgaaatgtttcaagtaagtttaatttgtgaattttgttattcttgcccacaaagtccaacacagagaactctgtaggttgttatagaattctttcattttatgaagtaattttctattagactaccataagttataattcctaattaatattgtttacttccttcataccactttactctgttgtctgattagaaggaatggtgttttttcaggatctttgtatatacaaaggatcggctaaatctcacattgctttagtacttagaagccaagagtacactttacaatttttactgtgtatgatcaattaaaaaatagatcttatttatgttgtctttaactcactgctacagaagaaaatctgattttactcctatttggtttaacatttggtctgatccaatagttgaaacagttcctgtaatgctcaatatttgggtcttctatttctgctctttcctccaagctctccaatatggcacctgtgtgtaaaagggaagagaaggagaaatagcagtgtagagggtcttaggctgccctctgcctctttggaggttgatgccttgctgatctgtctgcagctagtgtaactcatatgggttctcctttgcctgtccctcccttgttaacttggtgttaagtttgctcactggttcaaaatatggtgatacacatcttgtacccactgctggtcactaggtggtactcacttaacccttgttgctattacttgccgttgtacaaccctcttggcagtcccattagttcttaacccagctgcattctcagtcagcttgtgggattagaggaactgttggatgccaataacttcacctaaggctaattcttactgcatgtgggaaaatcttttctatgtgaagattgttttcttcctaatgtgaaaaagtatccatgctcacttcccaggagtgaggaactcctaagatgtcaaagattgcgaaagagaatatattttaagggggaaatttataatactttgttttagtacttgcataaatattttagccctaatgttactataaatcagttaatctagcaaggagaaaatctttctttgtttttttattatttatttatttatttatttagaggtgaagtctcactctgtcacccaggccggagtgcagtagtgcagctcggctcactgcaacctccacccccaagttcaagctattctcctgcctcagcctcctgaatagctgggattacaggtgtgcaccaccacacccagctaattttttatgttttttggtagagatggggtttcaccatgttgaccaggctggtctcaaactcctgacctcaagtgatccacccaccttggcctcccaaagtgctgggattactggcatgagccaccgcgcccagcctcttttttaaatttttattatttttatttatatttttgagacagggtctcactctgtcacccaggcttgagcgctgtggcgtgatctctgctcactgcagcctccgcctcgtgggttcatgtgattcttccacctcagcctcctgagtagctgggattacaggcatgcgccaccatgcccagctaatttttttgtatttttagtagagacagggtttcaccacgttgggccaggctggtctcgagctactgacctcaagtgatccgcccacctcagcctcccaaagtgctgggattacaggcgtgagccactatgctcggcattttgtttgtttgtttgtttggttttgtttaatgtttagagatggggtcttgtgctgttgcccacgctgtaatgcagtagtttgatcatagctccctgtagccttgaactcctggcttgagctatccttccacctcagcctcacaagtagctgggactacaggtgtgcaccaccatgcctggctaatttttttttttttaatttttttgtagagacaaggtcttctctatgttgcccaggctagtctcttgaactcctggcttcaagcaatgctcccactttggtctcccaaagtgttggaattacaggcatgacccactgccgctggcatacaatatttgataatgcattatttaaaaatggttaggcttattgaatgctggcctctcaaatatcactaaaacaacttgttgataagacaggccagagagaacagcacacctggacaaagcgttggtactgtttctgagaggaaagaccagttcggaatttatttacaattgggagtctggcttaaggaggtctttcaatatgagagggaaggctggaggtttgacttggactgggtaaatgtacaacaatccaggatgggtgcaaactgtaaggtaaggattttgagataagggattcaaagaatctatgggcacaaactgttgatgctctccattgaagagttaaatgggtctttcaagaagttcccatgatgaacaatttacatttgcctgggcaaaagtttcctggaaaagtaaagtcatgctaataaaaacagtggaattgcaaagttctgtaaatatgaatggtaaggagggtggggggtaggtagttctagttcttagtgtgcaaactgagtgcgggggcagatggtttctgttgtcagattcagcacgtaaaattttgttaatatggcagtccaaacttgatgtagccactacagagataataaattgttatctactgtcttttaacaaggagaacataaactgtacattttttatgtcaagtaagttgattattttgaaaggaggtaagctttaagaaaaaggtttgtatcttatatgtaataaagcaacaaatgacatacaaactttagaaatatccctttccttatgtttatgtggtttcttgcatttcttgtatccaaagaggaactggagaaacgacttccattgatgtggacttagaaatggcaagagataccttcaagaagttaacaaaaaaggaatggatttcttccatggtaatagccaatacttactttagatatagaacaaatacgattgcagtttatttttgttggaagctgggtgagatgggaactatgattgtaattgcccgatgagttcttcctgcccactgcagaaacaaaaatcgacccactgagactatgacattgtagtaaagaaagagtttaattgacatgaggctggccatgccatgtaggagacagaattattactcaaatcaatctcatgaaggctcaggctcacagcttaggggcttttcaaagacagtttggtgggcagggggctagggtagggggcatgctgactggctgagtgagagatgaaatcatagggaatagaaactgtcctcttgtgctgagtcagttcctgggtgggggccacaggactggctgatgggtccaggtgggaccatccagttgtcagaaatgcaaaaacctgaaaagacatctcaaaaggccaatcttaagttctaaaataatgatgttatttgcaagagtaattggggaagttgcaaatcttatgacctccagaataatggctgataattatttagaattcaagcccctttcatcctcctaacttgttggactttcattagttttacaagaacaattcagttttggggacagactattatcatttaaactataaactaaatttctcccaaagttagcttggctcatgcccaagaatgagaaaagacagccaacctgtgaggctggaagcaagatagagtcaaccatgtcagatttctcttactgtcatacttttgcaaaggtggttttatgattggggccgaaagagggggctagtgttcattatgaaattactatattccaggtactattaggtgctgacatttattttcttattgaatccttaaatgtacaatagatacaatatttttattttcaatataatcagagcaatgctcgagaggtggataatctctagcatgatataggaaaagagcattggtttgggaagcaggataaccttatcctggactgatcaactgaaaagccacttctgtattctgagatgaaacttacatctatttgagatgaatctctgttactacttcatcctttctctttggatcacattttctttacctgttgaattcatctttaaaatctattccagtttaatattgtgtgattctgggttgtattgggaagaaaattttcttttcctgtcctgactcaggtttgagctggtggatggggtcactgaaaattaataattaacagaatctcttagtgctcaggatgctgtagactgggtagcttaaacaacagacatttatttctcacagttctggaggctgggaagtccaagaccaaggcaccatcaggtttggtgtctggtgagggcccacttcttggttaatagatgaccatattttcagtgtcctcacatggcagtgtgaaccccaaatatctaagacaggtctcagttaatttagaaagtatattttgccaagattgaggacacacgcctgtgacacagcctcaggaggtcctgatgacatgtgcccaaggtagtgggagcacagtttggttttatacattttcaggagacacgacacatcaatccacatatataagatgaacactggtttggtctggaaaggcgggacaactcaaagcagggaggggccttccaggtcttaggtagatgagagaaaaatggttgcatgcttttgagtttctgattagcctctccaaaagaggcatcagatatgcatctatctcagtgaacagaagggtgactttgaacagaatgggaggcaggtttgcactaagcagttcccagcttgactttcccctttagcttagtgattttgaggcccgaagatttattttcctttcacagcaaaaagggcaagaaatctctctggggtctcttttgtaagggcactaatccattcatgagagctccaatcttgtgacctaattacctaccaaaggccccacctcttaatactatcatattgggggttaggattttaacatatgaattttggggaacacatttagcctatagcacaggaggaaaaaaacaagttttgtacgcttgcatgtggggcattcagatgaagaggctccctgaacagctagggataagaatttataaaccaacttaatggaggaaagggagaagggagaaagggctcctatgggaagaacaaatgggattttatggagacaaatggaaggtatgacagtttgtgagaatgtttgtttatgcaatttctcatccacatgcaagttgtctgaatgattggtctcctttttagcagtgtagctcctcaatgggggatgtacaagagcttcatactagaagagctctgcattagttagataaaagaagctccaaaaaggcatctcaaatgtcttcagttagtaaaataatctttataccattttgatgggtctgagtgggtccttatacttggaagggacaggcggaaagtgttccttaatgtgtagtagatacaatattttcattttcaagatgaagtgataatagcaaatattatgaagtatatttcttaaatgaatttaggtgatatgggagataatttggggtgctgttcccggtgtaagttccaagggacattagttttataaaaaaccccataaaaaagggttcttaatgagaaaactttgggaacactccctactattatggagtcatgatatgcgcattaggaaatcaaagattctatgatgtcatacactaaaagaaatctcttttgaccctatttttcttggagttatttgacattgtgatgctattttctggcataacacctactggcattccacagaaatcatattctgctagacatgtgaaaaagcaaattttaagaattttaatgtaataaaaacaatatatagtacatcacagtttattgttgcatatatcacttatttacccttaggacatgaaaggcaaacactgtaattacagaacatagatctatcaggtagagtaaatatggctagctgctatgacaaacaactttgaaatcccagtagcttaacacagtattttccaacatcctagtccaacaagggttggaggtcagaggcacctttgcacaggttcattcagggctgaatcaggcttctttccagcatctctaggccctggggctgtaaaatcctccactcaatcttttgggttggctagcagatgagggaagtgagtatggaagttcccatgagaggtttcagtggcctggccttaatgtgtcacacatcactttctcccacattggtgagctaagactcagtcacatggccctgcctgattgcaggggagccaggggctgccatcttcctataaacccaggaggaaaaagaaaaacgactggcaaggtgaacatatggcattttctctgccatggtagattttactactatggtagtgccacagtcactttctaatcgagtaacgctgacttcctctgagtctctccttgctcatctgtaaaaacaaggtaaaacacaaataaagcaaaaattaccttacaggattatcagtaagattaaataaaatgatttacacgagatcacctgacacattgtaagtactcaatgaatgttcaaacaaatataaagaataccatacaagtttattcccactagtatgtttttatatacgtcctattttaaaagtttacttctgggccaggtacactggctcatgcctgtaatcctagcactttgggaggccaaggtgggagtatcacctgagcccaagagtttgagactggcctgggcaacatagtgagactccatctctacaaataattttctaaaatgggctggctgtggcagtgcactccacttaggagtcttgaggtgggaggattgcctcaaccaaggagcttgaggctgcagtgagctatgattgagccactgcactccagctgtaattgagccactacacgctgaagtaaaactttacctctggatgaaataaataatataaaaatttagagctatttttctctgcaaatttttctactgatacatgagaaaacagaaagaaagaaatggatattgtgtgaggggaaggggacagctcttccttctagaaggaggaatactaatgtgacctgcatacaacattgcttttgaagggctttgtattcgttttgaatccataattcactcagtatatccatgctcatgggatttcactttattttcttcagggaacctgatataaaatgaggaggatggctctcatgtactatatcaggggtatttgggatggaaggagtgatggagtctcatcaataggtttcagaatggctaagtgattattctaattggaacatggtggagtgaaacccttaatttcacagcttgcttctcacaatcctctgtatctaatatatcctgggtctgttccctgatcctatttttaccacagataactacgtgtctcgaggatgatctgctcagagctcttccatgccattctccacaccaagaagctttatcagttttcctcctgctcccagaatgtcctgtgatgcatgattctaagaactggaagaacctggtggttccatttgcaaaggctgtgtgtgaaatgagtaaacaatctttgcaagtcctaagtaagttttatgtcactttatctgtactctcaatatagagtcactctctgaagtagacgttgtagcaaattttgaatagaagatttcaaaatagacaagtatttgagaacatggcatgtaaattattgaaaagattaataatctaaagctattataattattagttctatcatacaaagcaggtgtagtttttagacttggatgtggctttgacatcagagtttggtagctataaggtattcattttagacttggatgtggctttgacatcagagtttggtagctataaagtattcaatcaagatcaatccatactttaaaattttttgctcatgttattttgaaacttttgacattttgaccagatgatgaaaaacaaatgttaaactttgtattattattatttactttattcagtactgtattatgtccttttatagcttttagcgtatattgaaagttcagtgattacccaataacccaatggggtccagatgtttatatacccttctacatagaggagaggggaggtagggaatgtagacaattcttttgaggagtagtaaatgactattagggagaatgagtgacccaggaaacagaaattaacttgtaaatgattctccttggaattggaatgagcctgagaggcaggcattatcttttgaaaaaatacatctaggtgtggttacattcctcagtcgtcttgtctgtgacagataatgtaatttcagagatggcatgaaaggcaattctgttctctgtagtgggtccagtcttaaggtagataagggagtgtcagagaaaagccttttccagcatctgctgaccttcaagggcctttaacttaaaataatcagcataccagggtgccatattttggggcaaatttccctggactccttcacttaagaggtacagagggccaggcattgtggcttacaccttaatcctagcattttgggagactaaggtgagagaatcttttgagcccaggaggttgagggcagcctgggcaacatagtgagaccccgactctaccaatttttttttttttaaatcagccatgcatggtggcacacacctgtggtcccagctacttggaagctgaggcaggaggatcacttgagcccaggagtttaagtctgtattactggaaaggggtcccaatccagatcccaaacaagggttcttagatctcacacaagaaataattcagggagcgtctataaagtgaaagtaagtttactaagaaagtagaagaataaaaaatggctactccacaggcagagcagctccttggggctgctggttgcccatttttatggttatttcttgattatgtgctgaagaaggggtgggttattcatacctcccctttttagatcatatagggtaacttcctggcattgccatggcatttgtaaactgtcacggtgctggtgaaagtacagcagtgaggacgaccagaggtcactctcattgccatcttggttttggtggattctagccggcttctttactgcaagctgttttatcatcaaggtctttatgacctgtatcttgtgctgacctccgatctcattctgtcatctagaacgcctaactgtctgggatggtagcccagtaggtctcagccttattttacccagctcctattcaagatggagttgctctggttcaaatgcctctgacagcagcagtaagctatcagcataccactgcactccagcctgggtgacagagcaataccctatctcaaagaaaaacaaaaaggtacagaggatatgtacaatgaaatgtaagccacccagttcccctcccagaagtggctacaggttctagtttcttgtgtaacgtttgaaagatattctatatatagaaacatacaaatgtattatttctgtttttaatggtagcaaactattaaagttcctcttccacaacttgctttctcccactaaacaggatatcatggagatcattccaatagagaatctatagaactgcctcattctatttaatggctgaagaatgttctattgtgaagcatttcattgtacatatataaattcacacatgcaggaaacattccagaaagcaaaatcactgagtcaaattgtatgtacatttttattttgagatattttgccaaatgaccctccacagagtcaaggtcatcatatcacccaatttgaagtggttgtcattcacactgtagtctgtataaatttcacccctagagttgggaaacctgtccgtactgacaaaggatgtatcaatttacacttcatcaatgaatatgagaatatcggtctgcatactttccaaccatgttatcaaactttgatctttgccattctgaggaaaaaaaacttttaattttaagttgaatttttcttattaagagtgagattgtgccggtttttgtatatcacagatcactttgtatatcatattctgtgaactcttactataggaccaccaggtctgatttcctgttgcacagtaacagaccaatacactgaaaaagtaggagttgcagcagagaaagaatttaataattgtagggaaaccaaatgaggagatgagaggaaacctcaaatatgcctcttcaagaggtttgcagatggggtttttaaggggtctggacacaggtgatggcctaaagtgtggtgatcactgattggttgagaagtgaggggtgaagtcagggatagggagatgaagaaactgcattcctgcactgagtcagttccttggtgagggtcttcagaccagttggtgtcagccattctgctggaattcaggatctgcaaaatgccttaaataattattgggtaaaaaggtccagtgtcagagattttatccataggaacaatgggagagcaggtgctcagtgtgctgtgtgactcagggttagttatcagctcagggaagtgggttgaagtgcaccagcacaccctagtcaattgacctcgtcaatgaccataattctgcataaagcctggcttataattcccattaaccctgtgagagcggttttgctattcttccttctttgctcttttcctattggttgttagtatttttctgttttattttaggagctttttaattatgaaggcaattaatcctttatcaataatatgaattgcaagtatttaggctattaaaaatttttttttactttgtggtatttttgctatgcagaattattttaaaaaattttaatgtagcctactatattaatattttattctatggtttctggatttggggtcatacttcaaaaataatttataactaaaataattcccatcctcctgctgtaattgttattattttatttttatatttaaatatttgatccatatgaagtttatcttggttaaacactattttttctagatcagtttccagttttccccacatatttattaaatctttttcattcccactaatatgcaatgccgcatttattatgtattaaagtttcgtgtgtatttgagtctacttatggaatctctatgtgtttgcttttcatatatctaggtaatactgttttaattacatttgcttgataatgtattttaacatcaaatttatttgttttctgagagttattctgagaatttaaaggttccacattccaaatccatgttgcaatccagtaatattaaaatataattattggctattttaaaaagtacatggccatgtaccagatgttcataaaatccaaacacatatataatattttttcattttttacagattaaaaacgtccttgatgccattgtatgtgtttgtgtattcacctgtgtgtgttttcagacttcatagataccctatacaattgtcagtttgaaaatcatgaagtcaatcaattaagcataaatgtgagccattaaccaatttcttcaaatcctgaatttgagcttttcaaaattctaatgatacttaataagggaaaaaaatttccacatctgtgagcagtaactgttgtgcaggatatacttaaaaaagatattcataaattatgccatcagaaatgtaaaatattatctatttcttacattaaagaacccactagaaacagagatttggggggtggtaggaaaaacatatttatcatggctaattttacacccccagagaagtgttgggcatttttgcaagaatcttctctgaatccgctgatccagatgcttaaagcagccatcatctctcagctgcttcatcagactaaaaccgaacaggatcactgtaatgttaaagctcttttaggaatgatgaaagaactgcataaggtaagggttactctaaaggaatgcatgtactattttatgtaatcaaaatcccttaagtctcaaccagttggacttctaagaagtcaaataaaaatcatgaggagtcaaatgttttttaaaggagtatagaaaagggaaatgtttggcataaaataattagggatttaaaagttgagaaactttaggaggacttaagatgttttgtaatggacttctttcattaagaaaaagtacactgtgcttgtaattctagctactctggaagctgaggtgggaggatggcttgagcccaggaatttgaggctgcagtgagctatgattgtgccactgtaccccagcctgggtgacagagcaaaaccacatttcttaaaaaaaaaaaaaagtaaagtacactgaagatactgctacatgtaacaacatacaacaacatggatgaatctcatcaacacagtgataagcaaaaaacacaccaaaaattacactctatgtcatcttttataagaattttaaaaacaagcagagctaatctataatgacagaaagcagaatggtgttacctcttgggaagggcaattggtttggaaggagcataggagaacatcctggggcctgctagaaatgttccatgtcttcacctggacagtacttacccaagtgagtatgtgtgtaaaaactcaccaagctgcacatttaagatgtatgcacttagtcaatgtatgttgtaagaaaaaaaacccagaatcacatagaaaaaccctccctcaaagtaggagcgagccaaaagaccaaaaaatgacttaggacaagcccagcttgatgagtagatgttgtctattaggacttacatacagggcactcctggacggcaataggacagctctagtgatctgtgctgcctcccatctctaaactgcttttaagcgaattttctggctcaaagagctacagtgtttgagccatgagaatgtttttcttggtaggttctcagatactctccaggatgtttgggttctcagggacacctgctcctcagctgggcaccgtggccttggctcattgcctggccttcagggttaaggcactggataaaaacccttaagtaacttggtgagagacccatcacactacacatgtgtgatttttttgtttgtttgtttgtttgcttgagacagagtctagccctgttgcccaggctggagtgcagtggtgtgatcttggctcactgcaacctctgcctcctgggttcaagtgattcacctgcctcagcctccggaatagctgggattacaggcacctgccaccacacccagataatttttgtatgtttaatagagatggggtttcaccatgttggccaggctggtctcgaactcctgacctcaagtgatccgcctgcctcgcctcccaaaatgctgggattataggcgtgagtcactgtgcccagcccagatatgtgatttataaatgaaacatatatgttttatttgtaacttagtaaaaattaaatagaaaggaagaaaagttcaccgaggactatggccagaacaaagaaagggcccaatggatactgttagatcaactcagtctgtctatatcagaatatttgctaaatcccactgtagaaatatcaaatgaggccattaggatttggtgtccacgttctctatggctgtgtcaacattagggtcaccaagaatgcaaagtctgttttagtagagttacctagagtcagtggtatccagaagtcactgggcgtggttacatcatcctcattctgctttgggtggtagtcccaataaagagaaatcagactggactcttgactagatctaaagattgacacaaccatgttacagatgagtgtctgaattcacagtgatcagtgattcacagaagagctcttaaattccagagaagtagaccagagtaatgagcactaatgtctaaggcacctagggcagcacttcttaaactttaatatgcatgcaagttacctgagatcttgttaaaaaattcagattctgatccggtaggcctggggtggtgccaaagattctgagaaattcttaagtgatgtcattgctgatacctgaaggatttatgctttgatgttcttgtgcctaggaagaaaagctattaaactaattaataatgaattagtaattaagaccattacactgtaatttactgtcttaagctgcaattaataaacataatatttggtctcggttctggaatggtctctagtattgtggacaattggaagactatatttgttttactaatgttgtgatagagaaagcacaatattaggtcatgctaacttcagacgtacatcctaggacccaaacattgtcataaatcctctctcttcccctctccctctccctctccctcaaacattgtcatcaatcctctgtcttctcctctccctctccctctgctctctctctctctcggcttttttctttttgggtttcattctctcttactatatatagggtgtcagagcagggcactgtttctcacactaactttcgttttctttctaggttaaatttacttcttaataaaatacacctctttccctggcgctttgtagtactccttgtgttgaaaatcaagtattcatttggctgttaatctatccttgtacctgtataacaccgtacaagttactgtatctttataataaatattgatatgtgataaagtttcaacttttatcttctccttcagtgttattgttaaacttaaatattaactttagaattacctttttgttccaattccacaaattccatttgtcgggcttttgattgtgtctttgacctggtagtgaaatgaatctatagaacaattggagagagaatgacaactttactgagtcttctaagtctgatcatgacatagctctctgtttatttagttctgcagtttcttacaataatatgttatagtgttctatgtagaagtcttgcagtcttttattagataaatcatgagtacttgatattttatgtggttatatatctttttaaaacagctttattgagatataattctctcatttaaaatatacaatgtcatgcctgtaatcccagcactttgggaagctagggtggaaagattgcttgagctcaggagtttgagaccagcctgggcaacatagtgagaccttgtctctatttttttaaaaataaaaataaataaataaaatgtgcaatgtaatactttttagcatattcatggagttgtataacctttacccaaatcaactttacaacatttttatcacccaaaaagaagccctatacccattagcagtcactccccattccccattccccctcaactcccatccccttattctcactccagccctaggcaatcactaatctactttctgtctctacagatttgcctattctggacattttatgtaaatggaatcacacattatgtagtcttttgtaactagcttttttcacttagcataatgttttcaaggttcatctatgttggagtatgtatgagtacttcattcttttttattgatgaataatataatgcattgtatgaaataccacattttatatatcccttcctcaattgatggatatttgggttatttccactctttggctattatgaataatgccgctatttaaatgtctgtacaaatttttgtgtagacatgttttcatttcccgtatatacccaagagtgggatatctgggtcatatggcaactctagtttaatcttgtgaggaaccagcagactgttttccaaagcagctacaccattttgtattaccactagcaatgtatgacagttctagtttttccacgttcttttttcttttcttttcttttttttttttttgagacggattcttgctctgttgcccaggctggaatgcagtggcaggatctcggctcactgccacctccacctcccaggttcaagcgattctcctgccttagcttcacaagtagctggcattacaggtgtacaccccatgcctggctaatttttgtatttttgtagagactgggttttaccatgttggccagactggtcccgaactcctgacctcaagtaatccacccacctcagtctttcaaagtgctaggattacaggcataagccaccgcacccgaccacttttccacattcttgccaacacttgttattatctgtcatttggattatagttatcctagtgagtgggaaatgatatttccttgtgattttgacttgtatttccttgatggctaatgatgttgagcagttcatatgcttattgcccatttctgtatcttattttgagaaatgtttatttaggtcttttgtccattttaaaattagtttattagtctttttattattgagtcataagagttctttacatacagttacaagtcccttatcggatatacgatttgctagtattttcccatgtgttgttttttcactttcaccatggtgtctttatgcacaaatgttttttattttgatgataaattcatctactttttcctcttaaaagttaaatttttaactgtctttgatgtatagaaatgcagtaatttttatacattaagcttgttttttaacaatcttgttaaatttacctactaaaactaatctcttgacttctttggattttctctgtatagaatcatataacttgaaataataacagttttgttcctatttatttttctttacttatttcattggctaggacaaccagtataatgttttataaccttattctgatctcaaagggaaaaccttaacatccagttttatgttttgctgtgggatttttgtagatacgtttttaaaaggttaaggaaacttcattctatttctagtttgctgagggctttgttcttttagatcatgaatggatactgaattttattaaatgctttttctgcatacgatggcaaaatacacagatgggttttcagctgttttaactttatctacttgaagtaacacagcctgctcatgtgttatagatttcaaagattccatttgctgatattttgcttatcatatttgcatctatattcatgagtgagactggtttgttattttactttctcataatgcccctgtgaggtttctggaccaggtaatgctaatctcatgaaattatttggggaatattctttctctattttatgtaaaagattgtataatactagcattttccttaaatgataggtagaactaatctataaaccttttgggtctggaaatttctttgtcggaagttttttaaattatgggtttaatttatttaacagccacaggattattgagattttctatttttttcttgtattgctgggtatttccccaggatttgtctctttatctaagttttcaaatgtcctatttttatctttttaatctcatcacaatctgtagttttgccccatttttcattcttgatactggtttttttttttgttttttttaaagtcttaccaggaaattgttttttcttttttaaagacgcagtcttttcatttgttgatcttgctcctgtatatttgtttttcatttccttaatttatgttcttaagtttcttatttcccaccttctatcatttggattcatttttgtgatggaggcatttagatcatttagatcactgatgcttcctctaggaagccttcttgaacctcttaagtctttccccaatcagaaactgtatcctaaattcctggtaacttgttgtttttacctactagaccacagattgtcaatctacacccaagggcagtctcctgtttttgcaaatacagttttatgggaatagatccacattcatttgtgtaagacaggacattttaatctaaagatttgtcctgtgcttgacaaaaatagtgtgtgccaagttagtatttattaattaaggagcaaagtgctgaatttgttaaaagtaccttggatttttatggtgcttttattctcaaaatctagaaactatttccagtaaatctatgccctaaaaattagtttactaatccacactgtcagcgtcttatctttgacatttcttcatgaaaattaaggaaattatagctcagaaaatggaaactttatagaactctatttcatcactgacaaatgttttcagtttagagagctttcttcttcttatctgtataacagccatacatatatatctatatatcatagattaaatcacttattgatagaaaatgaaattcacaggtcatattctctttaaggtaaacaaagctaactgtcgactaccagaaaatactttcaacataaatgaactctccaacttattaaacttttatatagatagaggaagacagctctttcgggataaccacctggtaagaataacatttttacttctgaaaatgttcatattttaaaggaagacacattactgtagtatctgtaaaggtactctttgataaatcaggatttgaaaattttttaattgcaatgataaatttgctaaatttgatgatcactgaaaacttaaatatattttaatcataaaacaaatgcagtttttgaaattttgtttctaagtaattcggattcttacagatttctgaggccaggtgcagtggctcacacctgtaatcccagcactttgggaggccaaggtgagcagattgcttgagccccggagtttgagaccagcttgggcaacatggtgaaacgctgtctctatcgaaaaaatacaaatacgtggtagcacgtatctgtactcccagctactcaagaggctgaggtgggaggatcacttgagcccagagaaggaggttttagtgagccaagtttatgcccctgcactccagcctgggcaatagaacaagactctgccttaaaaaaacaaagaaccacaaaaaccagattccaaaaaaaaggcgataaggtaaaggaagtaagttttttttcattgtttttaattatcaaaactattatctctgtttattttttagatacctgcagaaacccccagtcctgttattttcagtgattttccatttatctttaattcgctatccaaaattaaattattgcaagctgattcacatataaagatgcaggtatgtatgtcctattttttagtatgaaaaatttcaaacatatataaaatagagatagtggtataatgaatcccatcaccaagattcagcaattgtcaacattttgccacacttttatctatcactttttttctttgttgttgttactgtttttgctgaagtattttacagcaaatttcagttccaatgtctcttcacctgcccatacttcaatgcattatttctggttgtcctactcgtgttcactgtgagattcatgagtggttcaagtggcaaccacatgattctttcattgtttctcattaaccttttatttaataatttcatccattattttcattaaggtttgtggtatggcaatacttctaatcttattccttccaaagtcatttcctggaattaggtaaaaaagagcttttccttatcagtcagggcacttggttcctccaaaatggttaaagaccattcacataggaaggtagaataattaattcctatccctttaattatcaaatgttgccaaattaccctctatagagtttgtaaatgcctcttccacatgctgttctcagcaatgcagagtattatcaagctttgtgatcttttccattttgatgagttaatcatgatatttcacgttgattttaatttatatttctccttgttatttaatgttctagtcctcactttctttatataatatgtatctattgttttcctgccatgaacaacactgacgctatccagtaatctgttctttccttctctcttccctctcctcctctatccaattttaattgctgtgttcttaagtgctaatctttggattaaaaatacctccttaagcttcttggagcttgatttataagctccgactgatattcttttattcttaaataatgtctatgagtcaatcaatgagtttattttgttttccacttactttcacccttctgcttcttttctggtagttgtattagtcccacataagatttacatactattttgtttcttttatcaccatcagccttagttctcagttaagtatatataatgccatccccttattatgctaaaacaaattttccaaactttttttttattgctgaggcttgttttctaggtcattcctcatgaaaagtttatatctatttttctatgatatttatattttaaagactcataggaatcagaacttatacccattattgacttttattactaattcaaaggatgcatctgggtgaaacataagaagtctgagatagaacatgcacaagagaagccatttcagttattcattccctttttataccccgctaattacatggcttacatgacattttccaatgtgccatgccccataaatccacgaattccaggtttatttataataagcaacctagacagacaaggtatatcctgctagtagcattccacaggtaagggctgtccctctagttcctattattattattattttgagacagagttttgctcttgttgcccaggctggagtacaatggtgcaatctcagctcaccacaacctctgcctcccgggttcaagcgattcttctgcctcagcctcccaagtaggtgggattacaggcatgcgccaccatgcctggctaattttgtatttttagtagagacagggtttctccatgttggtcaggctggtctcgaactcccaacctcaagtgatctgcctgccttggcctcccaaagtgctgggattacaggcgtgagccaccgcacccggcttattattattattatcatcatcatcatcttaagacagagtctagctctgttgcccaggctggagtgcgatggtgcgatttctgctcactgtaaccttcacctcccagtttcaactgattctcctgcctcagtctcccaagtagctgggattacaggcacccaccacacccagctaatttttgtattttagtagagacggggtttcaccatgttggtcaggctggtctcgaactcctgacctcaggtgatcggcccgcctcagcctcccaaagtgctgggattacaggcgtgagccaccacgcccggactagttactattattagtgcctattaccagcatgtttacaaatatatttgaccaggtcatctcttcttttatttctgagccatctgtttttatttttgtaacatccctggtaaagggagaaaatagattgtctttcctttccaaacctaactttcccatcaatttcccttaaacaagaccttccctttatggtattttctcctatagtcatgtttctctctgggtcatttgtctattctgctagtgagtagtcgagggttgagtgaataatggactcgggcagattgcacattatgaaagactaggaaaagtctgaggacaagaaaactcttacttttagttgttatgagtgaagctggaaagctgactttacaatcctgctctccaaaggagagataatggatatagttaaaactgcaagctccaaagtggatcaccaattcaaatgtgtaaatgtgaaaaggtaaaaccaatatacagagaaccggagtagagaagctagaaattaagctaagaggcaggtttcccatctagctcttggttatgtaaaagaaggtacagacacctctccctgctgtagtcagtggaggacattgctggccacaaacccatggaactcagacccatggaacatgttgctcagtagtcagtattgctggatgtcccagacctgcagacttctgcagggccacaggaggtgatgacccaccaccagaaaggaacagagatggaacttgttccttttccctacaaatctggtgcctaaaaaaaaaaatcttaaagaaaaaccagaagaatctagtaataacagacaaatttcttagtatataatggtggcagatacccagggcagggatttcccaaccccagggccatatgcacacttctctgaagtgcttgtagagagtgaatgtgggcaaacacacccagcctaggaacctggggtaggatagctattatcctctggtcttgctgtcacgatttcaggacaggccctatgagggctacattggtttgagttctaaatcctcatttattgtccttgtgatgtaactgaagcccttgaggagtgctgaaggtcaaagcaaggatagcaagtccaacactagatttctaatctaaagaagttcaacagaaacaagatcagagattaaaatagtgagacaatgttgagaattcagaaaagctaaagagaagtacttagggtgatcagaaaagctaaaagaagtactatttagtgtgaccaggagtaatgttagatataaaatgaggccacctgtggcatattcttaaagagttcccatggatggatcatagttattggaaagagaagagtggatcttctctgaggaagtctgtcttctgtctttttcctacagctcacattatccctgagctcttatactgtctttatattcctgaggattacaatgctaatgctctgtgtcttaagactgatggtggatgaatgtctcagcatgttgaataccagtatggcctttaaggatgatgtttactataataaataatctgagatagcttttaataacttagctgttcatccatgctaactaatctcctgtacacaattcctaggtaaccatagtttctttggtcctacaatcactccaccttccataaggcagatatgttgtctgttttcttaaataattacaatgtgaatgtttatagcaatggcaggattaagtatatactacacaaaatgtttattggaagtattaaacaatccttgggattcctatgaggtcaaaaggagaagccaactaaaaaatttatttttccagatgtcagaaaagaaagcatacatgcttatgcatgaaacaattctgcaaaaaaaggatgaatttcctccatcacccagatttatacttagagtcagacgaagtcgcctggttaaagatgctctgcgtcaattaagtcaagctgaagctactgacttctgcaaagtattagtggtacagtaaaaagtctcattgaacatttttacttctgtgggagggatgcattcatatgatgtaacaaatgctctctgaaaagagcctgcatttgcctctatggttatcaatcttttggtttccagaattcccctcttacccttcagagaatagcaataggatgcttaactgcacagtgggctatgagttaactattagttactgatgactacaaaaatgctgcataatgaaacatcccaaaacgtaaaggctcaaaatgacaataatttattttacagatctgcagttcagtggaggacctgctgatctaggctgaactcatctgggtggctttgcaaattttatctgagtttgtgtacatgtctgggagttggctagggactggctgacctaggcctggctggagcaatttagctctgcttcctatgtctttcattctcctcctggggcgagcaagcatgttcttcccacagtagtgccagaggtgcaagatagcaagaccaaacattgctttagtcaaagcagtcataaagctgaacctaagtcaaaggctagggaaatatacacagcctcttcagtgggaggaactgcaaagtcatatgcaaaagacatggatcacagaggggtgaagaattggggctataatgcaatcaaactgctagaggaagggatacttttcctacatgttggctctagtttcatcacttaagaccttccactaaagaccttccactatatgagtttcaatgctagccatccttccttttatcctttgtgggtgcttacagggtttttattgtgtagtaactcaggttatttgccctcttgaggctacagaataatgactaactctgtaggtaagagctggagtctgtccagaagggagtggattttctcgatgtcagccatgagaggaagagttgggctgttagagaagaaatcagaacctgggaagtgggattcagataaaaaagggattttcccagcatgtgactccaatggaaaacaaaaactactttataaaccaggctttctagttgtatgtctcccttcatacctatttttctttaaatcttaactgtaaaggaatcagtagaaaagtattccccttatgagagatgaccaaggggtaaaaaaaagtaaacttcaagccagatcaaataaaaatacagactctgaacaagggcaaggttgtcagggcccatcatgagtgagtcttgacacggacagacttgctagtataaatgagcagaaataggaaaatcagaagtaggcttaatttgttattgagatattcagaagggaaagtggggcaggcccttaaacatgatggtctattgatcgaagcagcagtagataagattacccaggcaaagagagtagagagagaacaaaaatctaagcaacaaaaattagaggtgcttatcattaaaagataaaagtaaattacccaaaaaaggatgtagaaaagaaatagttaagagacatgggggaaaaccaagatagtacatagccataaagtccaaaggtagagaaagcttttaaaaagagggactggggccaggtgcggtggctcacacctgtaatcccagcactttgtgggggccaaggtgggcggattaccagctgaggtcaggagtttgaaaccagactgcccaaaaatacaaaaactagctgggtgcggtggtgggtgcctgtaatctcagctactcgggaggctgaggcaggagaatggcttgaacccaggaggtggagattgcagtaagctgagatcgtgccattgcactccagcctgggcagcagagtgagactccatctcaaataaataaataaataaataaataaataaataaataaataaaaagagggactggttaatgctgatttctcatttgagagctatgggcaatctgctctgctggttcctgcaaaggtctcatgcccaggcagactgggagggctgttttgcagaagcccaaataagagtagagacaggagaaaccaaatacttgttgactggagccagccaaggttgtgaagtctgaatgatgagatggacaacaagatagaataatcagggaatttaggggcccacgggtttgaagaacatcaaaatttggtttgagatactggtcaatgtaactggtgaatgctaagtcttgctagagtcccccttcacttggtccatgtagcagtgtaaaggatgcacacaacaatctgagaataaatagattcatggccttcactgctcagcagcaaactgagggaagacagattgcaaggaggtaagggctatgtgattctaataattctagagactgcaagaatggtcgttagaggtttaaaacttccataaagctcaaaacattgtattttaagtcaggatctgggactatgttctctttccttaggttgaatttattaatgaaatttgtcctgagtctggaggggttagttcagagttcttccactgtatgtttgaagagatgaccaagccagaatatggaatgttcatgtatcctgaaatgggttcctgcatgtggtttcctgccaaggtaagtcttttcttttttttttttcccccagaacagaaaaggcaccccatatactgcaacattaacaccatagatagtggtgtaaaattaggtcatatagagctttgctactcatattttgagtagtactcgtatggttcacagagcagcagctatggcgtcacttggggagctgttagaaaagcagaatctgaggccctactctacacctactgaatcagagcatgtattttataagatccttaggtgattcacatgcacgttacatttttaatggttttaataaattatacttgagaaataataaactgcatatatttaaggtgtccagcttggctcagcctggtggttcacacctgtaattccaggattttgagacactgaggtgggaggattgcttgagtagctgagactacaggcgtatgtcacaccaggctaatttttgtatttttagtagagacggcattttgccatgttggccaggctggtctcaaactcctgacctcaagtgatccacctgccttggcctcccagagtgttgggattacaggtgtgagccaccacgctcagctgaatcaccttttaagaatgaaaaattatctctaggattctatcagtcatttctgtcctaatttaaaacactttagattactgcttctcaaaatttaggaaataacctacatatccatcagtaggagagcaggtaaacaaattgtagtacatgctgagcatcctgtaatctgaaaatccaaaatctgaaatgctctaaaattggaaactttttgagtgccaacatgatgccacaagtgggaaattccactcataagtatttaatacgaactttgtttcatgcacaaaattatttaaaatattgtttgaaattaccttcaggctatgtgtataaggtgtatacgaactattaatataaatgaattttgtgtttagacttcggtcctatccccaagatatctcactgtgtttatgcaaatgttccaagtctgaaaaactctgagatctgaaacactgctggtcccaagcctttcacatagggatactgagcagaatctcagtatcccttttttgagactccggctcaaaaaaaaaaaaagaaaaacaaaaacaggtgattcatggccaggtgcggtggctcacacctgtaataccagcactttgggaggccgaggtggggggattacttgaggtcaggaattcgagaccagcctggccagcctggccaacctggcgaaacactgtctctactaaaaatacaaaaattagccaggtgtggtggtgcgtgcctgtaatcccagctacttgggaggctgaggcaggagaatcacttgaacctaagaggcagaggttgcagtgagctgagattgcgccatagcaccccagcctgggcgacagagtgatactctgtttcaaaaataaaaggtgcttaaaaaggaaaaaagaaaaataaaaaaggtgattcatgtctgtaattattatatttttgtaaaggtccttaaagtataaacattttctttcttaaagtaacaaaaaaattgaggcaggcggatcaccaggtcaggaaatcgagaccatcctggctagcatggtgaaaccctatctctactaaaaatacaaaaaattagccgggtgtggtggcacgagcctgtagtcccagctactcgggaggctgaggcaggagaactgcttgaacctgggaggcagaggttgcagtgagccaagatcgcaccactgccctccagcctgggtgacagagcgagactccatctcaaaaaagaaaagtaacaaaaaaatttgtcttcatttctgtattagtaacacagatcatttaatctgtgtatgaaattgtaatttcatacaatattttaaataattttgtgcatgaaacaaagttcgtattaaatacttatgagtggaacttcccacttgtggcatcatgttggcactcaaaaagtttccgattttagagcatttcagattttggattttcagattacagttctaaaaagaatcacatgttgagcttctattgtgttatggtttgaatgccccaccctccccgaaattcatgttaaaacttaatccccaatgtggtagccttgaaaaggtgtcctttagaggtacttgggtcatgagagttctgccctcatgaatagattaatccactcatggattaatgagtaatggattaatgggttatcatgggagtggaactggtggctttgtaagaaggggaagagaaacctgagctaggacactcagccccctcaccatgtgatgccctgtgcagcctcaggactctgcagagttctcatcagcaagaaggccctcaccagatacaactgctcagtcttggacttcccagcctccagaactctaagaaatacattccttttctttataaattacccggtttcagatattctgttataagcaacagaaaatgaactaaggcatatttattagtcccctttcccataaacttccaaattgttcttccaaatggcagaaaggacaggcaggaggaggagaaagatgaatacatgtgaaaaaatactgaaaggtgttttgtatcttttcgagaacaaatggaccctctaaaatataggaatggctaaggtgtgccaatggtatgattttttgttggtcaatcagcaagcatttatttaatgtttcttgaggttcctacattgtattaaatattgtgggatattcaaattattacatgacataatccctttcctcctgaaactctatagatgtagttgtagcaataggatcaacacaccagaaactttaccaattggctctaagttatagattgctgacttaatatgtaatagtttttgagaagcatgacaggatggggaaggaagcactgatgtgggatcagaagcctagagttctaatcttcagtgatggtgagtgtgtcatttagcctctctgagatttcggtttcctcacctagaaaatggacgtcataatttctgctctgcctgctttgcagggctattgtgaaaacaaaacaaagtaaggtatctgaaagtaccatgaaggctttagggcactatacaaacttaagggattcttggttaggagagaaagaaatcaagaggggactgaagtgattgcatttgaaagtataatggagaggcgaaggcctgaggttgaaggttaaggaatgggatgaaatgaactaaagagacacaggttggggatggagaggagatgggatgaaatgaactaaagagacacaggttggggatggagaggaggtaccaaccttatgaggtacagatgaagaaactgaggtttagagagattaaataaatcagccaatgacagaaaactagtaagtgatcaagccaggatatgagttcaggattgtctaatcccagagctcttactcttaagcattatgctatactgctggataaaaaacagagacaaaaaaaaaaaaaaaccaaaacaaaacaccctgatttgtgtatggctcagtgaagagatgaaatcagctataaccaagggacatattacaaattatgggaaagaagactgattaggtttcaggggacccctttgtcgattacttgtattgtacttagaacttactttcaaaatttaaatgcaattttagaatttattttcacaattaaataaataaatatggcaactagactgtaccatagaatattacgtgagtggcccaaagtcatgcacccactaacagtaaggttggcattggaattgaatcccaaaattttcaggctgttgatctactgtgctgcaatcatggcctggatagatggagccagtgttttctctcaccaaggactacaagtgcagacaagacatgccaacttcaccaggcctctttccttcttccccttctttcttctacctaccttcttggtccctagcgtcagtcaccctccctgacccatatgctcatccctctaagcacacccaagttgtggggctgcattgccaaaggggctgccactcatgcgaggctcatctaatatgcctggtgaccaataaatgtataaagtgcacccttcctttctcagtgtcattattctacatgaatctgaagggaaagactataaaattaaattgtgaaaacctgaatatataaagctgtctgagcatattttttaacgttccagataaaatgaattcatttatttaatgttctgaactatcaatttgtattcaaaattatggaagaaatttaatgtattataatctgtagaagaacttcacatttttattttccggaagcccattttgtttttaatttttgactttcagaaaagggaaccacatttttttttactaatctaattatccctttgtattactaattatttataataccttagggatttttttcttcttttctagcctaaacctgagaagaaaagatatttcctctttggaatgctgtgtggactctccttattcaatttaaatgttgctaaccttcctttcccactggctctgtataaaaaacttctggaccaaaagccatcattggaagatttaaaagaactcagtcctcggttggggaagtaagtaaatataacgttttttcaggaccgtatctagtaagtctcagttgtttaggcataaataatcttacacacagagagacagatatggtcttcaatttcaataatgtatgctcttgagaggaatttgaattttagcatgatttataattgagtaaaccttcaaaatggaggaaagctgagtgttcctctaattattaacaagtggaagaaacaggagttctggcctggtctcttgactttatccaggtggaaacagttgcttcagagagcacaatatatatgtgcatcatcacacatataaatatttatgactatacaagggtgtgtgtgtttgtgtgcatgtaagtctaataaaaaaactgaaaatatgctcaccctaactagtaattgagggaataaataaaaatgagatatcatttttctacttacagattgacacttgttaaaaagtttttcttacagtgttggcaaaaaattgggggaaaggactctcttctcgtgtactgttagtgtgagaatatattggctagatgtgtgctggagcaggggttctcagccttggcaatactgaccttttggcctgtttaattctttgttgtgggagactgtcctgggcattgtgggatgtttagcagcatttggggtcacacccactggatgccagtagcaaccttccctccaagtgtgacaaccaaagatgtctccagactttgctgaatgacccctaggggacaaagtcatccctgattcagaatcactgtctagaggaaacagctcatttttgtaatttccatgaagatgtagcagtgtctatgtagtaacaatggtccaacaaatcaaactgtaaatagaggcaaactctagggaaagggaatgagaagatggaggataggaaatttatattatattttatacatttctatattgttcacaactttttccattgaaaattacttgtgaaactttataagatcaataaatataatttttaaaaccaaaatcttcattaggagtttgcaagaagttctagatgatgctgctgatgacattggagatgcgctctgcatacgcttttctgtgagtactaatgaaagccaaattatagtttagctttaatctgtttctaaaaaataatttttattatagtatcttaaatttgggatccctttttttttttattgaggcagagtctcactctgtcacccaggttggagtacaatggcgcgatctcggttcactgcagcctccgcctcctgggttcaagtgattctcctacctcagcctcctgagtagctgggattatgggcatgcgacaccatgcctggctaatttttgtattctttgtagagatgggtttttgctatcttggccaggctggtctctaactcctggcctcaagtgatccacctgtctcagcctcccaaagtgctaggattacagggataagccattgtgcctggcccctgggatcccttttttaaaagacattttatttctgtaccgcaagactttccccttatcttcttctcatgtctatatactctcaaataaagtgaagctatggtgattattcaactagtgtaaataatttaacaactaaacgataatttaggcatgaaagtaatgtacaacatgtactagggtaggcttttttgctttcacatgtatttaaaaggctgaactacataaaaaattatttagctccaagttattttcagttacataggggaaaatgtattggcaataaagatattatgggtggttgattattcaaacttactttgatatttggtacctgaatacattttggttacagatacactgggaccaaaatgatgttgacttaattccaaatgggatctccatacctgtggaccaaaccaacaagtaagttttgacagctagaatatctgttttgaatatactgtacataaaatgttgtatcactattcttttaaaatgtatttttaaatatggttcacacctgtaatcccagcaatttgggaggctgaggtgggtggatcacttgaggtcaggagttcaaggccaacctggccaacatggcgaaaccccgtctctactacaaaaattagccaggtgtggtggcacatgcctgtagtctcagctactaaggaggctgaggattgcttgaacccaggaagtggaggttgcagtgagccgggattgcgcaactgcactcaagcctgggcaacagagtgagactgtgtctcaaaaaaaaaaaaaaaaaaaaaaagcattttagcttctcaggtgattgttttagctcctaatcttttagaaaaaagaagcttttaagataaaagaaaaggagaaagaattcagggttcaatatttcctttgtagctctttttactatttattcatttagcaaatatttttgagcccctattctgtaccagactctattctaggtgctggagatacagtagtcaaaaagacagacaaaatttggagcttaaattccagtggggcagaaagacaatacacaaatgaatcattattatttttaatagagatggagtcttgccatgctgcccaggctggtctcgaattcctgagctcaggcagtcctcacacctcagcctcccaaagtactgggattacaagggtgagccaccgcacctggccacaaatgaattattatgtaatataatgtcagataaggatgagcactctgaagaaaattaaaactgattaagaaactagggagttccaggtggtggtatgctggagctcactagtaccagcttgtgagagctgattgttaaattttcaaaaatgttaagagtttattatcaaagtattagtagctgaaaatcagccacagtgggaatattaacaccacagaaattcgccaatgctgcaaatgtgtgtcccctcccctcccactccttttcagagagctggttgttagatatttaccagcacaccaatggttacaggggaaggcagacaagagttgatttagataggctagtccacaaaggctgcccaaagtgtgggagacaatcatgtctctgatggaaatgcctccagtagcaaccctgccatcaggaaattaatcatttagtagaaattacatcctgtagtataagacagaccttgcaggaataattttcacaaagtgacatgtgttgtgagaggggacaagcaaaggaacaaaaggatcaaccctgagaaagtcttacttatattgaaatctaatggatggtagaagttatcaggtaaagaagaaatgctgcattctgtggcctaactacaaaagagagacaagacctatgaacggggccagaagtgaaaatggaagtgggagctgggcaccatggtgcatacttgcagtctcacctactcaggaggctgtggcgggaggttcgcttgaggccaggagtccaagtccagcctgggcaacacagggagaccccatctcttaaaaaaaagaaagaaaaagaaaggaaagagaaagaaagaagaaagaaagaaaagggaagggaaagggaaagggaagggaagggaaaggaaagaaagaaagaaagaaaatggaagtgggaagaggccccttgctgagactggcaaggtcagataattgagggaggagctaggcttgggaaggcctgttgatccctgctaaggaggtttggaatttaccccaagggcaatgggaagcctttgaaagactttaagcaagagaatgacatattcagattcatgttttaaaaaaatcctcctgactgcagtgaggaaagtgagccaaatagttttaaaccttctgattatattttctaaatttctttcttctagctgaccaggttttggtcacaatacaacattcttgtgctatatagaagtaatttacttttccttctcaatagaaatagtaaaaagaacaaagtataaaatcttttaatcattggccttttccttcctttctttttttttttttttttttgcttccctcaaggagagactatgtttctaagtatattgattacattttcaacgtctctgtaaaagcagtttatgaggaatttcagagaggattttatagagtctgtgagaaggagatacttagacatttctaccctgaagaactaatgacagcaatcattggaaatactgattatgactggaaacagtttgaacaggtaggtgatacctaaagtgccccaatttttccgaacaacttctatatattccaccccactcaaatcatttttctccctctttctctcaagaattcaaagtatgagcaaggataccaaaaatcacatcctactatacagttgttttggaaggctttccacaaactaaccttggatgaaaagaaaaaattcctctgtaagtactgtggtactagatggacacataattatgtatcttttaaaaaggtacagtcttgtttagaatgaagccattgaagtggcctcattgtctggggtgacacccaaggttctttgtctcacagccatggagatcaaggacatggacacacacaaagggtgaggtatagagcagaaacttaataggcgaaaagagaatagctctctgctacagagaggggtcccagaaaaatgagttgctgatctgtggtgaaatgcagggttttttatagatgagctagtgaggaggtggtgtctgatctacatagggcatgaaaaacgagttaggaccaggtgtaccatccgcatagggcacgaatctctggcagcccctaccccaatctttgattatacaggtgggtagctactccatggtgcttctttcttactgtgcatgtgctaaaaaaggggggaggtggaacccccatggtggacatgcctggtcccaggttgccctttctattggtggagctgctggcattcccccgtgctagcttccagccttcttatctatgtttgcagcccgatattccaggctgctctttgttagaaaagaagtgatttcttggactgctttttgttagaagggaagttctgctgaggactcttttgccctcactatctgcctaaaataattttctatctctgtatcaccattcttgcaggtgggtcacatgtgttagtggcagagcaaggatgagaacccaggctccctaccttctagaccagcattctttctcttactcaagcctgtttctttttttttttaagtagagatttgctaatttactactttttctacactgactttttctgcaccctctttcctcacttcagctggctcctaagccttttatctcatgttcctatcttcatctaattatctaagtcctatgatgttcgaatgatgccaactatctgttttatagtaatatatcatttagaaataataatggcaacaacaactgatgataataatagcagcagcagcatttactgtgtgcttattctgtgccatgcactatgctgactgctttgtatctattacctacctttttcctaacagcaaccctacgaggtaggtactattcttttttccccgtttcagacatgaggaaaaagaggcttggagcatttagtagcttgcccatgttcagacagctggtaagtatgggaaccagaatagaatccatcaggctgactccaaagcccaggctcttgagcactaagctctgtagcctcatggtataagaacttctcttggtgggaaccctaaggtttctctagggcagacttaatgacttctctcaccatctcatcccatttgtcagctcttcctgagttacacatctttcttcttgatatttttgttgctactaaggatgctggaggacaattccaacttgtccacagatccaacctatttctctataagcccaagctgcctttctaatcttctctcttaatgggaaacttttgattcagcccagtggttcagctgtctgtacaccccatgagttcacttcttcccacctgtggctttttcctgagctttgtcccctgccttgaaagctcagccaaatcctgtcttgagaaatagcctggtgtgacctctgtgaagtctctctgaccactcagcctggtgtttctctccctgctgaatcctttaagctcctaacctcattcttcctagatgagctaaataaacttccttcttgctactatcttttcatgcatataattttcccccaactacaccatgaactcattgaggacaaagaccaaatgtcatgatttttatacattcaacatggtctaggacagttctctctgcctaaggacattcaataaatacttactgaatgaagtgattaatttcttccttttcattatgttttactctttctatgaaatatcttaaccaaattttattcctttctagttttccttacaggacgtgataggctgcatgcaagaggcatacagaaaatggaaatagtatttcgctgtcctgaaactttcagtgaaagagatcacccaacatcaataacttgtcataatattctctccctccctaagtattctacaatggaaagaatggaggaagcacttcaagtagccatcaacaacaacagaggatttgtctcacccatgctcacacagtcataatcacctctgagagactcagggtgggctttctcacacttggatccttctgttcttccttacacctaaataatacaagagattaatgaatagtggttagaagtagttgagggagagattgggggaatggggagatgatgatgatggtcaaagggtgcaaaatctcacacaagactgaggcaggagaatagggtacagagatagggatctaaggatgacttggacacactccctggcactgaagagtctgaacactggcctgtgattggtccattccaggaccttcatttgcataaggtatcaaaccacatcagcctctgattggccatgggccagacctgcactctggccaatgattggttcattccaggacattcatttgcataaggagtcaaaccacaccagtcttggattggctgtgagccaattcacctcagtctctaattggctgtgagtcagtctttcatttacatagggtgtaaccatcaagaaacctctacagggtacttaagccccagaagattttgctaccagggctcttgagccacttgctctagcccactcccaccctgtggaatgtactttcacttttgctgcttcactgccttgtgctccaataaatccactccttcaccaccca

SEQ ID NO: 2503 - DNA, 64358 bp, Homo sapiens; identical to SEQ ID NO: 2502
  source 1..64358: mol_type = genomic DNA

SEQ ID NO: 2504 - DNA, 7203 bp, Homo sapiens
  source 1..7203: mol_type = genomic DNA
ttcttatctttatcatttaatcattacccctcgggtacacaggacacacaaatttcatttttcagatttcactttaagaaaattaataaatacagcaaacattaacaacactgtgatgggacgatcatcagaactgtggtaactaatcagcaatagctctcaacctttgcacagcaaagttaggaaatttgactcgttaatcaatatgccatatgcctatctttaaaatacaaaaaaactaagatttatacatcttagttcattagttttaaaaagcatcttcattttaaaagttggcccaattaattatagatttagtcttttcttgatgtcaacaaagtctttaaaccccacagcactgtaactatcttggcattaaaatagtttctatacactttctaaaaaaaatcatcttcagttacaaggctttacacttatctaaattgcctcccacttccatttacttgagttttagacatccaacttctaggggatactgttagaacaccaaaccatactaatcttcagattgaagaggggttttgtccattttcttaagatctgtggtcaagaataaaccctaaaaaaactgttcccattctcaacatcttaaaaaaatggtagttgtcatgacgtacctactaaagttacaaattctccttgagccagaattcattttaaatggatcagaattattaatgttggtgattaatggtgatttctatacagtagaaacttccatctaaatcagattgagtcatttgctcctcttaacaaaaaatctgatgttcgacacaattgcagcctatcactaaccctgctgttcgcttgcatgtatcttgtttttaaaaatcttgtttaaatcattctgaaagtaaaactagtttttcctcctttatatatagcaccgaatacttgcaatgtttgacaaaaccttttatcagcccattaacctatttataagcataaagtgagtatttttaaagggaaaaactttgccatcccttatacttatttaaaaggtactgctaagaggtattattagaaacaagatttaaaaatatgtaacaaaatcttaagttcttaagtgaaagccatttaactagtatttaaaacctctgcaattattagtttattagtatcatccaggactcagatgttcagtattcctcctgaaattacataaacaaatgcaaatggaaagaatccaagtctaaattatataacaaaacagcactccatcacaaaagcgtgtaaaattacaagaacgctattttaaaatactggcactttaagaaaacgataatctcgaaaaccacaaaattgccaaattgttccctaaactcctaagcagataaacatgactaatgaatgagtttgttttgtaaagaaaaatcattcaaataaattgaataattcatactgagatgcaaagtttgtcttctttcttcctatctacttggatttataaaggggcaaaccgtaatataggaaaatataccctattttgaatgtggcatctttgtttgaaaagctggcccaattaattaaaaatacttgtaatggaaagtctcgtttcctgagcagtccatatttagataaatgggaaaagacatctatagccagcattttcatagtcttcactgagactaatgtcaacaaaaaatttaatatggcagtcttgtattttaagctcacgcttttggggatacattctcaggtcttctttaatgtgggaactgcaaaatataactgccattacatggtaatgggagttaaagaatagagtcctcatgtaaaggttagaacatacttttctattagtccttcaaggacagactttcaaaatgtttgattctaataatcccatgctttgagtagattgattactcttcagtttgtaaatgtaagtgggctatgtgaaatttcttaactgatcaagattttggatgttcagttatggatgaaaactatctcaacttaactttacccccattatgatatgcagggtgtgtagacaaaagctttttattagctaactatatgaaaggataaacactgtaataattcatgtgattcaaaatgggcaaaagcaaaagactagcttcccctcaagaagaaaaatttcagacctatgaaaaggacaacaatactaataaaaaaaattgtatttacttagaagcattcagaatgtcaacaaaacagctgcaactttttttttttttttgcaattacagagtggtattcagttaacagaacaacaattatttcgtataagctgcatcagagacaactgaagatgaaaaaactaccatccccatatataactaatttgtgctgtgcaccaacaagaacctgctttaaatttccatgccaatttacaacccccatactgtaccaggcaaggttagtggctattgaaaataccaccaggacagggctatctaaagacacattcggtagtgtgttaactatacaaaaaaagacactgtacagtttaaaaacaaatcttacacagccttacatttcaatttttttctttaaaaggagtgagttgtgtacaggggggttaaatgctttatagacaagaaaaaaaaaactgcgctagaaccaacttattcatcatcatcatcttcttcttcatcttcatcttcttcatcttcctcctcctcctcatcctcttcatcttcctcatcttcctcctcttccttctttttcttgcttttttcagccttgacaactcccttttttgctgcatcaggctttcctttagctcgatatgcagcaatatccttccaaagcaaagggaggataaaacagtagggaagaaaaaaacattaaggaaagaaatagaacatggcagaactttatgaaagaaatcaagattctagttataccaaaatatcacgtatctgtagatccacagcaactccagaaataactagaacttcaataaatgaacataaaaatacaagatcattataacaatctataactcatgaaatggcatagtctaatatttgcaaagttatgcctcattgaggtgcaattatgtaccacatcctaactctattaaaaccagaatgtagagactttgattaaagggtagacactgccaccttctgaatgcaaaaaagcactctacaggtttacactgtcagaccttaatccttagtaggaaatgtggtcttaaaaaaaaaaggtaatttgtcaataaacatgcaattaggttaagaaacatctagaaataaacacttttcagaatgactaaagctgaaaattaagtatttaatatttcaatttactgaactataagagttatagatttccttaatcttattaatttactggacagagcagcagacttgtaatttaacttagtgatgctgtggttttttgagtatctaaaggaaaagaacataaatgtttcaggatatgactaagaaaaatatagcctatattactttgtctagcctgtttttgtactgtatgccaagccatttgaaaatgctcatttttgacttgaagtgactaccaacattttcatgaacttcaagatactggggaataacaaaaccaacataaatgtacacagcctttgtctgagtctgattacattttagtcaaaaaaaccctaatttatttggtcctctgcattctttgaaggatgaggacttatatcaacaccatacttaatgtagctgttaccctaaaaacttattacacctcaaactaagtacaatcatacatctggcgtacttgtcatcattttaccaagcaaacccacacttcttaccttttcatatttttccttcagcttcgcagccttcttttcataaggctgcttgtcatctgcagcagtgttattccacatctctcccagtttcttcgcaacatcaccaatggacaggccaggatgttctcctttgatttttgggcgatactcagagcagaagaggaagaaggccgaactaaaaaaaaaattaattttaggattttaagttaacagatcacaaaaacaaatactatcaagtgtacactgcattgctatttaaagctgcctgtgaatttctgtgatgcattggacagggtgcaaatactataatatactaaatatccttcacaaccaaagcttaatttacaactatttaatttatactagctagaaccctagatgaacattctacaattacactatttcaaagggatagtatttttcaagaaataaaaagatcaaaaggagatacactgggcaaaggagaccaaatgtctaattcaaatgctctgggaacactcccacccaacaggaattttatactatttaaatataaccaatatgaacaagtattagctaagaaactttgattgtacatttacactctaaactgacaaagtagcttgctaaatttctctcagattctactgtaaaacgtgtctgggaagtaaaaacaggcaagatactcacggaggcctcttgggtgcattgggatccttgaacttcttttttgtctcccctttgggagggatataggttttcatttctctttcataacgggccttgtccgcttttgccatatcttcaaattttcctttctctttagcagacatggtctacaaaataattatttgtaagtttaagttgtaacatttaagtaaattatcctcaaaaccaatgtcttttgctatgtaatagcgtcccactacgagaatgccaactaggcttttttttgcatcctcaattggaaactgtcttttaattaccttgttagcatgttttaagccctcttaccttccacctctctgagcacttcttagaaaactctgagaagttgactgaagcatctgggtgcttcttcttatgctcctcccgacaagtttgcacaaaaaatgcatatgatgacattttgcctctcggcttcttaggatctcctttgcccatgtttagttatttttctaaaaaataaaataaatatttgatgttagcaataaaattatgacatataagaccttaaagtacttagtaagggaatgaaaaccaaagtactggttatttaacacagtagcgacatcaacctccgtaaaatcagacaagaatatggccgagagattaaattccttgaaggggctatgccaagcaaacaaaacaaaacaaaaacagtccttcagggcgatctcaaaaagtctagacacaaagatatacccatacagtattccctatctatccgcccgagtctgctctgaatgagtatctaactggtcacttaaacgattttaaaatctagaacaccattttaaaccaaccaaaccaaaggtcagaaaacatgctgccaattcgtggctttgcactagatagggaataaacaagggcctaagcgagtcgactcttcctaattatgggaccttaaaaaaaaaaaatcaccgtgcaccgaaagtttcaaaaaacaccctctttgcataaaactttgctccaaagagggagcagcagccagctccggtgctcggaacccggttggggggtggcggtgccaccgcgaggcagcctcgtttcctatcggtttggccctgagatgtatttctgttctgactaaacacgtccggtctgaagtttctccgagtaaacaaggatgagggacaaaagccactcctgctcgtggctcggtggccccctcccccaactcgggaagtattttttggagccgtgaaagttggggtgactcctgcgcggggcgagccccccgcccctagaacttcgccggtggccgcgcggccgaggagagaggacgcggcccggctcccaggcccgaggccgccacgtgcgcccggcaggccctgcaggcccgcgccgccgccgcccccattttgtcaggctcggcgcagggagaagccccgctcgaaatgggggctggctccgcccgcggccgccggggccggcgcgcacggaatggccgctgcgcgtcttctccgcctgcgccgccgccgccgcgagggcgagcgcgagcgagaatatggctccttccctttgtgtgtgtgtgtgtgtgtgtgtgtgtatgagagagtgtgtgagtgcgagggtgcgggcgcggcggcggcggcgggcggggtgcgagccgcgctctggcgcacacactcggccattacggccgggggaggggcggggggcgcgcggccgggccctcccctccgcgccgctcccctccccccgccgcggtgggggccgcccgagggcccacccgcccgccactccccgtctccctccgcgcgggccgcgcgccccgccgcccccgcacggagaacgcggggctgtgaaaagagagaggaaaaaaaaagttgcctcggaactgctgcgcccagctcccccgcccgcccgccttgttttctctccagccagcagcgccgggcccgagtcagccatgttccagcgagcgcagcggcgccgctccccccgccgcccggccgccgccgccgccgcgaccgggccgaggccggccgggcccgcactgccgcccccaggcccccgcgccgccctcgcccgccgcggcgccccgcccgccccgccgcccgcccggctggccgcgctccccgccagcgcccggctcgctgcggcggcggccaatgcagcccggggaagcgccgccgctgccctcccgccgccgccgccgagccgcgccggccccgccgccccggccgcgctccgcgcacgccgcccgcccgaacgcccggcccgagggcccaaaacacgttcaaaatttttttaattaaaaaaaaaatttttttttttgcgccagtcagcgcggacgccgccgggggtggaaactcgcggggcgcggggctcccggcgcctcaggctgcctgagggccggggcaccggcgcggggcagcgttcccggcgcccgggcagaggctcgctccgtgcgcagttccccccacggtcccccctcatttgcctttgtgtggatcctgacccgccggctcccggccgcggggatccggccgccgcgcgggctggggagctgccggaggcgctctccccgccgcggcgctgccccagactcaccctcagcgaggcacagagtcgcccagtgcccgtccggctctcacttgccccggtgctgtctctatggagctcaatgtactgcaatggctgtgagagcgggagccagacgcagcctcctcactctctccgctctgtaacattactctcca

SEQ ID NO: 2505 - DNA, 13148 bp, Homo sapiens
  source 1..13148: mol_type = genomic DNA
aaatgtgaccggccgcggctccggcagtcaacgcctgcctcctctcgagcgtcctcagcgcagccgccgcccgcggagccagcacgaacgagcccagcaccggccggatggagcgtccgcaacccgacaggcaagcgcggggcgcgggacgcgggacgggcgcctttctctcccaaccctgcttgcgtcctagccccaccccgggacactgccacacagcgacagagcccaggagccagaaacttgggctctggagtcaggaggtgcggggttctgatcctgcctgtgcccgtagggtagttggagggaggaacggtaatttacatgcctggcaccctggtatgcggttggtgaccaagatgggagtgtccctagagtatccagtctttgaggtagccaattttttttttaatcctactttcgaggtgtgtttggagttgctctctgctgaatctagatctctggggctctgccagcctgggggagcatgcttggttctcttggtggcatctgtccctcactagctacggaggacctgagccagacatcaccctggctgcggtgttccatgtctcacagatagcccagttcagggaggcgacatgcccaagagtgctcagttagctggtgtcagaactgggccttgaaccttggtctgcccacctccaggtctcactcattcccttctttcaataatttgttagtatttttttttttaactcctgggcttaagcatcctcccacctcagcctccagagtagctgggacttacagacatgtgccatttctcctgagactttgaccagctgtgttgtagaacagggaagcagggcaggagaaaagggaaaaatgacaattctgtggggaggcagggatacggacccatgacagaaatactcccagaaagactttttctttgactaaagcagactttctcaggctttttaaccctgacgccttcatgatgagcataacatgatagggggtcatgagatttgcatctggaactttaacaaaataactgaattaaatattgggtctaaaagccaatcaaagcaattacaaacttggagatgccggttcatggggctgctgcttcttcctgggttatgctgtacctcctcctcctctccactgcgaactacctgtaccaggatttcccccttggtttgggggactgtattatttagtgttttaatgactgaagagtgtttacaaagctgcgagagccaccatgcccagcctgaatttgttttttgttttttgtttttttgtttttttgcttttttgcttttctttttttgagatggagtgttgctctgttgcccaggctggagtgcagtggcgcgatctcggctcactgcaacctctgcctcctgggttcaagcgattctcctgcctcagcctcccaagtagttgggattacaggcgcccactaccatgcccggctatttttttttttttttttgtatttttagtagagatagggtttcaccatgttggccaggctgggctcaaactcctggcctcaggtgatctgcccgcctcagcctcccaaagtgctaggattacaggcgtgagccaccatgcctggccctttttttctttttttttctttttttgagatggagtctctctgtcaccaagtctggagtgcagtggtgtgatctcagctcactgcaacctctgcctccgggattcaagcaattacaggcataattgctgggattacaggcacctgccaccatgcccggctaatttttgtatttttagtagagacggggtttcaccatgtttgccaggctggtctcgaactcctgacctcaggtgatccacctgccttggcctcccaaagcgctgggattacaggcgtgagccaccgtgcccagccacaaggctgcatcttaaagcgattgagaacgtggcctgaatgaggatgggagtctcttgaaggcctgcccacaggtgggaggctcagcagttgggaaggaccccacccccagccagctttgtgttcacctttcccatttcctcctcagcatgccccaggatttgtcagaggccctgaaggaggccaccaaggaggtgcacacccaggcagagaatgctgagttcatgaggaactttcagaagggccaggtgacccgagacggcttcaaggtatgtggcttggtgggactagccctggtggagggtgtggcaggtgtgggtggacccaaggctcagaccagtggtttaagtggggatgctgagggaccagatgggcatgtccaatagaatcatcttaaaaatgatgacactgaggctcagagagggaaggtgagttacccaaggtcacacagcaagttcagcctgctctgtaatgttgtggaggggctggggcagcagtgccgttgactgagcaccggttccatgttgggcattttgtacacgtggtttctaatctgtgcttcaaccctgacgagaaagatgaggactggaaggctcagagaggttcagtgactaacagaaggtcacacagccagtaagtggaaaaggctgaaatcaaccaagaccgatttcagccttgtactccttgtatttcagagcttgtactcctgatctaactcgaatttgcctctgaagataaggaataatataggttggagtcttaacagaacccttttctaacagtgagactgagggtgcctcatctaatctccctaagccacgttttccccatctgtaaaagagtatttcaacagcagggttttcttaagcacccactatatgccaggtactgattttgctgtttcccagcactgttgtgaaattcatgcaaatagaaggaaagcacttgatgaagaaccgggaagatactgggtgttaaaacatcagcgtggggaagagcttgttcaggttgaacagagggtgtgggggtggggagtagggagctatatcccaccaccttcatcccagtcccttttgcaatctgcaccctctgccaccccctacttccaacatgagacatgctttatttattttattttatctgagacagagtctcactctgttgtccgggctggagtgcaatggcaagatctcggtgccctgaaacctccgcatcctaagttcaagcgattctcctgcctcagcctcccaagtagctgggactacaggtgcccaccaccacacctggccaatttttgtatttttttagtagagacagggttttaccatgttggccaggctggtctcgaactcctgacctcagatgatccacccgtcttggtctcccaaagtgctgggattagaggtgtgagccaccacccggccgagacatgctttaatgaggagagatttaatctgtggttccaggctgggtggggtccttgggcctgtaatgggtcttcctcatcctcctcccctctcccttaaaaagatgaggtacacccagttgctgcagtgtgactggagacagtgggtgcagggaggtgaatgctggaatatcccatccccagccagcttagactttggattttgcctctaagtcacagggttctaaggaggcgccaagatccatgagagaatccagtgctcacttacattaagctggtggacgtggcacttatcacagcccttctcatgtgagcgctaagtgccaggctgccctctgtgctggcccagatcctctcacttaatcctcacaccagccccatctagtatgtggcaggtgagggaactgactagcacagttggctagcacagtcacacggacctcagatcatctgctctaggataggataggaagctgggaccagagaaagcaagtggctcacccatggtcacacagttaaggactggcagagttgggtaagaaccaggtccgtcacactcaaaaacccaggctcttttgtaccagactgcctggctttctgtcccctcaaggaatagagctgctttgaatgtttgtggctcagaaataactcagaaactccaacctaaatgtcttaactttgttctccttcaaatttaaacgggcgtattaatgtgtaacgggagttagtgccccaagccaaggtacactcaagacctgttgcctcagcccagcatgcagaggtggtggggttcagaataggcctccaggaaggagaattgtgccctgtagttggttacgcagaggtcaaaagccagaagcacatggccaatctcctttaagcactttcatttcagctgttcccctctcctgagccatggtgggtccctggcaatgcccggtcttcaatctagtttcatttcttactagctgtgcaacctccatgtctcataccctctctgagccttagtttccttttctgtaaaatgggaatagcaattcctttgttggattttttttttttttttttctgagacagggtcttgctcactctgttccccaagctggagtacagtgatatgatcacagctcactgcaaccttgaaatcctgggctcaagtgatacccctgcctccgcctctggagtagctgggactataggcatgcacccccacagccatacctggcttttttttttttttttttttttctgagtcaaagtcttgctctgtcgcccaggctggagcgcaatggcgtgatctcggctcactgcaaccactgcctcctgggttcaagcaattctcctgactcagcctcccgagtagctgggattataggtgcctgccaccatgcctggccaatttttgtgtttttagtagagatagggtttcaccatattgcccaggctggtctcttggccaggctggtctcgaactcctgatctcgtgatccgcctgcctcagcctcccaaagtgctgggattacaggcgtgagccaccgcgtccagctggctagtttatttatttatttatttatttttatttatttttttgagacagaatttcgctgtgttgcccaggctggagtgcagtggcgagatctcagctcactgcaagctccacctcccgggttcacgccattctcctgcctcagcctcctgagtagctggaactacaggcgcccgccaccacgcccggctaatttttttgtatttttaatagagacggggtttcaccttgttagccaggatggtcttgatgtcctgaccttgtgatcctcccgcctcggcctcccaaagtgctgggattacaggcgtgagccaccgcacctggccccagccagctagttttttaaaataattttttgtagaggtgggttttgggctatgttgcccaggctggtctcagactcctggctttaagcaatcctccagccttagcctcccaaagtgcagggattacaggggtttgagccaccacactgggccagtttgttagatctttatataaggattcaattaggctgcttgttttgcccagtggggtaaaaggtttttaggctgagaaagtgcatgatcgtcttttcctcttgtaaaaacccctctggctgctgtgtgaagaggattgtagcgaggggtggcagaaggagtcagagcccagctgcgaagtgaggagggcctttccaaaggcagtagtggacgggacggacagaggtgggggtcttctatgtggctggcggcctgacctgctcactctgctttcagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccaggtgagggtcgggcagcctggggcagcctctgcctccccccgttgttcctccaagggacccttctcattgtaggggagggtgctataggtcatggttaacacagggaaccagagttccagcactgccacttactagctgggtgatcttgggcaaatgccttcatctctctgtacctcagtttccctatctgtaaaatagggataataatggtacctatatcttagacttataaggcttgagtgaatttacagcagtaaagtccccacagcagtgtctggcacagaggaagccctcaaacattcactactgtcataatgggacatgagaatcagttgtagctctctgtgacaacagtctgtggcaatgtataagttgtgtgtgcactagtgtatagccaggttggcactcccagggttacaggtggcctctgccttccagggactctcagcctagccagagaggtttacctctttctacaagtgtctcaaatccagggggaaggtggggtttgcgcaaagcctggaaggatgaattcttgggcagaggtggaggggtgaggggctccttctaaccagatgtcatagagccttctctctctgccaccccctggaggtgccatggggcctggggctcggggtcatgccctcctggctccctactcccagccgtggattgcagaagattctggtcctggcccctgttacggaacaaggcctttcccttccaccctcccccttcagaaaatccagtccgtcttggaggaagaaaatctgtgtctttcagagaagtgtaggcaaaagaaaagggccaggtgcagtggctcgcgcctgtaatcccagcactttgggaagccgaggtgggcggattgcttgagctcaggagtttcagaccagcctgagcaacatggtgagaccctgtctctatcaaaaataaaaaataaaaaaaaatttaaaggaaaaaaatgtttttaaaagaaaagggatttggaatcagaactggctctcaggctcgtgcctataataccaacactttgggaggccaaagcaggaaaatggcttgagcccaggagtttgagaccagccctggcaacacagtgagaccccatctctacaaaaacatgaaaaaattagccagacatagtagcgtgcacctgtagtcccagctacttgggaggctgaggtgggaggattgcttgagcccaggaggtcaaggctgcagtaagccatgattatgctactgcactccagcctgggcaacggcaacagagcaagactctgtctcaaaaaccaaaaaaacaaaaacaaaaacaaaaaaaaacggctcttggctggccgggcgtggtgggtcacgcctgtaattccagcactttgggaggccgaggcgggtggatcacgaagtcaggagatcgagaccatcctgactaacacggtgaaaccccatctctactaaaaaaaagaaaatacaaaaaaaattagctgggcatggtggtgggcacctgtagtcccagctactcaggaggctgaggcaggagaatggcgtgaacccgggaggcggagcttgcagtgagcagagatcgcgccactgcactccagcctgggagacagagtgagactccgtattaaaaacaaaaaacaaacaaaaaaaaacggctcttagtgcctgacctctggatcagtccttgggcaaagcacttaacctgtaggagctacagtttcctcatctgcaaggctaacaaataccattcagcacacctcaccaaggctgaatttcacaaatctaaactcaagagaagaaagcagcggcagaagagtgcatgtactaggataccacttaatattatttcaaaacaagcaacgcagccttttgcatggagacacaggctaaggacatgggcggccacagtgaactctaaatccaggatcattgttatcggttgggagggcaagagcaggcaggggagccaattgggcttggaacatcttatctcttaaggtggatgaaagggatatgaattttctttctttctttctttctttctctctttctttctttctttctttctttttctttcttttctctctctctctctctctctctcctctctctctctctcttctttcttctttctttctttctttctttcttctttctttctttctttcttctccttccttccttccttccttccttccttccttccttccttccttccttccttcctttctttctttctttctttctttctttctttctatctttctttctttctttcttttctttctttcttgcagagtctcgccctgtcacccgggctggagtgcaatggggcgatcttggctcactgcaacctcagcttcccaggttcaagcatttctcctgcctcagcctcccgagtagctgggattacaggcatgcaccaccacgcccggctaattttttgtatctttactagagatggggtttcactatgttggctaggctggtctcaaacttctgacccgtgatgtgcccatcttggcctcccaaagtgctgggattacaggggcgcaccaccgtgtccggccaatatttttcttaccatcttgttatttccaaagtatttcctaacacaacttaaggtcctaccttcagctgggacctggtagcatctctcactgagataggcatgtgtgtcttttgtcttttagctctttgaggagttgcaggagctgctgacccatgacaccaaggaccagagcccctcacgggcaccagggcttcgccagcgggccagcaacaaagtgcaaggtgagagcatccaggaaggggcacttcctctgggctacacatggagggacttggctgtctgactgtagtatctctattcctctgttttctgaatgtttggtggtggtgggtgttgtttcctgctgccccaccccactgcccctgtaaggacaggttctcgctatattgcccaggccagtcttgaacacctgacttcaagcaatcctcttgcctctgcctccccacatgctgcagttacaggcgcgagccaccatgccagcctgaatgtttgttgttgttgttgtttgagatggagtctcacccaggctggagtgcagtggcgcgatctcagctcactgcaacctctgcctcccgggttcaagcaattatcctgcctcagccccccgagtagctgggattacaggcgcccaccaccatgcctggctaattttttttttgtatgtttagtagagatggggtttcaccatgttggccaggctggtctcgaactcctgacctcaggtgatccgcccaccttggcctcccaaagtgctgagattacaggcgtgagtcactgtgcccggccacctgcgtgtttttgtatgagaagtggagtgcaggcaaaaggacctggggtcaaccttcagcgtgtggctctgggcaagccatgagacttctccctacctcagtttccccacccgtaaaatccagtgaggttcagctacttctagcttattggctcagaagtgcacaagaacccctcagaaatcatgggaaactcctgcctccttaatttagactcctttttaggcctttggtcccctgatgtgggccagggagttggggacctgtatccagctatgaacccaccacaggaagatgtcccttctgagtcttgttgtgtgtgagcccctccctcatgtgcctaagaacgatcaaggctggctgtactgaaacatcttggaaacttccaaaaagaccaaagtgctccacaaaatgtaccctcactaagcctaaaacactgagggagggagtgtggctttgggatgggtagcaataaagaggtaaggcttagctacctcctggcaggttatattaggcctcccctcctgtgccaccctaacctacctggcttgtggctttctcacttgtgccagaccacacggacccctctgctaggggtttgtaaccccggagggcttggctatttggtggggtagggagacgtcaccctaatgaagcagttctcaaagtgtggtaccctggctgtgggaggtggtaatcctagtatcccctcaacggggtctgtgaggacaaagcatttttataacactactactatttttttggttttttttttttcgtttgagacagtcttgctgtcacccaggctggagtgcagtggcatgatctcggctcactgcaagctccgcctcccaggttcacgccattctcctgcctcagcctcccgagtagctgggactacaggtgcccgccaccatgcctggctaattttttgtatttttagtagagacggggtttcactgtgttagccaggatggtctcgatctcctgaccttgtgatccgcccgcctcggcctcccaaagtgctgtaattacaggtgtgagccaccgcgcccggcctttttttttttttttttttttttttgagacagggtctcgctctttcacccagtctggagtgtagtggcacaatcacagctcactgcagcttcaacctcccaggttcaagggattctcccacctcagcctcctgagtaactgggactataggcacgtgccaccacacccagattttttttttttttggctttttttaaaaaagccaaaaataaatgagaaaattagagtttcactttctcatgaatgtgtgttggcattttccaaaggttatgtgacatgtgatgctctctcatggatttgatggctcatggaatgtgtgcctgtatgttcttgtatgttaagaatttctcagttttggccgggcacgatggctcatgcctgtaatcccagcactttgggaggctgaggcacggggatcacttgaggtaaggagtttgagaccaacctggccaatgtggtgagaccccatctctactaaaatataaaaattagctgggtgtgatggtgcacacctgtaatcccagctactcgggaggctgaggcaggagaatctcctaagtccgggaggcagaggttgcagtgagccgagattgcaccactgtactccatcctgggcgacagcgagactccatctcaaaaaaaaaaaaaaaagaaagaaaagaaaagaaaaagaatttctcagttttaatatctaattttgtaaatagtgatagctatactcacacaaacaaaagctcttttggatccttggttgcatttgagtataaaggagttttggaaccaaaacatttgagaactgcacccctaatgcatcagaaggagcaggagcctttaatatgaacaacacacatgtaaatgtcacagtgtacctgcttgcttgcttgcttgcttgtacttcctgtgaccgcagccctgggccaccagacctaaggccctgttttctctggggaagcccttctcatagcccagggcggggctaggattgaaacccagctggtctggctccagagacctgccctggactctgtcctgcttctaaagacctagggagcacccactctgtgcctgaggaggcaggtggcacatctacccaggttgcatggttggctctggcctatcatgttttaaatcttttttttttttttttttgaaatggagtctcactctgttgcccaggctggagtacagtggcgcaatcttggctcactgcaacctctgcctcctgggttcaagcaattctctgcctcagcctcccgagtagctgggattactggcactcgcaaccatacccggctaattttttgtatttttagtagagacggggtttcaccatattggccaggctggtcttgaactcctgacctcgtgatccacctgccttggcctcccaaagtgctgggattacaggcgtgagccactgcgcccggccctatcacattttaataaccagggatgggactgaacttgaattttgacctcagagctcctgctttctagctcctgccccatcatcaccatgcttagcaaacgtgtgagtttgagaggaagatttacagctcagacctaattgctggcaaagtttaaggagaggacagggagcaggcagaagtctgaaaaccacgcctgggcccaagaatgttttcacaatgtggcctggctgcacagggaagaacagacagcttgaagaagtagtgagctgcccgtctttgaaggtattcaagcagtggctagagggacacctgtctgtggtcttgcagaatcctggcgttgggcagtgactgtaccacagaccctgaggccgctctgctttgctttcctatgacatcagacaccctgatgcacgcccacctgttaatgaccttgccccattttctctttcagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 2506 - DNA, 13030 bp, Homo sapiens
  source 1..13030: mol_type = genomic DNA
aactgtagaaaagaatattttattgaaacagtttctcaattaacaatggagcaaagtacaatttgactcaaacctgtccaaccagcatcaacagctactgaaagaattcaaacatacagaagaggtgggggtggggtgaggggtgggacccttaggtcccatctctgccaatgtggcaaaaaaaaaaaaaaaaggaaaagacaaaatgactgacacagccaggttcattcttgtcttggagctgaggcagcagccctagctcctgctacagacggaatactggaggacgggctccctaggcgtaggtatggtgggtcgggggcccccaacctagcagagtgatgcacagaggaaggccagccctgaccctcctccttcatccacaggcctgcctcagagagagggaggtggcatctctacattcacaccatggtctctcctttccccaggatcttgggatagggactcacagtagaaagcacattttggtcagcccagggggtcagggggtgagggaaaggctctgtctgggaggagcagaacagcagaagagaggaggaggcagggagttacaggaacctggggtaccaggctgctgggaagatgcagattatgacagagcttgcacgatgctggcaccccatgccaaccactctacgtggctttcctcttcggagaggtggtgggctcccttcttcactgtgcccctccctcctctggccactaggggtgggaaatacgagtgagaatccttccagatttacttccgccaatccagaggtacaggcttttaggcaaggggcagagaactgcccaatttgctgcaggaagccaaggaaacccagggggaaaggagctggatggggaatggggaagggaggctcagagcaagagaagcccgcagagggaggaaagagcacagataggcactcagaaaccaaacctggtaactgaggctctgcagacactggcctgaaaggatgctcatcgcatggtgggagaggaagggagggaaggaacaatcaccagagaagagtggaaactccccagcaacctgatacccttcccatcaccgggacccatcagccactggcagccattctcttcctacccacaggcaaaggattcagaaattaatagtgatttttcccaaatttagggcctatatgggtagggaacagggagtggggctggggaggagaacagtttccatttttaaccacagaggtactgcagaaggaaccagtgagctgtccctcccttccccttctccacacctccaaatcacaggggtgagaaaggaactccagccgagggcaggaccaacccctcccccaaccctcgatgttaaataaatagaagtggtgggggaagggggtggagatgaatggggaaaacagaggtgggggttatagttcgtcgttcttcaaaggccgcttctgtcctgtcgattgttctttctgttcaggttctgttgggagtttgggggagcaaaggaatcaccgcaggtgaaacagaggaaccaaccccagttctttgcaaaggatttcctgagaccccaccaggcttcccaccgtagccccggctccatcctcacctgctccaggacctcctaactccaaaggctcagtgtctcctggctcggatcctgctttgggaagaaacaggttagtctcctcagaagggaggaagaggctaagggaaggctgggccagtttttccatgaagagccagctagtaaatattttaggatgcatgtaccacatttggtctctttgcctactctgttttttgagacagagtctctgttgcccaggctggagtgcagagtgcagtggcgccatcttggcttactgcaacctctgcctcccaggttcaagtgttctcctgcctcagcctcctgagtagctgggattaaaggtgtgcgccaccacgcctgactcttttttttggtatttttttagtaaagatggggtttcaccatgttggccaggctggtctcgaactcctgacctcaggtgatctacccgcctcagccttccaaactgctgggattacaggcgtgagccaccgtgcctggcctttttttttttttttttttttaaacaaccctttaaaaacgcaaaggccattcaagctcatgggctgtctagaaacaggctgtgcctgccagtttgcctacccctgggctaatgcaacatccacgtgctcaaccatggttgctccaactcaccagtctctactttctcaggttctgaaatgggctctgcatcttcagtctggcctagaaggaaaccaggggtaagacatagcctcaggaaggaaaggaggctgtctccctgtccagcagaacatgcagccaggtaccctgttctcacctgctggagggatgaccttctccccctggtcactggcactggcattgaggggtggctctgcccgggtcccattcttgtccttaggccggggccggggcttggtaaacttggccttattgagcagatactgcacctctcggtccagggccatcatcttagcttcaatgtcttttgagagcaacacaggcttctctgtggcgggcagcttagcctgctcggccagagttgcattcttccaggcctgtgggtgagaccaggagaggctccaagctagccatggagagagcagacatctctgtcccagatggaatcacacccccaaccagcctcttccctcagactgcaaatcactgccacccctggcctcagccccaagaggctaacagactcctcagaagggtattaaaggttctccacaatgaagtcccaacctgcaggtttctggtttacatcctactactctggagtgactacaactgaacaaaccccttgaatagtccttttttttttttgagacggagtctcgctctgttgccaggctggagtgcagtggcgcgatctcgactcactgcaacctccgactcctgggttcaaaagattctcctgcctcagcctcctgagtagctaggactacaggcgaccacgcccagctaatttctgtatatttagtagagacggggtttcaccatgttgaccaggatggtctcaatctcttgacctggtgattcgcccacctcagcctccttaagtgctgggattacaggcgtgagccaccgcgcccagctgaatactcatttcttgactctccactttactgagctctggctcaagagtccccacacatccaaaacagtttctgcttcacatgacacatcagtttcacctagccaaaccctggcccatgttctgaacctagctcaaatcccagcccctcaaagcagctttctctgtcctcatgggatgggcttttttgctcctccaggctgatgactcttatggccatggcccttgcttgggactaatcagaggtgggctcaaatacaaacatcttttgtcttcaggttagatgctaagccaggaggcaggggctgctgtggcttcatctctccacctctcccacagtacctaggatggcagctaagtatctggttaagtatttacgaagtgattacccaggtctcattgatgactttctctaacgttgtcatctccacctcagtgaagatctggtccatctctgggatgagccgggcccccctggaagccagaaaggagaccattagccccagagggagaggggcctggagtgtggggagtgggaagctggtaggaatgaaaaccagtggccttggcaggactgcaaaaagggttcaggggctgctcacttgaggaacatgctggaatggttgaggagattatcgagggcagacagccgttcgggccacttcttgcgctcctctacccgaaaaaacagcccttggcacagcttcctcagctcagccagcttctccttcaacatctgatggatgtgcgattgggcagaggggtggaagggacgacagcagagcctggagtcagccccatgtccttctttatgggctcaagccccagctcttctctctctctgaccctgggagaggaaggagagctcccactccacctgccatgtcctgagaggcccctcaccactgtggtggctccaacaccctcatcctccagccaggtggatgcggcgctgagcttcccagagatctcctcacgctgctcctctgtggacacttcctggtactcgggctggtacagcttgtcctggggagggggacatgtaaacacatgcacccacaagcccagaggcaaggcccacagagccaggtgtaagcccagtgggggggctgctgcctcctgcccactgacctgggtctcaaatatgaatgcttccaagctgttggcagctttttcccgttcctgcttctccaggtctcggagtgtcaagtcctgaagtctatgggacaaaggaggggtagggatgagggagagggcaagtgagaacttgagactctgggtccgacagccctccctcccagggcgccatcccacatcctgcccaccttgcacacacatgtacacacacacaccagctgtcctcacttacttctgcaccgactgagccagcttatcctctggcaagtcaggcaggtccagaacaaccagctccaccccgatctcctctaccattcgccgcttcctggcgggcttctgcttcttctctccctctggggctggagcgacgccctcaggccctgcctctgccttctcacttggtttctgggtgggaagagtcaggggtgtcaggaaaagcctctgccctcctacattctccacaaggccagaaacaaggcaggcgcctgctcccttagcctctggatccacactggccttcctctgccacagctcacctgggcctcagacttgtccccattttctttttctgtggccttttctccctcaggggttgcatctcccttaggttcagggggtgggggctgagagccatcctccactggggcctcagcttcctccttgagctccacctgctccccaggctcgtccttgctcccctctgcagggctctcctcttcctcctgggaaacaccacaggcgccccagggaacgatcaggagcagagcctccaggcaggcctggctcggcaccgccgaccccatgggggttccatacaggtgactgctgtatggaaacggtcaatggcctgcttggactgtggcaatctagctggacaaaggaagagcatctgcaatgaggggaatgggccttgggagcaccagtcaagaaacagctcagagcccagaggatcctggggagtgaatggttaacacaacaggggcaggggtggcctaccctcacccccttcctctgcggctactacctgcatcccccaccgtcctccatgcttccctggctccatcctgaactcacctggacagtatcagtaccattctccttggcatctggtgtggtaccgcctccaaacaggctggaaatggtgttgccaagttctagggggagtaaaacccaaagactcaaaaggagaccacagcagtgactccaccttctaacccaagggccatgccctgtccacctccccaaccttcacacaagtatattctctcccatacacacatgcatgctcatcttactggtgagagtagattcctcttctgcgctgtcctctaccagtgtctcaaatacagactccacctgaaaacaggttcaaaatgaaaaaatacacaggctaatccaccttttctccacaaacatctgccaaagtgggtgtttgcttatgcacactccatgccgtcacaggcctagtctctcacctgccttttctaaggacttggaggtggctgcccatctcctttgattaagagccctccatgaatagggtcccagctcctctttctccaaagagccccctacttctccactcaataactgtattggctattacatccatattacccccagatttgttcttcaaaaacggattcctggccgagtgcagtggcttatgcctgtaatctcaacactttgggaggccaaggcaggtggatcacttgaggtcaggggtttgagaccagactggccaacatggtgaaaccctatctctactccaaataacaaaaattagccaggtgtggtggcaggcgcctgtaatcccagctactcaggaggctgagacaggagagtcacttgaacccgggaggcggaggttgcaagatcacgtcactgtactccagcctggacaacagagcaagactctgtctcaaaaaaagtaataataataataagtggattcctgaggctgcgtggctcccacccataatccctgtactttgggaggttgaggcaggatgatcgcttgatcccaggagttagagaccagtctggcaacatagtgagaccctatctctataaataaagtacaaaaaaatttcgcaggatatggtggcacatacgtatcgtcccagctactcaagaggctgagatgggaggatcatttaagcccaagtgttcaaggctggaatgcgctatgaccatgccattatattccagcttaagtaacagagccaagaccctctccaaaaaaaaaaaaaaaaaaaaaaaaaaaaaaaaaaaaagagtggattcttcaaaccattcaattgttccaagaaatttacaatgcctatatcaaaccattcaatagttccaagaaatttacaatgcctataagcatttataggctataaggaggtctgcaccagatcatcagttagctctgttcagagccaacatttttctgattcctaaaccttttttggttatcttatcctaatgccatgtggaacccactttggaaatggctggcagggcctgagcccctgctctgcacacagggtatcctttagctctcaccctgtctagactgagcacgccactctcatccaggttgaagtgagccttgatgcccttggactcgtagtcaggatacttcttgaagctgtcacccaccccttttagcttcactgtggtcagattctgggagccaaataccctggttgggaaggaaagaggagttcagggggacccaccccagcccatctcgccctctagactacatggcctcctggcacaaggtgtcaggggcactccccaagggcacactcaagaggacggatgcattctccagcgaagctgatcatagctgccctgtttcagccccgcaggcccacatcctccctcacccccagtcctcagattatccagcagccacgcctccccctccctggagctcccatcctacacccctgcccctcaccgaagatcttcaggccccaggaagcccaggtcgccgtagttgatgtggaagttgaaatcatggctgtagcggttaaaggtgatgactttgcgttgagggtagggccccatccgagagaagagtacccgtttattgtgcttcaggctgtgaatcccaggctcctcctccacctccctcgtgaactccacctacacagcaggcagacagaggcacactgttgcacactagagaacccgagtaggttctggggtaaggatgggggtgggatgggggagacctcttagcagaaagacaaagggatgagccagagcagacagaaggggaaaccctacttgggagaggtaaagggagcttgtcacctgctcagtcaggctcactcaccaggatggggtagaccactgcatctcggacgacaaatggcttcactttaaaggctttgctgagcgcagctgcctggtacactgcccccatggcggctgcttcatctgcattgatgttcttccccagctcctccctgggaaagccccaagcctcagcacggtctaccctggagcatgcaaccgggacttccctcccctcagccctccagctgctcagcccaaagccctgccccaggcagaactcagccaagcgctctagcccccacactcacttgcccacggccttcagcagcacctcctgaactctggggacccgagtggccccacccaccaggatcacctgctcaatctcatcctgcagtgggtaagaatgacaggtgcaacagcatgcagttagcactgactcgtcccttgacgtcccatgggtttcctatgccctttcctacggggcattcccgccttcccctactcgctcaccagactcatttcggcactctggagggcctgctgtacaggcccaggcacccgctcaaacaagtctgcacacaactcctcaaattccacacgagtcacttttgccttgaagtccacatcatccatcaggccttcaatctgggagaggatggggactgtcagggggttcttgcccagctcccgctctcttggtgagtaggacagaaacaaaaagaataggtctttgggaggatggtagcgggaggagcatgggccatgccaggcacgagcagcccagttcagtggcagggtcccccaccctctacgtgggacaaaatatagcctcaaccagccacttgtgggcacctgtgccatgtggtcagcgttggcactgaggacggttttgagccgattagcctcacgcagcagcttggccatggcacgcgggttctcccgcacatcctttgctctctgacccttgcgctgctcattgaaaagcccagccaggcgttctcgaagccggagctccatctccaggccccccagggtacggtcaaatctgttgagaaaagggagcagggaaaaaagtgaagaacacatggagtccccgcatctgcacaggagcctctcatccccacatggcacctttccttcatctcaggggaccttgttcatctccagtgccccatgtgtggacacacactctgccctcaactctctacagcacagctgacacctcgcagtgacccttcttccactcattcattcgacagtgtttactgagcattacttatgtacttccctctgggaatacaaatgtggcggtggggagagagacagggtccctgctatggaaaagttgaataatcacacaaatgtgaaattatcactacgtcacatgttgtaaaggtgaggggacaatgcctgcagaacatgcatggggggagattcaggctactgagggagacccaagaacatgtctcctaaaaagtgatgcttgaactgaaacctgaaggatgagttcagtgcaagcatcacttgaactgaagagttcagagttcactagctggaggggaaagaacattctagacagaggcaacaacgttcataaagaccttgaagtgggagagtgcatggcaagttccggaggagggcaagcatcactggggctcaaaaagcgagagggctcagggctcagacaggctgcagaaggcagggttgagacaggcacagggaaagttatggagccagcgacaggtttttaaagaaacaggtaatgattaggttggattttaagaagaaccctctggctgcaatatgaagaaagaactgaaaggagacgtcactaggaacagggagatgtttttaattctgcaaataagaggtgatggtaacttgggctgggtggtaatggtgaagacggaaaaagatgatttcaagaaataagacaacagggcacatgttctcaggatctcctgagggctatgtcacaggccataaaaaaaaatttaaaaagaggtaagacaacaagaatggtaaattatttaactggaaatgacaagagaacaaaaacatgattgaatctgacaccctacatattgcctgcggctccatggatttccttagaatacattttgaaagttccatgtcttccagttttcccaaactgtcctcccctgagcctcagcttccccttactctttgtgagtggtcccctacaatgactgatgcctcaatcaggagaccattcctgcagcatgcaggaaagcaaagcagtgtgtctcctccaagaagaaacccctgacttgagggtcttcacaagcagccctccctgccaagtatccacttaccctactccccggatctgcagctgtggctgcatcccagcttccttagtcttcaccatctggtaggtcacaatggtgcatacggtgctgcctgagcccatgtcatagaacatgatattctgtagagatatcaaggcaactgtcacaggaaccttctcaaactccagggggcctgcctgcccacccacctgcttccaatgggctgtctgactcttaacacaaaactaaacagctccaacaggggctgggaggaggctattggtgcattttgccaagggtcagcccagccatgcaaaccagatgcaaaagggaccaagtggcctccatccttagattcagtcaccctgcatgtctggtcaaggctcccctggctcacctgggcagtggtgttaatatctttccggcggaagacaccatagctgagggcagtggcggtgttgtcattgatgagctgcagcactttgaggccagccatacgagcagcctgcagcacagctcggcgctcggcctggttgaagaagactggcacggtgatcactgcatccttgatgggctgctctacagatgacaacagaaaagggtcccgccggctccataccttagatgagggcttctaatctggtcactaatgacattttggactaggtaattctgtgttgtggggctgtcctgtgcactgtaggatgttgagcagcatccccggcctctacccactagatagcaggtgcacccctcagatgtgacaaccaaaatctatcttcagatgttgctaaatgttccctgggaggcaaacttgcccctgttggagaatcactgccctagatcctggggagcctggccctaagggccccaccttgaccactcacctgcaaaatcttcagctagagaacgagaataattgagaaccatgcccaacacttcctcaggtgagaactgcagctgcctgaggggaaggaaggtagttggagccaaggaaagccaggcattaaggcaggacaatcaggaacacacaccaatgaggagcccagcagcgttgccgagaccaccttccccaacagagcactcacgagctgatctgaaagtgcacagtctgcctctgtgggtcgaaagtcagctcgtgctccgggaagcgggcctggtaaagagctacatgggggttatctgcctgcttccccaggaggtgctggaagtaacgtagcgtagcctttggattcttaatcgcctgaggggtgaagaaggagcagactagtattaggctcccaagtccaccattacctacctcttacatcacagagactgataaggaaacagactctgggggctgccatctcctctcctctgcccaccactctgggaagagggactgctagctcaccatgcttgctgcactgtctccaaagaatctttcattttctttcagggtcacgatcaccggtgttttcctccgagattccctgaggaaaagagattttgggcccaggtgcctgcagcagaaggactcagaagcctcgacactcacacacatttaaccactcagatgccgaagtctgctgtgggcactatgactaacacattcacacttggagcccagactccctcgttccccacccttaacacgggggccaccctcacttattcaagacaatttccatgggcactccaggtttgacaatggccaccttcatggactcactgcccaggtccacagacatcactgccagtgtatctgaagggaaaagaggtttgtcagttagctctcccttcgcccaccttcctgggactccctctaatcaaagcataccactttccatgggtaaacgaagatggcaaaagacaaaaaggcctggacctaacaactcaagagacttctggccaacagccccaagctcaattcccatcatgcatccttcagtcatcatttatccatttgctccctctactggggtacataccactcagtgccaacaggtctgccaagagcacagccaccaaggcccaacagactcgcctcctcggcctctgcctcctaactttgtctgccatagtgcccctgggggaggcgaagaaagaaaacacttaaaactggatacccggagtgaaggagacagaatcacatcccagaacggagaggctgtaagattcatatctacttcattcttacccagggcagatcagcctacttctcccttctccctcctgatgggtacaaaccattctctaatcatcccagcagcgcccacacaaaggcccaagtgaaagagcatgggtcctcggctttgccacatccctaaacagagaagctaacaggacaagagaaaggagacccgagccttttgtccaccacacaggcagtgagtggcgcaccgcagcactgtgcctgttgtcagacacctggggtgcggccagggatccccgcccagggctcaaccacctccccacacctggagctcccccgctgacggggaaagccagctgggcctggacgggaagagaaaggtaatgacgttgggggtagctaggatgaaggaaaggcctatctcctcctcggcatccctgcgggttgtcccgccccctcccctttcccagctcactccccggccccgctgtgcccacagacgcagtgccaggggcggtaaggttccccgcccggcgggtagccgttacccggtgttcacctaaaccccacctgacgaaggcggcggctcccactcccggaaacggatcccggcccgccccagcaagtggggacagaccgggggccgagctgcgtgccccccggtgcgaggccgagcgcccggcgtccgcgcggccctcccttgcgctcccgacccgcccccggagctcgcacgctgtctcccctaggaggggtggccggcccgcacctccatccacccccgctacctcttgcctccgctcctgcggccccagctctgggacagacgcggcacgaacgtacccacgaggccggcagcgccccccacccgcgcccttcacaactcctctcggtttgcaaactgttacattagccaccaacctctcggcggcgtctcgcgcaccagccggccccggacgcggcgcgcgctcattggagcctcg

SEQ ID NO: 2507 - DNA, 13021 bp, Homo sapiens
  source 1..13021: mol_type = genomic DNA
aactgtagaaaagaatattttattgaaacagtttctcaattaacaatggagcaaagtacaatttgactcaaacctgtccaaccagcatcaacagctactgaaagaattcaaacatacagaagaggtgggggtggggtgaggggtgggacccttaggtcccatctctgccaatgtggcaaaaaaaaaaaaaaaaggaaaagacaaaatgactgacacagccaggttcattcttgtcttggagctgaggcagcagccctagctcctgctacagacggaatactggaggacgggctccctaggcgtaggtatggtgggtcgggggcccccaacctagcagagtgatgcacagaggaaggccagccctgaccctcctccttcatccacaggcctgcctcagagagagggaggtggcatctctacattcacaccatggtctctcctttccccaggatcttgggatagggactcacagtagaaagcacattttggtcagcccagggggtcagggggtgagggaaaggctctgtctgggaggagcagaacagcagaagagaggaggaggcagggagttacaggaacctggggtaccaggctgctgggaagatgcagattatgacagagcttgcacgatgctggcaccccatgccaaccactctacgtggctttcctcttcggagaggtggtgggctcccttcttcactgtgcccctccctcctctggccactaggggtgggaaatacgagtgagaatccttccagatttacttccgccaatccagaggtacaggcttttaggcaaggggcagagaactgcccaatttgctgcaggaagccaaggaaacccagggggaaaggagctggatggggaatggggaagggaggctcagagcaagagaagcccgcagagggaggaaagagcacagataggcactcagaaaccaaacctggtaactgaggctctgcagacactggcctgaaaggatgctcatcgcatggtgggagaggaagggagggaaggaacaatcaccagagaagagtggaaactccccagcaacctgatacccttcccatcaccgggacccatcagccactggcagccattctcttcctacccacaggcaaaggattcagaaattaatagtgatttttcccaaatttagggcctatatgggtagggaacagggagtggggctggggaggagaacagtttccatttttaaccacagaggtactgcagaaggaaccagtgagctgtccctcccttccccttctccacacctccaaatcacaggggtgagaaaggaactccagccgagggcaggaccaacccctcccccaaccctcgatgttaaataaatagaagtggtgggggaagggggtggagatgaatggggaaaacagaggtgggggttatagttcgtcgttcttcaaaggccgcttctgtcctgtcgattgttctttctgttcaggttctgttgggagtttgggggagcaaaggaatcaccgcaggtgaaacagaggaaccaaccccagttctttgcaaaggatttcctgagaccccaccaggcttcccaccgtagccccggctccatcctcacctgctccaggacctcctaactccaaaggctcagtgtctcctggctcggatcctgctttgggaagaaacaggttagtctcctcagaagggaggaagaggctaagggaaggctgggccagtttttccatgaagagccagctagtaaatattttaggatgcatgtaccacatttggtctctttgcctactctgttttttgagacagagtctctgttgcccaggctggagtgcagagtgcagtggcgccatcttggcttactgcaacctctgcctcccaggttcaagtgttctcctgcctcagcctcctgagtagctgggattaaaggtgtgcgccaccacgcctgactcttttttttggtatttttttagtaaagatggggtttcaccatgttggccaggctggtctcgaactcctgacctcaggtgatctacccgcctcagccttccaaactgctgggattacaggcgtgagccaccgtgcctggcctttttttttttttttttttttaaacaaccctttaaaaacgcaaaggccattcaagctcatgggctgtctagaaacaggctgtgcctgccagtttgcctacccctgggctaatgcaacatccacgtgctcaaccatggttgctccaactcaccagtctctactttctcaggttctgaaatgggctctgcatcttcagtctggcctagaaggaaaccaggggtaagacatagcctcaggaaggaaaggaggctgtctccctgtccagcagaacatgcagccaggtaccctgttctcacctgctggagggatgaccttctccccctggtcactggcactggcattgaggggtggctctgcccgggtcccattcttgtccttaggccggggccggggcttggtaaacttggccttattgagcagatactgcacctctcggtccagggccatcatcttagcttcaatgtcttttgagagcaacacaggcttctctgtggcgggcagcttagcctgctcggccagagttgcattcttccaggcctgtgggtgagaccaggagaggctccaagctagccatggagagagcagacatctctgtcccagatggaatcacacccccaaccagcctcttccctcagactgcaaatcactgccacccctggcctcagccccaagaggctaacagactcctcagaagggtattaaaggttctccacaatgaagtcccaacctgcaggtttctggtttacatcctactactctggagtgactacaactgaacaaaccccttgaatagtccttttttttttttgagacggagtctcgctctgttgccaggctggagtgcagtggcgcgatctcgactcactgcaacctccgactcctgggttcaaaagattctcctgcctcagcctcctgagtagctaggactacaggcgaccacgcccagctaatttctgtatatttagtagagacggggtttcaccatgttgaccaggatggtctcaatctcttgacctggtgattcgcccacctcagcctccttaagtgctgggattacaggcgtgagccaccgcgcccagctgaatactcatttcttgactctccactttactgagctctggctcaagagtccccacacatccaaaacagtttctgcttcacatgacacatcagtttcacctagccaaaccctggcccatgttctgaacctagctcaaatcccagcccctcaaagcagctttctctgtcctcatgggatgggcttttttgctcctccaggctgatgactcttatggccatggcccttgcttgggactaatcagaggtgggctcaaatacaaacatcttttgtcttcaggttagatgctaagccaggaggcaggggctgctgtggcttcatctctccacctctcccacagtacctaggatggcagctaagtatctggttaagtatttacgaagtgattacccaggtctcattgatgactttctctaacgttgtcatctccacctcagtgaagatctggtccatctctgggatgagccgggcccccctggaagccagaaaggagaccattagccccagagggagaggggcctggagtgtggggagtgggaagctggtaggaatgaaaaccagtggccttggcaggactgcaaaaagggttcaggggctgctcacttgaggaacatgctggaatggttgaggagattatcgagggcagacagccgttcgggccacttcttgcgctcctctacccgaaaaaacagcccttggcacagcttcctcagctcagccagcttctccttcaacatctgatggatgtgcgattgggcagaggggtggaagggacgacagcagagcctggagtcagccccatgtccttctttatgggctcaagccccagctcttctctctctctgaccctgggagaggaaggagagctcccactccacctgccatgtcctgagaggcccctcaccactgtggtggctccaacaccctcatcctccagccaggtggatgcggcgctgagcttcccagagatctcctcacgctgctcctctgtggacacttcctggtactcgggctggtacagcttgtcctggggagggggacatgtaaacacatgcacccacaagcccagaggcaaggcccacagagccaggtgtaagcccagtgggggggctgctgcctcctgcccactgacctgggtctcaaatatgaatgcttccaagctgttggcagctttttcccgttcctgcttctccaggtctcggagtgtcaagtcctgaagtctatgggacaaaggaggggtagggatgagggagagggcaagtgagaacttgagactctgggtccgacagccctccctcccagggcgccatcccacatcctgcccaccttgcacacacatgtacacacacacaccagctgtcctcacttacttctgcaccgactgagccagcttatcctctggcaagtcaggcaggtccagaacaaccagctccaccccgatctcctctaccattcgccgcttcctggcgggcttctgcttcttctctccctctggggctggagcgacgccctcaggccctgcctctgccttctcacttggtttctgggtgggaagagtcaggggtgtcaggaaaagcctctgccctcctacattctccacaaggccagaaacaaggcaggcgcctgctcccttagcctctggatccacactggccttcctctgccacagctcacctgggcctcagacttgtccccattttctttttctgtggccttttctccctcaggggttgcatctcccttaggttcagggggtgggggctgagagccatcctccactggggcctcagcttcctccttgagctccacctgctccccaggctcgtccttgctcccctctgcagggctctcctcttcctcctgggaaacaccacaggcgccccagggaacgatcaggagcagagcctccaggcaggcctggctcggcaccgccgaccccatgggggttccatacaggtgactgctgtatggaaacggtcaatggcctgcttggactgtggcaatctagctggacaaaggaagagcatctgcaatgaggggaatgggccttgggagcaccagtcaagaaacagctcagagcccagaggatcctggggagtgaatggttaacacaacaggggcaggggtggcctaccctcacccccttcctctgcggctactacctgcatcccccaccgtcctccatgcttccctggctccatcctgaactcacctggacagtatcagtaccattctccttggcatctggtgtggtaccgcctccaaacaggctggaaatggtgttgccaagttctagggggagtaaaacccaaagactcaaaaggagaccacagcagtgactccaccttctaacccaagggccatgccctgtccacctccccaaccttcacacaagtatattctctcccatacacacatgcatgctcatcttactggtgagagtagattcctcttctgcgctgtcctctaccagtgtctcaaatacagactccacctgaaaacaggttcaaaatgaaaaaatacacaggctaatccaccttttctccacaaacatctgccaaagtgggtgtttgcttatgcacactccatgccgtcacaggcctagtctctcacctgccttttctaaggacttggaggtggctgcccatctcctttgattaagagccctccatgaatagggtcccagctcctctttctccaaagagccccctacttctccactcaataactgtattggctattacatccatattacccccagatttgttcttcaaaaacggattcctggccgagtgcagtggcttatgcctgtaatctcaacactttgggaggccaaggcaggtggatcacttgaggtcaggggtttgagaccagactggccaacatggtgaaaccctatctctactccaaataacaaaaattagccaggtgtggtggcaggcgcctgtaatcccagctactcaggaggctgagacaggagagtcacttgaacccgggaggcggaggttgcaagatcacgtcactgtactccagcctggacaacagagcaagactctgtctcaaaaaaagtaataataataataagtggattcctgaggctgcgtggctcccacccataatccctgtactttgggaggttgaggcaggatgatcgcttgatcccaggagttagagaccagtctggcaacatagtgagaccctatctctataaataaagtacaaaaaaatttcgcaggatatggtggcacatacgtatcgtcccagctactcaagaggctgagatgggaggatcatttaagcccaagtgttcaaggctggaatgcgctatgaccatgccattatattccagcttaagtaacagagccaagaccctctccaaaaaaaaaaaaaaaaaaaaaaaaaaaaaaaaaaaaagagtggattcttcaaaccattcaattgttccaagaaatttacaatgcctatatcaaaccattcaatagttccaagaaatttacaatgcctataagcatttataggctataaggaggtctgcaccagatcatcagttagctctgttcagagccaacatttttctgattcctaaaccttttttggttatcttatcctaatgccatgtggaacccactttggaaatggctggcagggcctgagcccctgctctgcacacagggtatcctttagctctcaccctgtctagactgagcacgccactctcatccaggttgaagtgagccttgatgcccttggactcgtagtcaggatacttcttgaagctgtcacccaccccttttagcttcactgtggtcagattctgggagccaaataccctggttgggaaggaaagaggagttcagggggacccaccccagcccatctcgccctctagactacatggcctcctggcacaaggtgtcaggggcactccccaagggcacactcaagaggacggatgcattctccagcgaagctgatcatagctgccctgtttcagccccgcaggcccacatcctccctcacccccagtcctcagattatccagcagccacgcctccccctccctggagctcccatcctacacccctgcccctcaccgaagatcttcaggccccaggaagcccaggtcgccgtagttgatgtggaagttgaaatcatggctgtagcggttaaaggtgatgactttgcgttgagggtagggccccatccgagagaagagtacccgtttattgtgcttcaggctgtgaatcccaggctcctcctccacctccctcgtgaactccacctacacagcaggcagacagaggcacactgttgcacactagagaacccgagtaggttctggggtaaggatgggggtgggatgggggagacctcttagcagaaagacaaagggatgagccagagcagacagaaggggaaaccctacttgggagaggtaaagggagcttgtcacctgctcagtcaggctcactcaccaggatggggtagaccactgcatctcggacgacaaatggcttcactttaaaggctttgctgagcgcagctgcctggtacactgcccccatggcggctgcttcatctgcattgatgttcttccccagctcctccctgggaaagccccaagcctcagcacggtctaccctggagcatgcaaccgggacttccctcccctcagccctccagctgctcagcccaaagccctgccccaggcagaactcagccaagcgctctagcccccacactcacttgcccacggccttcagcagcacctcctgaactctggggacccgagtggccccacccaccaggatcacctgctcaatctcatcctgcagtgggtaagaatgacaggtgcaacagcatgcagttagcactgactcgtcccttgacgtcccatgggtttcctatgccctttcctacggggcattcccgccttcccctactcgctcaccagactcatttcggcactctggagggcctgctgtacaggcccaggcacccgctcaaacaagtctgcacacaactcctcaaattccacacgagtcacttttgccttgaagtccacatcatccatcaggccttcaatctgggagaggatggggactgtcagggggttcttgcccagctcccgctctcttggtgagtaggacagaaacaaaaagaataggtctttgggaggatggtagcgggaggagcatgggccatgccaggcacgagcagcccagttcagtggcagggtcccccaccctctacgtgggacaaaatatagcctcaaccagccacttgtgggcacctgtgccatgtggtcagcgttggcactgaggacggttttgagccgattagcctcacgcagcagcttggccatggcacgcgggttctcccgcacatcctttgctctctgacccttgcgctgctcattgaaaagcccagccaggcgttctcgaagccggagctccatctccaggccccccagggtacggtcaaatctgttgagaaaagggagcagggaaaaaagtgaagaacacatggagtccccgcatctgcacaggagcctctcatccccacatggcacctttccttcatctcaggggaccttgttcatctccagtgccccatgtgtggacacacactctgccctcaactctctacagcacagctgacacctcgcagtgacccttcttccactcattcattcgacagtgtttactgagcattacttatgtacttccctctgggaatacaaatgtggcggtggggagagagacagggtccctgctatggaaaagttgaataatcacacaaatgtgaaattatcactacgtcacatgttgtaaaggtgaggggacaatgcctgcagaacatgcatggggggagattcaggctactgagggagacccaagaacatgtctcctaaaaagtgatgcttgaactgaaacctgaaggatgagttcagtgcaagcatcacttgaactgaagagttcagagttcactagctggaggggaaagaacattctagacagaggcaacaacgttcataaagaccttgaagtgggagagtgcatggcaagttccggaggagggcaagcatcactggggctcaaaaagcgagagggctcagggctcagacaggctgcagaaggcagggttgagacaggcacagggaaagttatggagccagcgacaggtttttaaagaaacaggtaatgattaggttggattttaagaagaaccctctggctgcaatatgaagaaagaactgaaaggagacgtcactaggaacagggagatgtttttaattctgcaaataagaggtgatggtaacttgggctgggtggtaatggtgaagacggaaaaagatgatttcaagaaataagacaacagggcacatgttctcaggatctcctgagggctatgtcacaggccataaaaaaaaatttaaaaagaggtaagacaacaagaatggtaaattatttaactggaaatgacaagagaacaaaaacatgattgaatctgacaccctacatattgcctgcggctccatggatttccttagaatacattttgaaagttccatgtcttccagttttcccaaactgtcctcccctgagcctcagcttccccttactctttgtgagtggtcccctacaatgactgatgcctcaatcaggagaccattcctgcagcatgcaggaaagcaaagcagtgtgtctcctccaagaagaaacccctgacttgagggtcttcacaagcagccctccctgccaagtatccacttaccctactccccggatctgcagctgtggctgcatcccagcttccttagtcttcaccatctggtaggtcacaatggtgcatacggtgctgcctgagcccatgtcatagaacatgatattctgtagagatatcaaggcaactgtcacaggaaccttctcaaactccagggggcctgcctgcccacccacctgcttccaatgggctgtctgactcttaacacaaaactaaacagctccaacaggggctgggaggaggctattggtgcattttgccaagggtcagcccagccatgcaaaccagatgcaaaagggaccaagtggcctccatccttagattcagtcaccctgcatgtctggtcaaggctcccctggctcacctgggcagtggtgttaatatctttccggcggaagacaccatagctgagggcagtggcggtgttgtcattgatgagctgcagcactttgaggccagccatacgagcagcctgcagcacagctcggcgctcggcctggttgaagaagactggcacggtgatcactgcatccttgatgggctgctctacagatgacaacagaaaagggtcccgccggctccataccttagatgagggcttctaatctggtcactaatgacattttggactaggtaattctgtgttgtggggctgtcctgtgcactgtaggatgttgagcagcatccccggcctctacccactagatagcaggtgcacccctcagatgtgacaaccaaaatctatcttcagatgttgctaaatgttccctgggaggcaaacttgcccctgttggagaatcactgccctagatcctggggagcctggccctaagggccccaccttgaccactcacctgcaaaatcttcagctagagaacgagaataattgagaaccatgcccaacacttcctcaggtgagaactgcagctgcctgaggggaaggaaggtagttggagccaaggaaagccaggcattaaggcaggacaatcaggaacacacaccaatgaggagcccagcagcgttgccgagaccaccttccccaacagagcactcacgagctgatctgaaagtgcacagtctgcctctgtgggtcgaaagtcagctcgtgctccgggaagcgggcctggtaaagagctacatgggggttatctgcctgcttccccaggaggtgctggaagtaacgtagcgtagcctttggattcttaatcgcctgaggggtgaagaaggagcagactagtattaggctcccaagtccaccattacctacctcttacatcacagagactgataaggaaacagactctgggggctgccatctcctctcctctgcccaccactctgggaagagggactgctagctcaccatgcttgctgcactgtctccaaagaatctttcattttctttcagggtcacgatcaccggtgttttcctccgagattccctgaggaaaagagattttgggcccaggtgcctgcagcagaaggactcagaagcctcgacactcacacacatttaaccactcagatgccgaagtctgctgtgggcactatgactaacacattcacacttggagcccagactccctcgttccccacccttaacacgggggccaccctcacttattcaagacaatttccatgggcactccaggtttgacaatggccaccttcatggactcactgcccaggtccacagacatcactgccagtgtatctgaagggaaaagaggtttgtcagttagctctcccttcgcccaccttcctgggactccctctaatcaaagcataccactttccatgggtaaacgaagatggcaaaagacaaaaaggcctggacctaacaactcaagagacttctggccaacagccccaagctcaattcccatcatgcatccttcagtcatcatttatccatttgctccctctactggggtacataccactcagtgccaacaggtctgccaagagcacagccaccaaggcccaacagactcgcctcctcggcctctgcctcctaactttgtctgccatagtgcccctgggggaggcgaagaaagaaaacacttaaaactggatacccggagtgaaggagacagaatcacatcccagaacggagaggctgtaagattcatatctacttcattcttacccagggcagatcagcctacttctcccttctccctcctgatgggtacaaaccattctctaatcatcccagcagcgcccacacaaaggcccaagtgaaagagcatgggtcctcggctttgccacatccctaaacagagaagctaacaggacaagagaaaggagacccgagccttttgtccaccacacaggcagtgagtggcgcaccgcagcactgtgcctgttgtcagacacctggggtgcggccagggatccccgcccagggctcaaccacctccccacacctggagctcccccgctgacggggaaagccagctgggcctggacgggaagagaaaggtaatgacgttgggggtagctaggatgaaggaaaggcctatctcctcctcggcatccctgcgggttgtcccgccccctcccctttcccagctcactccccggccccgctgtgcccacagacgcagtgccaggggcggtaaggttccccgcccggcgggtagccgttacccggtgttcacctaaaccccacctgacgaaggcggcggctcccactcccggaaacggatcccggcccgccccagcaagtggggacagaccgggggccgagctgcgtgccccccggtgcgaggccgagcgcccggcgtccgcgcggccctcccttgcgctcccgacccgcccccggagctcgcacgctgtctcccctaggaggggtggccggcccgcacctccatccacccccgctacctcttgcctccgctcctgcggccccagctctgggacagacgcggcacgaacgtacccacgaggccggcagcgccccccacccgcgcccttcacaactcctctcggtttgcaaactgttacattagccaccaacctctcggcggcgtctcgcgcaccagccggccccggacgcggcgcgcgctcatt

SEQ ID NO: 2508 - DNA, 15775 bp, Homo sapiens
  source 1..15775: mol_type = genomic DNA
caagcttagcctggccgggaaacgggaggcgtggaggccgggagcagcccccggggtcatcgccctgccaccgccgcccgattgctttagcttggaaattccggagctgaagcggccagcgagggaggatgaccctctcggcccgggcaccctgtcagtccggaaataactgcagcatttgttccggaggggaaggcgcgaggtttccgggaaagcagcaccgccccttggcccccaggtggctagcgctataaaggatcacgcgccccagtcgacgctgagctcctctgctactcagagttgcaacctcagcctcgctatggctcccagcagcccccggcccgcgctgcccgcactcctggtcctgctcggggctctgttcccaggtgagtcggggtggggattgccgtcgggccagttctccgaagccccgggaggaccggctcccgggtcaggtcatgcatgcttaggtagctgtttatgggaaggaggggctagagacagcgattgaaaggcaacagccagtaggttcgaatccagaccctgcatacctccacgtgtggccttgggctatagattgcagctttaaaaaagggtagggggttggagatggaggggaggggcgggcctcgttttgttgcccaggccggtcttgaactccgggggtctagccttacctcctgcctcagcctcccgagtagctgggatgagaggtgtgaaccaccgccttgcttggctagattgcgtctcttacagtttctcagctgtaaaacgggaaacgttatagcggccacctggcagggtatcttggcccagcgcagcacctggccccaggactcgatcatgatggtttgggaacttggctctgtgccaacccaacaaggcttaagggacccccacccccctcaagatgtatattctgttcctcatcctctctgcccctggggaagtccagggctgcttctacttgggggaattccagagctgacttatccgtggcccaaagctgagaagtgggacgccccagcacaccctcccccagctccagcccagctagggaagagggaaggggtcagagggtctttcatggtggtgtaagtttggggaaccaggagggtgggagattgacagcttggttaacagctcaacaaagcctgagatccaggccagcacggtagttcatgccagtaatcccaacactttaggagccccaggcgggcgaatcacttaaggtcaggagtttgagaccagcctggccaacatggcaacatcccgtctctactaaaaatacaaaaattagctggcatggtggtgggcgcctgtgatcccagctgctcgggaggctgagggaggaaaatcccttaagcccacgaggctgaggttgcagtgaaccaagattgtgccactgcactccagcctgggagacatagcgagattctgtctcaaaaaacaaagcgttctgatccggactcagacccagatcgcactgctttctagctgagtaaccatttctctctatgaaatgggaatggtcccagaatctcccttggagaatgtatggagccagtgtcctcacacccccatccaagatagaacaaatctgagacaggaatctttgagtgaggcagtgctgggctcagacattttttcccaccttcggaggcagcagaatctgagggacctgatccaaataagccccttctttctttcttttcttttcttttttttttttttttttttttgagacggagtctcactctgtcgcccaggctggagtgcagtggcgtgatctcggctcactgcaacctctgcctcccaggttcaaacgattctcctgcctcagcctccctgagtagctgggactacaggcatgtgccatcacacccggctaatcactgtgttagccaggatggtctcgatttcctgacctcatgatctgcccaccctgcctcccaaagtgctgggattacatgcgtgagccacagtgcccaccccgtaagccccttctttcttacctgcaaggtagccagttgctacccatcctgtgctgagttacttgtattagcaagggatggggtggctatactcacccaccttacagatggggaaattgaggcccaaagagggggaaactacgtgtctcagggagtgaggagccagtctgattcctggagggctgactgtctccacctgacttcttaggagggaggagggcaccaacttcacattaaaatctggttggacacagtggctcacacctgtaatcctggcattttgggaggcttaggcgggaggatcacttgaggccaggagtttgagaccagccttagcaacatagtgagaccccatctctacaaaaatgtttttcagggccaggcgcggtggctcacacctataatcccagcactttgggaggctgaggcgggcggattacctgaggtcaggagtttgagaccagcctgaccaacatggagaaaccccgtctctactaaaagtacaaaattacccgggcgtggtggcgcatgcctgtaatcccagctactcgggaggctgaggcaggagaatcgcttgaacctgggaggcggaggttgcggtgaactgagatcgtgccattgcactccagcctgggcaacaagagctaaactccgtctcaaaaaaaaaaaaatgtttttcaaatattagccgggtatggtggtgtcctgtagtcccagctacttgggaggctgagatgggaggatcacttgagcccaggagttcaaggttacagtgagctatgattgtgccactgtattccagcctgggtaacagagggagacccgtttaaaaaaaaaaaagtgatggctaaagtccttccatggctccctattgccctcagtataaagaacacatgtggctgggcgtggtggttcacgcctgtaatcccagcactttgggaggctgaggcgggcggatcacttgaggccaggagtttgagagcaggctggccgacgtggcgaaaccccgtctctattaaaaatacaaaaattagctgggcgtggtggtgcttgcctgtaatcccagatactctggaggctgaggcaggagaatcacttgaacccgggaggcaaaggttgcagtgagctgagattgcgccactgcactccagtctgagtgacaaagcgagactccatctcaaaaaaaaaaaaaataaaagaacacatctttagcatggccttcagtgctcacgggatcttcctgaattaatctccccctcttcatccttgctcactcagctccagccaccctgccccgggacatctgtacttgcctggaacttatttcccttttctccggacagccagccctttctcgtcatttagatctctgctgaaacattaccctgtcaccaaagcactgtctattctatcaccctgttttgtttttgtcaaagctcatattaacatcagttattaattatcttgtttgctcataatttttttttttttttttttggagacagagtctcgttctgttgctcaggctggagtgcagtggcacaatcttggctcactgtaacctccacctcccaggttcaagtgattcttgtgcctcagcctcccaaatagctaggactacaggcacgtcccaccatgcccagctaatttttgtatttttagtggagacggggctttgtcatgttggccaggctgatctcaaattcctgacctcaagtgatctgcccgccttggcctcccaaagtgctgggattacaggcgtgagccaccacacccggcctgctcatgaattttctctttaacttccacatcgaaggcaaagtattgtcttgttaaggctgtgcctccagcacccagcacaggctgggcgcacattcccttgatgaacctgatttgtaatgcctgtcgcctcttccctcgtttcttctaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactgtgagtaactgagcccggagggctggactaggcagacccggtgggagagacgtgcaggggcacctgcagaggcctgggggaatctttgccacttgctcgtagggtcaaggaggggctccttgcagggcaggtggggacatccttggaaagtccctttgtgaatttctttgggtacaattaaagtatttacaggctgggtgcggtggctcatgcctgtaatcccagcactttgagaggctgaggctggcggatcacctgagatcaggagtttaagtttcgccaacatggcgaaaccctgtctctgctgaaaatacaaaaatcagccgggcatggtgtcaagcgcctgtaatcccagctacttggaaggctgaggcaggagaacgcttgaacctgagaggcagagattgcagtgagccgcgatcgtgccagtgcactccagtctggataacagagcaagattccatctcaagaaaaaaaaaatgccatctctctatgcctcactctttgaacatatgacacggtcctgcttcagacactttaataaaagatgcaaattaagccaagtgtggtggcttgtacctataatcccaactactccagaggctgaggcagaaggatggtttgagcccaggagtttgagaccagcctgggcaacagagtgagaccctgtttctttcttttttttttttttttttttgagacggagtctcactctgtcgcccaggctggagtgcagtggtgtgatctcggctcactgcaagctccgcctcccgggttcacgccattctcctgcctcagcctcccgagtagctgggactacaggcgcctgccaccatgcccggctcatttttttgtatttttagtagagacggggtttcactgtgttagccaggatggtctcaatctcctgacctagtggtccgcccgcctcggcctcccaaagtgctgggattacaggtgtaagccactgtgcccatccaagaccctgtttctaccggaaaaaaaaagtaaataatttagctgggcatcgtggtgtgcacctgtaatcccagctgctcctgaggctgtgatgggaggattgctttaacccaggggttcgaatcctaggagttcgaatccatcctaggcaacatagcaaaaccccatttttatttaaaaaaaaaaaaaaagatatgagttaaaactagccctgggatggcatttttcacatattggtaacaaacaaaagaattgatggccgggcgcagtggctcacgcctgtaatcccagcactttgggaggccgaggcgggcggatcacaaggtcaggagatcgagaccatcctggctaacatggtgaaaccccgtctctactaaaactacaaaaaattagccgggcatggtggcaggcgcctgtggtcccagctactcaggaggctgaggcaggagaatggcatgaacccgggaggcagagcttgcagtgagccaagatcgtgccactgcactccagcctgggcgacagagcaagactccatctcaaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttgaggtcaggagttcgagaccagcctgaccaccatggagaaaccccgtctctattaaaaatacaaaaaaaactagccaggcatagtggcacatacctgtaatcccagctactcgggaggctgaggcaggagaatctcttgaaactgggaggcagaggttgcggtgagctgagattgcgccactgcactccagcttgggcaacaagagcaaaactccatctcaaaaaaaaaaaaaaaagaaataaaagaaggtatgttgaatatgagtggtatgccaccctcacattagggaagggcagtttcggggaggctgtatttatgtataaaatagccctaaaaggaagtgggagaaatgacaatattagctggctatgagaagagaggctgggaggctgtgggagagggcttgggtgtggagaattctttttgttttttcctttttttgagacagagtttcactcttgttgcccaggctggagtgcaatggcacgatctcagctcaccgcaaccttcacctcctgagtttaagtgattctccggcctcagcctcccgactagctgggattacaggcatgggccactacgcctggcaaattttgtatttttagtagagacagggtttctccatgttggtcaggctggtcttgaactctgacctcaggtgatccgcccgcctcggcctcccaaagtgctgggattacaacgtgagccactttgcctggctgagaattctttttttgttgttgtctttttgagatggagttttgctgtgtccccagcctggagtgcaatggtgtaatctcagctcactgcaacctctccctcccgggttcaagcaattctcctgcctcagcctcccaagtagctggaattacaggcgcccagcaccacgcccggctaatttttgtatttttagtagagacgggatttcatcatgttggccaggctggtcttgatctcctgaccttgtgatctgcccgcctcggcctcccaaagtgctgggattacaggcgtgagccactgcccccagccgagaatttctctttgcgtccttcctactttggggacttcgaatggtgggaaagagttatcaaggccaaaataaggaattcaaatgaaaacaaaacaaaatcaaagaagaaaaaacagaagagcactgggcaggctaggcacgtggctcatgcctataatcccagtgatttagaaggccgaagtagaaggatcgcttggaggccaggagttggacaccagcctgggcaacatagcaagaccccatatctacaaaaaataaaaaacctaaccaagcgtgctggcatactagtagtcccagctactcaggaggctgaggtgggaggatcacctgagcctgggaggtccaggctgtagtgagccgtgatgacaccactgcactccagcctgggtgacagagaaagaccctgtctctaaaaaataaaaactggccaagtagctttgggattagccttgggttccagtcccagcaaggcctttaatagcttgggacatgacttctgcatttactttgcaatcaggtgagacctcctctgatggggaaaatgacacggtgagtgacaaaggatgttctcctatcattgtgtcagggcaaggaagcctctgggtaaatgatcaaatgatcagctttgcttctgatttggagggtgggtgagcagatgctgaccttcccaggtgagggaagtccccgaacattcccagcagcttctggaaaccccagggaaacctctttgaaggtcttttctgcatctctgcctgataggtctttttttttttttttttttttttcttttttttgacacacagtcttgctctgtcgcccaggctggatcactgcaacctccatctcccgggttcaagcagttctcctgcctcatcctctccagtagctgggattacaggcacctggcaccacgcctggctaatttttgtatttttagtagagacagggtttcgccaagttggccaggctggtctcgaactctagacctctggtgatccacccgcctcagcctcccgaagtgctgggattacaggcttgagccaccacgcgcggctctgcctgatagctgagagcatagaactccaggtttgagacctggctctgccacatttctccctctatgactgtgggtgccccactttgccttagtttttacctctgtgaaatggagcagatggctggcacaggtagcaaaggagtaaaagttatgtgggagggtggtacctgagagagactctagcttggtcttgccccacccctggtgtaaacataaagaagcctccctggatggctcaatcttctccaaaaaggttagaggtgtaattcctagaggaggcgaccactagctgggctttgaaggatgtgtaggagttcataaggacaggcattctgggcaggaggaacagcctgggcaaaagttgggagcagggagaaatcttgatggaggcaggaggaggaggaggtaggttggtgtaggccaggtgcagtggctcacacctgtaatcccagtgctttgggaggccaaagcaagaggattgtttgagcccaggagttcgagaccagcctgggcaacatagcgagaccctgtctctaagaaaaaataaaaaaattagggtacagtggcatatgcttgtattctcaactactctggaggctcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactacaggtgtgagccagcaggaagcccagctggttttttttttttctttggtgttttttgtttgtttgtttgagaccggagtttcgctcttattgcccaggctgaagtgcaatggcaggatcttagctcaccacaacctccgacccccaggatcaagctattctcttgcctcagccacctgagtagctgggattacaggcatgcgacaccacacaaggctaattttgtatttttagtaaagacagggtttctccatgttggtcaggctggtctcgaactcccaacctcagatgatccacctgcctcggcctcccaaagtgctgagattacaggcatgagccaccgtgcccggcctttttttttttttttttttttttgagacagagtctcactctgtcgcccaggcaggagtgcagtggttcgatctgggctcactgcaagctccgcctcccgggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgctttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgacttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttaatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttccagagacggggtctcgcaacattgcccagacttcctttgtgttagttaataaagctttctcaactgcc

SEQ ID NO: 2509 - DNA, 14113 bp, Homo sapiens
  source 1..14113: mol_type = genomic DNA
ttgcatcttactctcttaagtcaggtttctggagatggctgtcccaacactggaatccagcctgtctacagcaagggagaaagaggaagctgatgttgggctgagaggggcaggcgttacagggtaggtctcacaaatgccgacgtgacaggcagggcttctgagggggcttcagggaccagcagggaggcgagactcaggcactgacccgcagagagcatggccttggacgcacagtggtgacagcagcctccaagtgtcccccgtgccctcaggcatgagggacagaagcttctggggcccctgcctctttcctgcccatcccctggtgaaggaaaatcgcctctgataggaaaagctggggccagactccctctccctgcattagtgtcgccgtcctgcctgtgaggtccccgggcccagggcacctcccgggacacccgagtggtgatgcacgaccctcagtcctggggcttaggacctctgggtgcccccgcaggtccgtcctggagtcacttcacagtcactgcaaatgggcaccacagcccactttccaacgccccaactttccacacccaagcagctccttgtccctgccaatcaatgcccggtgatgacaactgttcttttataaacaccacacatcttctaatgctttcatgttaaaagcgggagtggatcccacattcacctaaaggctcaggtagggactttttttgcagaaaaccaatttcttgtaacaagtactggaacctcattgtagccttgagtcctcactcctccttttgttctaagtctgggtctgagaagtgcaggcctcacacagctgtcagttccaagtgaccagggctgtaacaggtcctggctgaccctgggaatgtcaggggattctgggaagtaagaaggaggggcatttgcccatagccccggggcagacaatgtgtcccgagggccaggccaggctgtctactccatctccctggggcgagtgcacctcgggtcacctggcagcatcctttccagcccttctggagacagtcagcagctgattcattccgggaaccagcatggcaggtgccggggctggtcagggcccagggctgtacccctcagcactggaccaccccgtctcctgcccccttgggactgttgggctccgaggagcctggcgctggggtcggaggtcttcatcaggaccctggggaccctcagggttgagtggggtggggctgctgagggtggtgggggccgggggagccacctctcactttggggatcattgctgaggtgagaagggggactgtggccaccaggtgataccctctccatgcacctaactgctgctcaggactctggggaccgtgttgccaggcctgcgcctgctggacatgggcgtctccagccctgctgggctgtgtctttctcgctgcagagccaagagccccggcagcccctgtagccaaacacggccctggcacagcctttcttctggcaaactccacccgtgcgtcttccaaaggtggctcaacttttcaccggaacagccgagggacattgttcctcccagggaatgtggcagaggacactgaagcccagtggggacttccgggggctcctcggtgtggacggctaactacacttgtgggcacacacatgagtgggtcctgtggcttccgggcgggaggcaggttgggagcgttcagggcagaagagctcctgtgaccgtgtcccctgcaaacagcctcgcgtgaccccagcagcacagaggccgtcctggaagagcggacgcccagtcttctttttaaaccaaacacccttcggtctcaggatcccgcatcccacgggaagacccacagtgggtctggggtactgggaagagcctggtgctgaatcccgcacgctccgggtagagacagcccatcaccagtcccttcctgtgggtgactggcagtgacagcggggagcccactcacttggggacatttgcctttggtgtggatgacgcttttgaaagggcctcattccaggatcacagccaacgccagcaggttctccctgggatccagcagtggtccttctgggggctgccccaagtgctcccctgcagtctgggagtccatgctcaagctgccacctggcctctcacggtggcgtctcacggaagccctgtccacgctctgggcggtgagctccggtcaaacgtggccttggaagggagatgaaggagagagaggaacatgaagcacccctttcccttctgcaggcagacgtcggttttctcaggactcagcttggtggaaacacagggtttaaagcttcggaaacagcggcctgttcagggaacttcgactggctccgacgggaacaggccggccgtgtttttagcaagctgtgttcctgcatcatctggatgggccgacctggccttggaagtgcgtttctgcggtcggccatcagctcgcctgggtccacaggtgacaccacagcatggtggctgcgcacaccctgagcccactgtccccggggaaccccttctcctgggcggcaaacagggctcggaggggatcctggcccatggcggggagcccggctggcctgcctgcgaagcccagcgccccttgcagccagaggcacctgccaggtgggtgaccgtgtgtggacatttttcccaaattggacaggaatccacatctatgttgctcctggaactgaggggcaaacgagagctgcaggagtggctgccacagagagaagctggcggtgcccggacccactccggacaccccacaggggctgggcgccggtgcctggacccgccctggacaccccacgggggctgggcgccggtgcctggacccactccggacaccccatgggggctgggcgccggtgcctggacccgccctggacaccctggtcggggctgggcactggggagcgcgggggtctagcactcgtctctctgcttctgtgcatgttgggaaaatcccatcgcagtgtgacaaagtgcacaccaggatgccatcccatgccaaggggaggctgcaggaaatgccatgcgcaccatcgagggcttcgctgcgtctccaggaacaacagttgttcaaggcaagggacttttgccttttgaaagttttttgaaactctgaaagacagctggcagccaagcctcccctgggccccccagaacctgctgcttcccacggcaaactcaccagtgagctctgtctccggactcacagcccaggcacctggaggacaaaccaaaatggtcagggcagcagcgatggggggtgtccctaaagcccctggtgttcctgagctctcagcagccccctaaacaccctacttggaagtctccccaaggctcccagctccaggcggggaaaacactcacagatgaggggctccccaggccacgtggcttttgagaaagatcctcttaaaggggtacgtgcctgggaagcacttaaaatgctgtgacctggatctggggcccttctgcggcccagccagcagtggcatcatggccgtggaagatgtttctgggatgactgagattggccacaaatgggaaagccaggggcagcccacaggagccgcccctactccgtggccactgcgcctgcactccattgactgccacccttggggggttctgggaagagccccccccgtcatcaggaccatcactgcagccaacgttcagggcttcctgcgccactgcgtcctgctgctgtgtcttacatggctgaaacacagacctccgggctctgtcgcggagctggccagagtcacagacccacagggcaggagtgctcaaggcagcctcagcggcttccctggaaatgaccaccaccccggcctctacatgcagaagccaccctgcccacccgacctgcagggcagacctcgcagcgcccttctggcttggcagtgtcaggaatgtcagagatgctgggtttcaaaaccactttgtgggatagttcgggttgctaagcctcatgaatattagtgctaccacaacaaagttcctttgtttttttgggggggacagagtcttgctctgtcgcccaggctggagtgtagtggcgtgatctcggctcactgcaagccccgcctcccgggttcacgccattctcctgcctcagcctcatgagtagctgggactacaggcgcctgccacacgcccggctaattttttgtatttttagtagagacggggtttcaccgtgttagccaggatggtctcgatctcctgatctcgtgatccactcgcctcggcctcccaaagtgctgggattacaggcgtgagccaccgtgcccagcctaccacaataaagtttcaagctaaatcagtatcagtgagggaagttaaagcaggcaaacattcacaccaacaggacaaacactaacatccacaatatggggccgtctctacctgcatagctgtgttggaggcatcggtccctgcacacccagcctatggccaccgccacgaccacaagcaggcacaggacagccaggatgctccacgtggccgcgtttttctcgccggtactgactggattctctgtgatcttgtctctctctccgatgtcatttcctacaagaaagaggaaaataacccgacttaaaggatcttagaggaaaagggtcttttttttcatccttgagtagaaagtgttgcaaggaagtatttattccagagaacttccctgacatgattttgaggttttaaaaacaccaaactgatgagatgagggttttctcttacagaggggcttcatttcctgcagggatcttgttcctcctcgtcctacctgggaggggcgataaccccaaccacagccaggggaccatagggctgggtatggtgggaagcacaggttcttactggattttttttttctttttttttgaggcagagtcttgctctgttgcccacgctggagtgcagtggcgtgatcttggctcactgcaagctctgcctcctgggttcacgccattctcctgcctcagcctcccgagtagctgggactacaggtgcccaccaccatgcctagctaattttttgtatttttttagtagagacggagtttcaccatgttatccaggatggtctcgatctcctgaccttgtgatccacccacctcggcctcccaaaatgctgggattacaggcatgagtcaccgcgtccggcccttactggatttttaaaaatcaaagtgaggtcaggcacggtggctcacgcctgtaatcccagcactttgagaggccaaggcgggtggatcacctggggttgggaatttgagacacacctggccaacatgcagaaaccttgtctctactaaaaatacaaaattagccaggtgtggtggtgcatgcctgtaatcccagctactcgggaggctgaggcagaattgcttgaacccgggaggcagaggttgcggtgagccgagatcgtgccattgtactccagcctgggcaacaagagtgaaattccgtctcaaaaaaaaaaaaaaaaaaaaaaggtgaaagccacataacataaaattaaccatttcattttatttattgagcttttgagacagggtcttgctgtgttgcccaggctgaagtgcagcggtgtgatcataggtcaccgcagcctcgacctcctgggctcaatcagttctcccacctcggcctcccaagtagccgggactgcaggcgtgcaccaccaggcctggctaattttttttttggtagagatgagatctcactatattgctctggttggtcttagggctcaagtgatcctcttgcctcagcctcctaagtagctgcaactataggtgtgcaccaccttgcccagccaaaatgagccactttatgctttatttatttatttacttttttgagacacagtcttcctctgtcgcccactctggagtgtagtggtgcggtctcggctcactgcagcctccgcctcccaggttccagcaattctcctgcctcagcctcccgggtagctgggattacaggcacatgctaccacacctggctaatttttgtatgtttagtagagaaggggtttcgccatgttgtctaggctggtctcaaattcctgacctcagatgatccacccacctcagcctcccgaagtgctaggatcaggtgtgagccacccctcccggcccaaaatgaaccattttaaagtgaacaattcagggtgccagtgccatcataaccaccacctaattccaggacctgtaacccccaaaagggaaccttgtgtccatgagcagtcactccccactcttccctgccgtctgctgtctttctgggcagttcatcggggagaatggtcgtgtccatttcagatggactgtgagcccgtgtcagcagcaagaaggagcagatccaaatgagggggtctcagaacagctggggcctctaatttttctcttaaattttgttctcatttagtgcttcatggcactcccttcaaatttcacttttaaaactctagcttggacgtggtggctcacacctgtaatctcagcactttgggaggcttaggcaggagcatcgcttgtgtccaggagcttgaatctagcctgggcaacacagtgaggccccatcgctacaaataatcaaaattagccaggcgaggtgcatgtgcctgtagtcccagatactcaggaggctgaggcaggagaattgctgtcctcctgcaccagaagcctccagttgctttgtgtctcagtggctcaccctattctggacactttgcataaacagagtcccacaggcttgtcctcaggtgtctggctctgtcactcgcataatggccttgaggttctccacgccgcagcgtgcgtcaggacagcggcctccttcctttttcaggctaattctcccctgcacgcatggatcacgtttggtgcatccgtccacccacgaggaacactcgggtggttcctaccttctggctgccatgaacattcacggacaggcatttgtttgagtccctgttctgaatcctctggcctatatcgctaggagagaactgctgggtcctgcagtgcttccacgctgagcttttcgaggaactgccacaacgttccccatggcagctgcgcccttctgcttttccgccacgatgcacaaagctaacaatgcctctggtctctgtgtgcagtgcccttcagagagccgtcctcaccggcaaacaagcagcggcatccccctgggagcttgttctgaatgcccggcgcgtctccaaacacacttggagaaaccacctggacggtgctcaaccttgaacctctgaagcttttagacactgtcccgatgccaggtgccagcccagagcttcaggtgcaatgggtctgggcatgggggctttcataggctgcccagatgaccccactgtgtggccggggttgagacgacagccctgggagaagcttctgctgccacctgggctgctctgcggggagtatgctggctggaaggcagttatcagaggctgctttgggagcagcccctcatcccgctgcatgcagctcagacactctgaatgttgagtcagaagggctgagccctgatttcaagaaggagaaggtccggctctgccggggatcctggcggccagggtggacttcgagggtatgacctgtgcaggcttctggggttgagctcagaaaggccggcaggaggtgcaatgcttgtggtcactgtctggaattcttaatgctcccgaaacaaggagccctgcattcttgctttgcccagggccacacggtgagtcctgctggcagcccctttcctgcagccagcagggccccaggacccctcctcgatcatctcctgcctccatcttctgcctctcatcctgacacaggagatggggacacaaatggggagggcctgtgtcctctacaaaggagtccccgtagaggaaccccttccacagggcaccccttccacagggaggggctgggccagcagccgtgcgcagtgggattcccgtgtctgggggcttcagtcttctcaggggacacacgcccaagaggcagggagcttgggtgggggctgcacagctgtgggcttctgttctgggctgctgctgcctagtgctgcggcttctgaagtgttacccagcctcagagttcagccctcatctgtaaagtaggtttaagaaaaccgactccaggtgaagaaaatggagcaatatgcactgggcacggcacccattcctgttcccagagaccgcggtggttctcactgtgcggcatgtgcctctcacctcccctcccttccaaccacctttcgggtgctgagccgcgtcgaagggactttttgtctcctacctcagaggctctcccaagccagccctggccccactgtcgggcacagctcagcacgcaggcgccgggaccttacctgtctggctgccgacagtcaggttctgctgcagaagcacgttctctatgcagcagccaatgttcacgctgggggtccgtgcgatcctcagcacgctgaccacgtcatacaagccccgcatgttcaagaagacggtgtcattctgcagagcctggtccagcaggctgttgtccgtcttattgatccagtacacgttgggcctggggtagccgtttatggatgtacacgtgaaggtgagctcatcctgggaggggctgtggggggcgctgacgacgggcacgctgaagtttgctgcaggggagggaaacagattgtgagagatgccagaccctgctggtcaagaaacagagggtacacggtgccaaggctgggtcagaggggaggcggcccattgtgccccgacatgggtgacaggccaggaccagggctgtggtccgagcagcaggctccgccctgtcctgcccaagagtcatcccccaagccagtcccagtagccagggaccgctgagcctgtcgggcagtgactggcacccacagaccccccactccacagccgtcggctgtgccgggaccccctcatttggatctggtcattctcactgctgacacaggggctcacagtccatctgaaatggacacagctgttctccccaatgaactgcccagagctccttggttgcctcttatttttctcttaaattttgttctcatttagtgctttatagagttcccttcaaatttcacttttaaaactctagtttggatgtggtggctcacgcctgtaatcacagcactttgggagggtgaggcaggaggatcgcttgtgtccaggagtttgagaccagcctgggcaacatagtgagaccccatttctacaaataatcaaaattagccaggcgaggtggcatgtgcctgtagtcccagatactcaggaggctgaagcaggagaattgcttgagctcaggaggtcaaggctgcagcgtgatcacgctactgcactccagcctgggcaacagtgagaccctgtctcaaaaaacaaactaattggccaggcgcggtggctcacacctgtaatcccagcactttgggaggctgaggcgggcggatcacgaggccaggaatttgagaccagcctggccaacatggtgaaaccctgtctctactaaaaatacaaaaattagctgggtgtggtggcacgcgcctgtagtcccagctactcgggaggctgtggagaattgcttgaacccaggaggcgggggttgcggtgagccaagattgtgccactgcactgcagcctgggtgacagagcgagactccgtctcaaaaaacaaaaacaaaaacaaaagctaactaactcaagaggcaaagacagcaagggtaggagctcttccgggaaaccaagcagccgcaggtcatgcactaaggatttttcagctgtttagtttccctcgaagttagacagaagcctgataacacagatgagaattttcttcactggaagaaacagtgaatgagccagggagggggtttcatgaacacttgtccacgatgtgaggctgggatggacctagctctccccgcctcgatggtcctacctgccacatgcagtgtaacctcaacgctcaaaacctcctggaatcccagggattggctcaacaccaggcagtgaaacttctgctcgtcctggggggtgacgttgaacaagcgcagggagaagtcgccccgcagcatgccggccggtgacatcagggctcggttccggtagcggctgtccacgttttccaaggagctgttctgtgggatgtggtaggtcaccacggttttcgactcactggtttgccaatatacgtaaacatcatttaaatcaaaacggcttccttcagggcaagcgcagctgagctccacgtcgctgcctaccatcgctctgacttccttctcctgagtatctgcaatggcccaaaaggtgcaaaatctgttttcggaggctgatgcccaggccatgaagctactctatggggcagactttgggtttcaagcctcaaacaccaacggtggctcagaatttattaacaaggcacatgtaggaatgcagtcaaacttgaaaaacgcagacatttcatggtgaggtccatgtcagtctttggcttcgatgacacactcctgttatgtaaggggctgccatggggaggagcggctggatggggcctggccgctcagtgttatttttgttactcagcactacttttactacttctcgggagtctataattaatgcacaataaaaagttctttaagggaaaggcatttaagggaaaagaatttctcagcaattacattatattgctgctcacttgcagtaggaaagctgtcacaaatgtggcagacacagggtagctttactgtttgtgcagctacgtaaatgcctgtgggaaaatctttttttttgagatggagtcttgctccgtcacccaggctggggtgcaatggcgtgatctcagctcactgcaacccccgactctggggttcacgccattctcctgcctcaccctcccaagtagctgggattacaggtgcccgccaccatgcccagctaattttttgtatttttagtagagatcgggcttcactatgttggccagcctggtctcgaactcctgacctcaggtgatccacccgccttggcctcccaaagtcctgggattacaggagtgagccactgcacctggcacctgcaggaaaatctgtgtgtgtcccctgcccccaaagccctctgggctggaaggcttggcaaggtttcaggtttgtgctgcggtgcttcgtccttattcctggctcttccagaggctggtggctcttagggctcagcagggctgctgcctgggacagggagaccaggggacccaggaagccctggctcagaggaactgcattctgcccgcaacaaagacggagtcaaacaagaactccggagtttgcagaagtgtttccctttaaggaaacgcttctatcctgtgcagcaacctaggtttagggtccaactgtctccaaaggaccacttgagaagcaagaaggagcctggtgaggctgctcccagtgccctgcggccagcagtccacacagccggagagcccatctctgagctgggcgccccatggcaaagcaccccctgaacttaccagctcgaaggctgctgaagagcaggaagagcagtccaggactggaaaaaacaaccagaaaggcaggtgaggcggggccaccagggagttacctgtatcttccaaacaggaacaggctggttcccatgagcaggaggtagttaagcccatcacagaaatgtgaaggcagagccaggagcctgcctgcctctgttctccatgggaattcggggtccggggccaggaccaccaccctcctgcccagcacagcaagtccgaggggctggcagcctctcaccactctctagctctcgcggtaacaaatccccagaaacacagtgatgctggcgtgaggatgaaggggagcgagggacgccagtgaggctggtctagccttcctggggacagatgccaagaagttgtaggaaatcagaaaaaaaaaaaaaaaaaaaagctttcagggcacatatagtaggagtgtcacttaaaatgctggggagacggagaacatcaggcgtgcccgtgacagggtcaggtgagtgacgggacagccctgtgcggaacgcggatcattttgaaaccaaacctgagctcctcctgtttcagatcctgctgcagctggtgcccctgcctcgggcagcaaattcccctcgtgactccaatgcccctgccatcttgggtctgggagcctttgcaccctgcacgccacaggctcgccacctcctcccgccagcccccaggatgccttccccacgtgggggcccttagtggccgggaccactttggtagcagtgcttaccccagccccccaaaccatcagtttctggggccagctccccatgaagcaagagccccaggagcagggacatctccttctctgatgtccctgcacctccaaggtctgggagacgctcatccctcttctctgtggcctctgcctgggaaagcttgggggctttgtaagtcaaaggttggtcttgtgggaacctcccagtgggctgtccctgagccctggagccacagaaacccctgccccacccacgatggctgtcatctgagtctgcatggaggtgtgtctgtgccaagtgagcacacatgcaccaaggcggcccctggccaccaggggctcttgaagtctgcaggcggcccttcctctctctcccactccccctgttggggccaccattctggctggcaagatggctgtgatggcctccagcaggccccctgcctccacccttagccccttcaagcatttccccagagccaccatctaaacgacagctgtgagaactcctctgtgcccccatttgtctcccacagtgcccatattcatcaccagcccacaaggcccctcctgtctatggaggcctcctcaggacatctgggggcttcctgggccagggtggggggtgcctgctccaggctgtttctggcttgtcccctccctgggtgctgcctaagcagcggcctctgtgtcctttccttggaccctcagcacccctgcatctaacctacccccaccccgagcttgcctcaagacccagcatggacagggccgcctacctgaaggtgtgggtggcggagggctaagacatttgggagggctatgacattccgggacctttaaattctttctctctagggcaggatcataactgcatacacttctaatggggaggggacctggggagtgtgactccggtgtggcccagctctgagctgtgcgggaggcatccctggggtcaggggcctcacaggttcacccaggggagcacaggctgcggaccctacaacgtgggttgcgaagagtatattttggatattttcgcaaaaatccaggaggaagctgtcactcctggttcaggcagccccgccttccccagtgtggatcggctgccgggctgcggggaatcccacgtgtgtgggggagggcgtgtccgcagaccgtgggcaccagctggccttggagagcgctcggccggtcacctccctccttctcccttcttctaggaaatcagcagtgccagggagtggaaggggcagcgcccgtgccccggcgtgcagggtgcgcccgccttccctccctccttccagcgttcgcggtcctccttccctggcagggaccccgcccccgagcccgcccccgcacggctgtgcgtcctgccatgggtcccggtgccaggccccgccgcccactgccgtccacgccccgccggccgccccggcgcctccgccgcccgctcctcggacccgcactgccagcccggcacctccaggcgagccccgcaggccccgcgtccgagccgagctggggacgcgcgggccgagccaccccgcccctgaccgcggcgcctccgctccttccccggctcacctgcccagccgcatggtgcgggcggagacctcgggccgcggagacctcggggcgcggagacctcggggcgcggagaacttgggccgcgggagacctcggagaggagcaacctcggggcgcgggagatcggctctaactgcgctcccgc

SEQ ID NO: 2510 - DNA, 7735 bp, Homo sapiens
  source 1..7735: mol_type = genomic DNA
ggcagggggcggcatgtgagcgccagaaggcagggatttcacggaaatgaaagtggaagcaaacagcctgcgagcagagcctcctgaggtgtatttcgggtcttgctggggctgagagagaccacagccctttggggggtacaaacaagagttcagttgctgtgaattctgccactgtgcccagctctgaagcctcagctcttgccaaacagacccgagacccatgtcagccccactggatgccgtaagtgaggaggagggagttgggaagtggggaaacaggagtaatcctcttggctaggaacctgcagatatctcagggcctggcagccaagcctcaccctgcccatctcagacctgctgaagggctggggagaaacacagggctggggttgcctctgcaagagttggttccctaacctattgcctcagacaggaggagctcattaaatcctgtgtgtgtacacttctctggagagagaatctgtagtttccatcagatactcagcgggttctgtgacccaaataacaattgttctaggccgggcgtggtgtctcacgcctgtcatcctagcactttgggaggccttggcaatacagtgaaaatccgtctctactaaaatacaaaaaattagctgtgtgtggtggtgtgcgcctgtaatcccagctacttgggaggctgagacaggagaatcacttgaacctgggaggcggaggttgcagtgagccgagattgcatcactgcactccagcctgggtgacacagcgagactctgtctaaaaaaaaaaaaaaaaaaattaaactaaaggaattaggctgggtgtgttggctcacacctgtaatcccagccagcactttgggaggctgaggcgtgtggatcacttgaggttaggagttcgagaccagcctggccaacatagcaaaaccccatctctactaaaaacacaaaaattagccaggcatggtggcacacacctgtaatcccagctactagggagactgaggcgggagaattgcttgaacctgggaggcagaggttgcagtgagccgagattgtaccactatgctccactctgggcaacagagggagactgtctctcacacacacacacacacaaaatttatatatatatatatatatatatatactataagaattatactttaagaatcacactaggtaatccatagattaacacggtaaaaacttatcccactgcttagcacctacagagcattcaatatgtgtttcttcttaatattattattgccaaccttttcagaaccccagttccccaaggacaatcccttttttttttttttttttgagacggagtctcactctgtctcctaggctggagtacagtggcatgatctcggctcactgcaacctctgcctcccgggttcaagcgattctcctgcctcagcctcccaagtaactgggagtacaggcacgttccaccatgcctggctaattttttgtatttttagtagaaatggagtttcaccgtgttagccgggatggtcttgatcttctgacctcgtgatctgcccccctcaagctcccaaagtgctgggattacaggtgtaagccaccatgcccggacttttctttccttttttttttttttttttttttgagatggagtttcactcttgttgcccaggctgaagtgcaatagcatgatcttggctcactgcaacctctgccttccagattcaagtgattctcttgcctcagcatcccaagtagctgggattataggcacacatgccaccacgcctggctcattttttttttttttttttttttttgagatggagtctcgctctgtcacccaggctggagtgcagtggcaggatctcggctcacagcaagctccgccccatgggttcatgccattctcttgcttcagcctcccaagtagctgggactacaggcacccgccaccacgcccagctagttttttgtatttttggtagagatggggttgcactgtgttaggcaggatggtctcgaactcctgacctcgtgatccgcctgcctcagcctcccaaagtgctgggattacaggcgtgagccaccgtgcccagcatggctaattttttgtagagacagggtttcagcatgttggccaggctggtctcgaactcctgacctcacatgatctgcctcccttagcctcccaaaatgctgagattacaggcttgagccacagcacccggctttatatacgttaaattgggccatctttttcaaataaaaatccagattttttgttttttggagacaagatctcactgttttttccaggctgcagtgcagtggctggatcatggctcactgcagccacctccacctctagggatcaatagatccttccatctcagcctcccgagtagctgggactacaggcatgtgccaccatgcctggctaatttttaaatattttgtagaggtagagttttgtcctgttgcccaggctggtctcagactcctgggctcaagcgatctgcctcccttggcctcccaaagtgctgggattacaggcatgtgccacaacaacctgcccagattttttatttctattaaaaatgggaagattagggggcctgggtccgtggctcctgcctgtaatcccagcactttgtgaggctgagttgggcagatcacttcaggtgggaagtttgagaccagcctggccaacatggtgaaaccccatctctactaaaaataaaaaattagagccgggcacggtggctcactcctgtaatcccagcactttgggaggccgaggtgggtggatcacgaggtcaagagattgagaccatcctggccaacatggtgaaaccccatctctactaaaaatacaaaaattagctgggcatggtggtgcgtgcctgtagtcccagctactcgggaggctgaggcaggagaatcgcttgaacccgggagtcagaggtcgcagtgagccgagatcctgccactgcattccagcctggcgacagagcgagactctgtctcaaaataaataaataaataaaaaataaaaaaaattagccaggagtggtggcaggtgcctgtaatcccagctacttgggaggctgaggcaggagaatctgttgaatccgggaggtggagtttgcagcgagccgatattgcgccactgcactccagcctaggcaacagagggagactccgtctcagaaaagaaaaaaaaatagagggctgggcgcggtgtctcacacctgtaatcccagcactttgggaggctaagacgggcagatcatgaagtcaggagatcgagaccatcctggctaacacggtgaaaccccgtctctactaaaaatacaaaaaaattagccaggcgtggtggcgggcacctgtagtcccagctaatcgggaggctgaggcaggagaatgaagtgaactgggaggcgaagcttgcagtgagcagagatcgcgccactgcactccagcctgggcgacagggtgagactccgtcccaaaaagaagaaaaaaaaaaaatagctggcatgatggcacacgcctgtactcaggaggctgagatgagaggattgattgattccaggaggtcgaggctgcagtgagccataatggagcaattgcactccagcctgggtggcattgagactttgtctcaaaaaacaaaacaaaacaaaaacatgggtagatttgctgtggggggaaactttgttatggctagaagcagtttactttagaaaggacatgctcttcccagtgcgtcagagtccccaccactctctgttatcctacatggctctattaactcattaatgtcatccaactggcccttaaaggcactgtgttagcactctctgagttacagaaatatgaataactaatgatctttttcactattcataaaccagcataatttggtcaagctctagtattcttctgctaaaaatagaacaaactcacactgaatttctttggtgtcctctgtaatgtgctcctttaccgtcattcattcacttcatttcttcattcaacacagttttaccggacacatattttgtgccggagatcttgctggacacaaggaatacagagatggtcagaacagagtcctatctttccaagagatctcatgcttctctgagctgaacttctttatcaggattcctaaccacagggtgaactctgctctattccacaaacaaaggtgcatttattggtatccctggtgtcacttccctgcctgtgatgtcagttctctctctggacccattccagatcacacccagcctaaaaggttacttggtgtacagtggaaagtgtgacagtccagggacaagctagaattgatgggtaaactacctccccactctgggcttcatttcttcactgtaaagcacaggttagtgggtgggctctggagtcagacagcctagggccaaatgactttgggcaagtcatttaacctctctgagctttaatttcctcatctataaaataaggattggccaggcattgtggcttacacctgtaatcctagcactttaggaggccgaggcgggcagatcatctgaggtcaggagtttgagaccaacctggccaacatggtgaaaacctgtttctactaaaaatacaaaaatgagccaggtgtggtggtgggtgcctgtaatcccagctacttgggaggctgaggcaggagaattacttgatcctgggaggtggaggctgcagtgagccaagatcgcgccactgcaccccagcctgggagacagagcaagactctgtctcaaaaataaataaataaataaaaattaaaaaaataaatcaataaaataaggatcacaggatatctatcttagataccctgttgttctaagaattgaatgaaataattcatcagacgggcttagcacagtgcctggcatatagtaagtacttagtaaacgttagttaagaatatgactgtatgacattttgcaactagtctcccctcctcttggaggtgtccctaattgggttaacccctttgggattgtccctcttccaaattccggctgcccttcacagtcagtcatgtgatcatgtactcttgagcactgtttggcaggcctgagggtcgtacccttatcttccactgcctgtgtcagtgccgagcactttctagcaggagcttaatcagtgtttgttgaactctagatctgtggtcacgaacaagtcatggacgctgcaaaggctcctgccctttcaagagcagctgagatgaggccagccaagccctgggtggagggggccaagaccagcccagggcagcacaaaggggttgggttgttcttgagcttagcatcaactctgcttttggagcgtccagaataggccccacttcccctgggcttgttgattctctggaagggcgggtagaagtcttgttgtttccttctgccccaacaggccctccacgcccttcaggaggagcaggccagactcaagatgaggctgtgggacctgcagcagctgagaaaggagctcggggactcccccaaagacaaggtaaggtgggagatctggtgttgtttggtaaaaacgagctggcgaggccgggtgcggtggctcacacctgtaaacccagcactttggtaggccaagggggcctgatcacctcaggtcaggagtttgagaccagcctggccaacacagtgaaatcccatctctactaaaaatacaaaaattaggccgggcgcagtggctcacgcctgtaatcccagcactttgggaggccgaggctggtggatcacctgaggtcagtttgagaccagcctggccaacagggtgaaaccccgtctctactaaaaatacaaaaattagctgggtttggtggcacatgcctgtaatcccagctacttgggaggctgagtccgaattgcttgaacctgggaagtggaggttgcagtgagccaagatcatgccactacactccagctgggtgacagagcaagactccctttaaaacaaagaaacacaaaaaagagctggggagttctcggttttattcctggctctgctacttccttgctgtgtgacctccattatgttacttgaacatctgtaaagtagagctacccacctcccaggacaaattaagatgttgtatgtaaattgccctgtatggaccagacctgcattcatccactcatttatccagcttttctttcagtaaatgtatttatctccggcactcagcatcaatggaatggaatcggagatgccttcctcctaggtgggagtgaggaacactcctactcccctcccctacttccaggtcccattttcagtgcccaagatccccctggtattccgaggacacacccagcaggacccggaagtgcctaagtctttagtttccaatttgcggatccactgccctctgcttgcgggctctgctctgatcacctttgatgaccccaaaggtaagctcatggggagcctcaggagggaggtggggagggttcccagtactgaccctgtttcccaccacccagtggctgagcaggtgctgcaacaaaaggagcacacgatcaacatggaggagtgccggctgcgggtgcaggtccagcccttggagctgcccatggtcaccaccatccaggtgatggtatgacagaatcctggggcatgcaaagcatgccatgcacctgggcatggggaagtggagctgtgtctgggaccaccccttgctgtctccccctagatgtccagccagttgagtggccggagggtgttggtcactggatttcctgccagcctcaggctgagtgaggaggagctgctggacaagctagagatcttctttggcaagactaggaacggaggtggcgatgtggacgttcgggagctactgccagggagtgtcatgctggggtttgctagggatggaggtgagggctatgcaggcctcctgcaggggagagggtatagggtgtgcaagattacggtgcagggagaggagagggcttgatgctaaaggcccacccctccttgctccccacagtggctcagcgtctgtgccaaatcggccagttcacagtgccactgggtgggcagcaagtccctctgagagtctctccgtatgtgaacggggagatccagaaggctgaggtaagcaggaggggtgaagaacaggggctgggctgggtaacctgtctgcctgccaggaacttgcccaatgaaggatcagaggccccaaaccccactgacctacctacccaccatcagcctctccaggcctcccgacctcatacccccatggggcactgcctgccctacccccagcccccagcccttctcccatgagcctttgccatctcctggctccttttccagatcaggtcgcagccagttccccgctcggtactggtgctcaacattcctgatatcttggatggcccggagctgcatgacgtcctggagatccacttccagaagcccacccgcgggggcggggaggtagaggccctgacagtcgtaccccaaggacagcagggcctagcagtcttcacctctgagtcaggctaggggcctccccttctcatcctccccacccccccgccaaggttctcacactggcctgggcttgggtgcccatataggaggtctgtatgttcaccaacagtgcggaggggtcacacattgcaaaacactgcccagaacagtaaaaagagcctgcatgccatga

SEQ ID NO: 2511 - DNA, 13942 bp, Homo sapiens
  source 1..13942: mol_type = genomic DNA
gcaaggacacacccacagcttacaccattggctgctgtttagctcccttatataacactgtcttggggtttaaacgtaactgaaaatccacaagacagaatagccagatctcagaggagcctggctaagcaaaaccctgcagaacggctgcctaatttacagcaaccatgaggtaaggatttctttgctcctctgccataatgtctaaagtttttgaaaaaatggtaattaaatactatttcaacaggttagatctcagtgaggtcaggttttctaattcctcgatttgagtatctgcttatggactgaatgtgtgcatgcatgtgtgtgcacgttcacacatacataaattgtttaatgcatttttatgtttgttagcatgaacttgaggaagcttacctcatgctatagcccaaagaaggggagggaaatgggaaaagagttttgcaggaagggagaaaatgatcccaatctgagagattctttcccatcagattcacttctgtctgatatggggaaggaatggacagcttgtctgagtagaggcattgctttctgcaggttctttaccacagagaaaaagcaggacccacaagaatgtgaaagcctcagtcttgcagcctctctgatgtcttgtgggtaatacagtggagatgtggtaggaaaagctcacagccttcctccataggcttctggtctcactttctgcactgctggcctcttacaacaggttttcgcaatcaggctgagcttaagataaacagattgcctcctccctggaaaatctaggctcttggtacgtccttgactgaagatgatccacatctgcttgggaagatccgtatcttccttacctaaagggcctaatgtgggaatttctcagctgatttaaaaaccattacttaggccgggcaagggggctcatgcttgtaatcccagcactttgggaggccaaggtgagcagatcgcctgaggtcaggagttggagcccatcctggccaacatggtgaaaccccatctctactaaaaatacaaaaatttgggcatggtggcacatgcctgtagtcccagctacttgggaggctgaggcaggagaatcacttgaacctgggaggcgtaagttgcagtgagctgagattgtaccactgcactccagcctgggcaacagagcgagactccgtctcaaaaacaaacaaacaaacaaaaaatccattacttaatactgatttgtaaattttcccctcagtgctccagttggcaaaattttgaagaggtaaaaattccagaaaatgcacattacaggcctatgatgaaccctcctctgtaaacagatggagttggtactgataattaaaataataataatattaaatgttataaaggtagttatcacttcttgaattcgtattaagtgacagcctggcttctaaaagtgttatgtaaattattccatttaattctcaaaagatacttataaggcaggtacttacacagtcatgcatcgtgtaacaatggggatacactctgagaaatgcagctgttaggcaatttcatcattatgcaaacatcaaacctagacggtatagcctactacacacctaggctataaacctgtgcagcatgttactgtactgaatactgtaggcaactgcaatacaatggcaagtatttgtttatctaaacatatttaaacatagagtacagcaaaattgtggcattaaaatcttataggaccaccaccaaatatgtggtcctttgtggactaaaatatcattatgcagtgcatggctgtatgatcctgattttacaataaggaatcttagatttagaaatgttaagatcacacagacaataagtggtagctttgagatatggatcaggatctctacattcaatgatatttcattaaacctttaaatcaatgtttcccaaagggtgtcagtgggggctcatgtgattatttcagatggcaaactcatttgcttttatgttttcctgcttttatgtttatgtcaatatgtactacaggaaaatatatatatatatatatatatatatatatatatatatatatatatatataaaacttgaattttattcaggttagcaatgtgattttttattgtgataaaatacatgtaaaataaaatttatcattttaattactttaaagtatacaatttagtagtatttagtatattcatgatactactgtgcaatcatcatcactatctagttcaagaacatttttctcgctatgtggagaaactgcatagccattaagcagtcactccctacttgcctctttccccaggccccagcaactgttaatctgctttctgtctctatggatttgcctattgtgggtatttcatataaatggaaacacatactatgtggttatattgaatttttataattttatatttcctaagcatccctttttgaatattaagttggactttctcattccagaagcagggctcagtcacccttgagacaatttctagttctccacctttttccagttcctcaatgtgattgatccagatatctgctttatataactacctcctggtgaccacttccctatagcatagcagggtatgacctatttgacttgcccccactgaccccacccccaccccacatggaccaggcagatgtgctgcagtgaccacctctcagtcacagcatgaccccttggcaaaattgcacctgcttgctctaaacccaccaaatagaactctccacaggaaacccacctaggtaacgccctggcctcccataaaggcttgggcccacattccccactcgctggttgagcaggcatgtcctcaatggctccccctttcccattggccctgcaaggcatattaccctcttctctctggatctgtaagtaataagctgcttctgttatttcacatactatttttttcaattgcctcctttgtatttcacctgaccaacacactcaaactcttctttactggtcatggctttccgagagagtggctgtctcagtagaaataaactaaacacaggtcaggcaagaaccacaagggcatctgcctgatataaacaagtttcctataaaaggggacacctagacatagatcagacgcttaggcattaggctgttcatcaaaataaagaagtatcccaagaaaggcacattgtaaatatccatgaccaaataccctgaagctctttcaaggcagggctgtagattgtagccactctcacaggagagacctcaagacaaaattaggaaaaaaaaaaatacaacagtgaccttttggatcagtttttttcatttagtgtagtgttgtcaaggtttatccatgttgtgtcatgtatcagtacttcattcctttttatggctacataatattccactttatggatatattacatttttttatctatcagttggtgaacatttgggttgtttccattttttggccattatgaatagtgctgctatcaacatctgtgtgcaagtttttatttgaacacctgtttttaagtatcttaagtatatatccagatgtggaacatccaggaatgtatacccaggaatgtgtcatatggtaatattatgtttaacttattgaggaaccaccacattgttttccacagcagctgcatcattttacattcccaccagcaatgtatgagggtttcaatttctccacatccttattgccttagtcctttttgtgttgctatagaagaataagcaacaatttctaaggctgggcaatttctaaagaaaaaaggtttatttagctcacagttccgcagcccatacaagaagtatggtgctggcatcttctcagcttctggtgagggctttggtgctgtgtcaaaacacactggagaaggtcaaaggggaagcacatacaaagagggtctaaacccagggggcatcctcacattataacaacccattctcaaaggattaatccattcccccaagaaccaatccagtctcacaagaatgagaattcactcactactactagaatggcaccaggtcattcacgagagacctacctctatgatccaaacacatcccactagaccctacctccaaaattgtgacactagagatcaaatttccgtagatttggtggggacaatcaaactgtatccaaaccatagcacttgtcaatacttgttcacctattctccttttctaaaattattattgtagccaacttactgggtgagaagtgatagctcatggttttggttagcatttttctagtagctaatgatgttgagcatcttttcatgtgtttgctagtcctttgtgattcttctttggagaattgtctactcaagtcctttgcccatttttaaattgggttgcttatctttttgttgatgagctgtaaatatacttacatatatttctccatacatgagtaatcacatacatacaaatatataaggatttggttctttataaaatagggtcgtgttttggacacttctttacaattcacttttcttgatatatatgaaagtccatcaaactcaagtagttttgatctaattcatgtagtctagtggctacataatattctatggtatagatatacctttatttaaccgttccctattaatatttccagtttgttgctaatatatacagtgttggtaatgaatattcttgagtatacatccttatgtactggttatttttttctgggagatagattctgaggagtggaattactttgttgaaggaaatgtaattttaatgaccaccattaattttaattttgattttaaaattaaaattttaattttaattactatcaattttcatggctgtcatcagattgatcttgaaggccataataatacatggcttcagaaattgtgtcctcatccatttaaactcttgccaatctgagtggaataaagttataaattattgcttctttaatttgcatttctctaatggctagaggcttagggcatcttttttctttttatagagacagggtcttactatgttgcccagactgatcttaaacttctggcctcaagcaaatctcctgccttggcctcccaaagtgctaagattataggcatgagtcattgtcttgatccagagcattttttttcatatttattggccatttatattggcttttctacaaattatctattcacatagatttccagtggtctgttgaactataccaatttacaaaaacactttgtatattacagatgagagtcttctctgtattacaaacattttccacgtttttgttatttttctatttactttgtttggagtacctttgccataaataaatcacaaattgttttattatggtaaaacatatataacataaaatccaccattttaaccatttttaagtgtacagttctatgacattaaatacattcactttattgtgcaaccatgaccaccatccatctccagaaatttttcatcttcctaaactgaaattctgtactcattaaacaatcatttcctattccctcctcccccagtgtggaggatcagtcagagtgacgggaaaaactatagggaaagaatgcaagccttctgaaaggtcagaaggttctgcagagccctgggggagaacagctgaaggcagctgttctataactctgaggcagagggcaaggagtaggtacaagggagtgtgggggaatgtatcttaaacaggcttgtttatttatgttgaccaggaactgacctttgatcatccacatgcgtgatgttccctgaaaggggaacaataaatgttaattccctacaggttgtgttggctccaggttttcggcattgtgcctgcactgaataaaagtaagcagctccagcttctcggggatgttctctggccactagagccaggcagtcacctagctgctcttacattgcatacctgtgtctgagtactcatttcatccatcagccagggtctgtgggacagacccggcaccctagtccctgttaatcactattttactttctgtctttatgaatgtgcctactctaggtagcttatataaattgaatcatacaatattgtccttttgtgactggcttatttcacttaacataataccttcaaagtttatccatgttgtaacatgtatcagaatgtcttttcttttttaaggctgaatattccattgtatgtatataccacattttgtttatccattcatccatcaatggacacttaagttgctcctaccttttgctatgtgaataatgctgctatgaatatggacaaataaataatctgcttgagtctctgctttcacttctttttgggtataaaaccaaaagtggaattgctggatcaaatggtaattctatggttaatttttctgaggaattaccataccatttttcacagcacttgcccccttttacattcctactagcagtgcacatttctctagattctcaccaataattgttatatcctgctttttttttaaaataatagccaacctaacagacatgaagtggtatctcattgtggtttttatttgcatttcactaatgattagtgatattgagcatctttgcatatgtttattggccatttgtatattttcttttgggaaatgtctatttaagtcctttgcccatttcttaatcagttgtttgttttttgttgctgagttgtagaggttctttatctattctgtatattaatcccctatcaggtacaagatttgcaaatattttccttcattctgtgatttgtcttatcactctgttgatagtatccttccatgcataaaagtttttaattttggtggagtccagcttaattatttttactgttattgcctgtgattttggtatcatatctaatgaatcactgccaattgccaaatccaatgttacaaagctttttcctttcttctgagttttataattttagggcttacatttaggtctttcatccattttgagttaatttttgtatatggcataaagtaagggtccaactttaccctttttcatcatatatccagctttcccacacatttgttgaaaagaccatcctttccccattagatggtcttgtcattcttattgaaaatcattccaccattgttatggaatgaattgtgcacttcccacccacccctgcccaaaattcttaagttgaagccttaaccctcttatgttgaactgttgtttggagatagagtctaaaaagaggtaataaaggttaaataaaatcgtaagagtgaggccttaatccaacagagctggtgtccttagacaccaaagctcactctctctctctctgtgccactgaggaaaggccacttaaggatgcagcaagaaggagccatctgcaatccaggaagaaattccttgccaggaaccaaattggttgtcaccttcatctaggacttctagcctcgagaactgtaagaaaataaatttctgttgtttaagacacccactctgttatattgagttatgacattctgagctaactaatacagtcagataagtaagggtttttttcagggctttctattctatttcactggtctatacatctgtctttataccattgttgtaatattgtgattactgtagctgtgtagtaagttttgaaatcagaatgtgtgagacatccaactttgttcttctttttcaagattgctttgactatttgagatcccttgacatttcatatgaattttaggttgaatttttctatttctgcaaaaaatgtcattgggatttttattaggattgcattgaatttgtagatcactttgggtagtattgacatcttaatattatgtcttctaatccacgaacaaaggatgtccttccatttatttattgcttctttaatttctttcagcagtcttatagtttccagtgtacaagtcttttgcctcctaggttaagtttattgctaaatattatattctttttgatgctatttttgtaaatgggattgttttcttaatttccttttgggatttttaaattgttactatatagaaatatgactgatttttcatgtagattttgtatcctgcaattttgctgaatgtatttgttaatgtgtagaatccttagaattttctacatataaaattatgccatttgtgaacagagataatcttacttcttcctttccaacttggatgtcttgtatttctttttcattcctaattgctctgactagaatttccagtaccatgttgaatagaagtggtgaaaggagcatcttacctcattcctgatcgtggaggaaaagctttccctttttcaccattgaatatgatactagctataggtttttcatatatggctttaattgtgctgagatagttcccctgtattagtagtctatagtctgttttttttttcataaagggtgttgaattttgtcaaatgcttttcctgcatcaattgagatggtcatgtatttattcccttcattctgttaatgtggtatattacattgattaatttttgtatattgaactatccttttatatgaaagtctccatttagatgactttttttttttttttgagactgagtttctctctgttacctaggccagagtgcagtggcgcgatctcagctcactgcaacctctgcctctcagactcaagcgattctcctgcctcagcctccgaagtagctgggactacaggcatgcaccaccatgcccacctaattttttttttgtatttttagtagagacaggatttcaccatgttggtcagctggtctcaaactcctgacctcaaatgatccacctgcctcggcctcccaaagttctgggattacaggtgtgagccaccgcacccagcctatatgacattcttgaaatgacaaaattacagagatgaagaacaaattagtggttaccaagggttaggggagtacaggtgaggaggtgacagatgtgaccataaaggggtaatatgagggagatgtggtagtgaagaggagtttcgtttctttatcaaagtggtggtctcataggcttacgtgaaaaaaatgacatagcactatacaaaagcattgttgtaccaatgtcaattttctagttttgagctactgtattatagttgtgtaagatataatcattggagaaagtgggtgaaggatacactggatctctgtactgtctttgcaactttccgtgaatctgtaattatttccaagtaaaaaaaaaatgaaaaaaaaaaaacccgggtcaaatattatctgtttcatgtggtcttaatttgttgcattacatgcagagtaaggtcctgaagtcaatgtttcctaaggttctgcatttctaactgacctctgtcctaattatcttaatattaaaataagaaactcttatatagcatataatatgctctaagtgcttgacacatataagtttattaatcctcaccaaacccagtgtgataaatactatcattatctccattctacaaataggactcataagtacagaatagttacttggctggaaattgctctagccagcatatgaagccaagcaaacaatatcaacagtccatgaataacttaaaaatacattaactttaatgaaacctaagtaagttgatcctttcaaggataagcactaaaatacaaggtattttatctgacttttttcttttagctgttcctcacctaacaaagaaaatctgtttttgtttttacagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaaaaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttccactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctacaaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatattagttgtgttcaacaattagtgaaacagaatgtgtgtatgcatgtaagaaagagaaatcatttgtatgagtgctatgtagtagagaaaaaatgttagttaactttgtaggaaataaaacattggacttacactaaatgtttaattcattcattttattgtgaaataaaaataaaatccttagctcctccaccaactgaacagaccctcttggccaaggagaccccagaaaccttaaaaactaagtttcccaaccatgacaagatgagagatcattcacacctcattatattccctcccttgctaactgccattggactttttccactgagttaaacagaaacccatggaaaacaaagaacagaagactcactccttggctgacttcacctagctcactccacgtagcgccacagccagactcccctcccctcttgcggtttccacatgacaactgatcagccttccctcctgataagtgaccactgcccacagactggttctggccagtccatggaggctgcacacagggtgcctctatgtcctttgtttcaccttttgatatagaaaggctaattttgctgtattttaatgttaagtctccaccacagagtgaacacagaatgcatgtgacatacatgtttacataccactattgtgtgactgcccctcatgaatattcatagccccccataacctgttaactatgtgtgtctagccaatccaccaaccataaaacttctgtaataccctcccttcctccaagagcctgcttttggttgctgtggtaggctctgcttcccaggctgcaggttgcaggagaggaggctgcagtggctcacgcctgtaatctcagcacttcgatgggacgaggcaggcagatcacctgaacccaggagttcgagagcagccttggcaatggcaaaaccaaccgtctctacaaaaaatgcaaaaacttagctgggtgtggtggcatgcacctgtagcttcagttccagctactcaggaggctgaggtgagtggactgctggagccagggagttcgaggctgcagtgtcgagatcttgccactgcactccattctggatgatagaacgagaccccatctcaaaaaaaaaaaaagttctctccaattgtatatagcttgtgattttatgtcaacactatcaataaatagctttcagtgcaagaaaccaaaaatactgtaataaacaggcacatattcttcccaaacctcatgcagtttacaatctagtgagagacacagatagcagtacagagtcaattaaaggttagttttcttcatgaagatgttttaattttaattcaatgtgaaagggttccaaggagtttatcttgttttatgccattttatttgaagcactacttactaagtcatttgctgatattaatctagttaaatcaagaaatattacatgaaaatgttgctaaatcagagatcatgggtaacaatcacctttgattatgaataatcatattttattgaaaggcaaggcacaacaaataataagaaggaaaaaataaataagcaatgttattgatctttcattctgtatatgttttggggggaatatactagtttcttttagtggctgtaacaaattaccacaaacttggtgacttaaaatttcacagatttactctttcttacagttctggaggtcagaagtctgaaatgggtttcaatgagccaaagtcaaggtattgatgacgctacactcctccggaggctctaggcagatagccttttccagcttccagaggctgcctgaattctttcatccatcttaaaaaccaacagtgtagtagcctcaaatctctctctctgcttccttcttcacatctccttctctcctctgactcttttgcctctttcttctaaggacgcaccaggtccacctgcataatccagaataattgccccatccgcaaatccttaatttaataacatctgcaaagtcccttttgctatgtaaagtagcatgttcacaggttctggagacttggccatggatacgattgcggggggggcattattcttaccacagagcaccccaagaaaatctccaaattttgggcttccaatccattttgcttcaattatttaatatttttactccttccagtagatactgatttcatccattgcccttaagaaggtaggacagagattatggcacatctcacattaaatgctatattttcgttggaaatacattttttgcttcaacttttattttaaattcaagggtacatgtgcaggatgttcaggtttgttacacaggtaaacgtgtgccatggcggtttgctgaacagatcatcccatcaccaacagatcatcccattgagaggtgaagccggctgggcttctgggttgggtggggacttggagaacttttctgtctagctaaagtattgtaaaatggaccagtcaacactctgtaaaatggaccaatcagctctctgtaaaatggaccaatcagcaggatgtgggtggggccaagtaagggaataaaagcaggccacccgagctggcagcggcaacccgctcgggtccccttccatgctgtggaagttttgttctttcgctctttcaataaatcttgctgctgctca

SEQ ID NO: 2512 - DNA, 13942 bp, Homo sapiens; identical to SEQ ID NO: 2511
  source 1..13942: mol_type = genomic DNA

SEQ ID NO: 2513 - DNA, 13942 bp, Homo sapiens; identical to SEQ ID NO: 2511
  source 1..13942: mol_type = genomic DNA

SEQ ID NO: 2514 - DNA, 13942 bp, Homo sapiens; identical to SEQ ID NO: 2511
  source 1..13942: mol_type = genomic DNA

SEQ ID NO: 2515 - DNA, 13942 bp, Homo sapiens; identical to SEQ ID NO: 2511
  source 1..13942: mol_type = genomic DNA

SEQ ID NO: 2516 - DNA, 7328 bp, Homo sapiens
  source 1..7328: mol_type = genomic DNA
agtttcactttcccttttgtaacgtcagctgaagggaaacaaacaaaaaggaaccagaggccacttgtatatataggtctcttcagcatttattggtggcagaagaggaagatttctgaagagtgcagctgcctgaaccgagccctgccgaacagctgagaattgcactgcaaccatgaggtaaatattttcccttcgtattcggtagtgctgttgagtcatcttgtccaatgcaaatcctgagaagctatgttcccaaagagggccagctccattttagtgtttgtttatagccttactatgcctctacctctgttggttgtaaatctgtcttaccaatggtggtttgttccctcctgaacaattttctgcttcacactggcaagcttcctaaattcatctccagaactgcacgcctggggagttgagttgcaatcagagaaagaaggcagcagagagggatgatgtttcatcggcctggtgcttcacttaaagatgggtctgggggcattgctcttgtgcactgaccctgtcttatttcatatttgaaaggattaagttggggacttgtaatacaattatttaacaaaagggttcttttcagcagatactgttaaagatatacacagaatagcaaaccccacttcctgcaaaggtgaattttacttttaatgtagttcttcatctcagatttgcacaagggctggtaaacttaaatattttcaccccaaaatgcctcctgagtatgaattagagatggagtgcttggagaaaatagttctgttctcacctctaacattcccttctatccccaaaacatgagactgccctggagaggaagtgttagctcattgaataggaagggaaatattttctccagtttgaaggtggggtggccggacctggttgcctaaccctcatcctgggagctctggaatcccgtgttaccaacccctgtgcttacttcctatgagacaccttgccctctgtctgtgaggttcctgatttctcttcttgaaacgatattatttcctgctagtctaaatgttctgcctgatttcaaaaaaaaaaaaaaagatttgagatatttacagatttcttttttttgtagtcacccagaatctatagaacccttttcttatttcttagaattttagcatggtcttatcttagaatttttcccattacaatacagacccatctgtcctttctttccttaattctttatctattgtgactttcactgggcattgcccttgtgccctaagacagtggttctcaaaattgagcatgcataaaaattgcctggacagcttattaaggacagagtcctagggttgactccccagagattctcattaagtgggtctgggttagagtctgaggatgtgtgtttctaaaaggctcctcagtgattctgagactgcggtggtagcattagttctgagcctggttgataatgtcactgtggctttcatccagataagaggcaaaggaagaaattgttgttgttgtgtatacaactggaacttctataggaatcgggagaataggtcctcacaagccagagcccaggaagcaagtgtctggcatcagcttctctaacttaccagtggaaataaaaacccaaaatcaagcagtgaagttggatgccttttaaatggctgctcaaagggcttttacctaagtgtgtatattaaatatctctatcctgcaaatgcacaatagactttatgttttatatggtggagataacctcaattctatttactctctctgtttcttttgtaaaatgagaaaggagctaaggagtttatgtgttaagggaatgagctcccaaactcaactggaagttggaaatagaattgagagggagcaaggaagctatagtgagtcttcaggtgttaggatgcgtgctgcacatgcttggggtctgagagtggtcatattctgtaggactcaccatattctgtaatgaatgcagtagagagtgtgactgagatgcacatggagaaaacacagggtctgagccctccaagctccccagtgtcctgttctgatcctcctggggtcactacagtcctacccatggtcctgtgaagcactctagtaactttaaatcagttcctgctcacctctgtttcttggaacaaatggagacttaactatcccaggcagaataaacaaacaaacaaacaaaaataggatggaaaataggcaggagtttataggaaggacccgccttccattcaaagctccaaataggtcttagcaaagagccaggttgtctaagtcccttgatgtaactaaccccaggtgcgggagccccggagagtgcttggcttggttatcaggcatcctaatggcagatgcattcccgttgaaaagctcatgtccaaacagatctgtttttattcttagtgaggttacaggaagattcccaatcaaaatgggagtgggaagcagtggtataaaaagtgggagagagaggggcagttagaaagaggggtcacataatcttctatctagacatatgtttcataagtgatcctgccacattgcatgacattccagatatctattggttgtataagaagccatactatttagaaatacagctcctgatacaagggttgctgtatagataccacgaaaaaaaaatttaaataagaaaaggcaacattacagagactccaatacacagacagtgttgagaaataatttggggcatagaatactatttatctccaaagtaattcgaaatacaggcttttgctcatttgtctgttctctgggttttttaggggtttttttgttgttgttttgttttgttttttggtttggttgattttggtttatttatttattttgaggaccaacactaaagggaatggaaaatctttccaggagagtcataagggtaccctaaagaaaaaagagctctttctataagaaaaggagctagtggccttgtgagccttccctgtagctgcacttcttgccccttattataaaagcaaaacccagaagagaaaaataaaatttcaaaaaaaaaattaaaacaataaagtacaaaattattaatagagcaactcaatgagatgtgttaagaacagaaatcaccagtttaagaaatagaggtatgggggggaggggaggaaaaaaaattacattttattccaaaataaatgtttaagacattgctaacataaataatacttgaaattaaatgagagaataatacaaaagcagataaaatgagtaaaaattaagaatggttgaaaataagattcaaatggttaaaatggaaaaattcacagaaaaaaatgagaatgtagcatgttaaagtaataaaccaatacaaaataaaaccaatctgataaaagctcagaaagtttgaatagacaaaataaatgaaggatatattaaaagctgaaatagacagaaaatcgaaagtgataaagatttctttaaaggcaaatgaaggagaactaaggaattaagaatatcaaagataaaatgaagctgcatttcggagggatgagaaattaaaatcaccatggcaaaacattaaaagaataaaaaattataaagctgaaattttcaaagtacaaaagtaaagctagggaagaatgaagaacagaaacagcaatgaaaaagacttacttctttaaaactacataaataaaaccaagcctccacagagaccctcgaaagcagagagggcagagctgtttaacaaaaactgtcttattcatgaaaacctagccacagactcagagaacaacccactgccctcgccctaattcttctgctgcccacagtccctaaactcctgctaccacatgcaggaattaacaataaggaaaaacatattatagaaagaaaagaaggggagtttctttgatttgtgttaacagcctttaggaggaggagcattttatttgccatgctcccatttcttgacatataaatctgtgtctcaaagtccatctttgtgtttttccctacagtgagaacaataagaattccttggagagcagcctacggcaactaaaatgccatttcacctggaacttgatggagggagaaaactccttggatgattttgaagacaaagtattttaccggactgagtttcagaatcgtgaattcaaagccacaatgtgcaacctactggcctatctaaagcacctcaaagggcaaaacgaggcagccctggaatgcttacgtaaagctgaagagttaatccagcaagagcatgctgaccaggcagaaatcagaagtctggtcacctggggaaactatgcctgggtctactatcacatgggccgactctcagacgttcagatttatgtagacaaggtgaaacatgtctgtgagaagttttccagtccctatagaattgagagtccagagcttgactgtgaggaagggtggacacggttaaagtgtggaggaaaccaaaatgaaagagcgaaggtgtgctttgagaaggctctggaaaagaagccaaagaacccagaattcacctctggactggcaatagcaagctaccgtctggacaactggccaccatctcagaacgccattgaccctctgaggcaagccattcggctgaatcctgacaaccagtaccttaaagtcctcctggctctgaagcttcataagatgcgtgaagaaggtgaagaggaaggtgaaggagagaagttagttgaagaagccttggagaaagccccaggtgtaacagatgttcttcgcagtgcagccaagttttatcgaagaaaagatgagccagacaaagcgattgaactgcttaaaaaggctttagaatacataccaaacaatgcctacctgcattgccaaattgggtgctgctatagggcaaaagtcttccaagtaatgaatctaagagagaatggaatgtatgggaaaagaaagttactggaactaataggacacgctgtggctcatctgaagaaagctgatgaggccaatgataatctcttccgtgtctgttccattcttgccagcctccatgctctagcagatcagtatgaagacgcagagtattacttccaaaaggaattcagtaaagagcttactcctgtagcgaaacaactgctccatctgcggtatggcaactttcagctgtaccaaatgaagtgtgaagacaaggccatccaccactttatagagggtgtaaaaataaaccagaaatcaagggagaaagaaaagatgaaagacaaactgcaaaaaattgccaaaatgcgactttctaaaaatggagcagattctgaggctttgcatgtcttggcattccttcaggagctgaatgaaaaaatgcaacaagcagatgaagactctgagaggggtttggagtctggaagcctcatcccttcagcatcaagctggaatggggaatgaagaatagagatgtggtgcccactaggctactgctgaaagggagctgaaattcctccaccaagttggtattcaaaatatgtaatgactggtatggcaaaagattggactaagacactggccataccactggacagggttatgttaacacctgaattgctgggtcttgagagagcccaaggagttctgggagagggaccagattggggggtaggtccacgggcttggtgatagaattatttctcgattgacttcttgagtgcaatttgaactgtaacatttgcttagtcacctttagtggagtaatctactgggcttgtttctatatttatataaagcagccaaatccttcatgtaatattgaagtccatttttgcaatgttgttccatacttggagtcattttgcatcccatagaggttagtcctgcatagccagtaatgtgctaagttcatccaaaagctggcggaccaaagtctaaatagggctcagtatcccccatcgcttatctctgcctccttcctcctccttcccagtctatcatcaaccttgagtattctacacaatgtgaattcaagtgcctgattaattgaggtggcaacatagtttgagacgagggcagagaacaggaagatacatagctagaagcgacgggtacaaaaagcaatgtgtacaagaagactttcagcaagtatacagagagttcacctctactctgccctcctcatagtcataatgtagcaagtaaagaatgagaatggattctgtacaatacactagaaaccaacataatgtatttctttaaaacctgtgtgaaaaaataaatgttccaccagtagggataggggaaaagtaaccaaaagagagaaagagaaaggaatgctggtttatctttgtagattgtaatcgaatggagaaatttgcagtattttagccactattaggaattttttttttttgtaaaatgaagactgaactctgttcaaatgctttcatgaacctggtttgagacggtaggaaagcaacaaaacgtgggaacctggtgactaagggcctggtgcaaggacttgggaaatgtcattgataatagatggtggggttttcccccctttagaaatgttggatattaagtgatataaacacttcttttaactccgaaaatcttctgagaaatcacaaaattcacggtatgcttggaacgattgagattttctaggtagatgctgaatagcctagacatcaaagttggtgtgaaccaaaatagagtcagctgacccagcatcagccacactctgggttggaaaatgtttgcctgttggaattaatttaagcttaagtatatatcaacattattttattgtgcaattaaaacaatacaaattcatggttttttaaagttaaaaattctaaccactgtaacaacagtttttgtgttattttctgtattaaacatcttgttgcacgcatttgaggtcatcagggtgcaaaatttgtattcctgaaaatgtcatatattttcattaataaataacctaaatatgataaaacataaagcagtgttctggttcatctggaattttgctgtactttaaatctttcagactcagctactgataaatgaaacgttacacaggtgtgaaccaaatccaaataacctcgactggtctactatcataatcacctgaacagaacaaaactttttcctcagctttaagagtccagggcttcggataacagctgccatctgccacctgctaccattgacctacgtgaacacagacattctgtctccaccttgatggtgggtgggctgctccccttttctttgttaaattttgtgctttcatcacattttctctattctgacctctgttatgagaaataaaagtcactgattccatttta

SEQ ID NO: 2517 - DNA, 8487 bp, Homo sapiens
  source 1..8487: mol_type = genomic DNA
actttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcgagtggcctgaatcatatcaacctgagtcttctaatagaatgcaaatttctaggtcctgcattctgaaatcctgattgagtaaaacagaaataaggtccagaaacaaacatatatttaaagaggaccacaagtacttcataggcatactgaatggcttacagaagaaatgtccatctccaaatcctctcttccttaaatgcatacaaggcttcctgcattgtatgtgtgtaaatgtgaaggaggaaaccccaagaggcaggaggggggaggggtgggaagaatgttgaaataaagcaaagcttgtttctgggcacagtggctaagcctgtaatcccagcactttgggaggctgaggcaagaggattgcttgagcccaggggctccagaccagaattggcaacaaagtgagacctacaaaaaaacaaaaataaaataaaaataaagcaaagtttgactgtttaaagggtaatttaagtatgagaaactggtgattggaaatcactgccaaaaagggaagtcttcccagagccttgctgctcacagtgtggtctgaagctgagatcccccgggaggttgtaagaaaggtaacatcccagcttatctgaatccagatctgcattttaaaaagatctccagatgtttgtgtccatatgtacattaaaggttgagaagtccggctctggagagttccttcacttgctttctgaagtgatggactccttggattgggcctgttctgaccaaccaactgagcacaggtctgccagttccttcacgtagtcagttggagcataaccagcacatgctggggacaagctgcacatgtgcagacaagagtggggaaatccccactcttaccacttcaagaaagccactttctgaaaatttcaagattctactctagtaatagctttgactgggaaggagatgtggtatctaccctggagtctgtgggcaagacaggtggtcatgatctgggttaggtgagagactgtaactatgttgattctggggatttcctaaggactagcagcactagctttaactgctttagtaagcgaaatcttatgtctgcaatccgaggtcatgggaaatctctttctggacctgagggaatcctatctccctaaggtcttctactagatgcagatccaggtaggactggcattctactccccaagtttcacctgaacctagctattctgttttttcttctttttcttttattctttttttttttttttttttttttttttttttttttgagacggagttttgctctttcgcccaggctggagtgtagtggcccgatcttggctcactgcaacctccgccttccggtttcaagcaattctgcctcggcttcccgagtagctgggattacaggcgcctgccaccacgcccggctaatttttgtgtttttagtacaggcggggtttcatcatgttggccaggctagtctcgaactcttgacctcatgatccacccgcctcagcctcccaaaatgctgggattacaggtgtgagccaccgcgcccggccacctagctgttctttatcaagtgactgtagtcatcatcccacctgcctgcttgtatttatttaaatatctgcattaattactgttaactaacttatttatacatataagaagtattcagagtaactttcaaaaacacatatgagataaattattaagtgaggaaaccttggcaattggagtatttgttttaagagggcaatagtattataatgaaaacctcctgacctgtggctctggggttcatgtttcttcttatcgaggtctcaggccttccagtccaatatattttgctccaaattttacttcaaggagagatcaagtatcaaatacctcatcaaattggagactttagggagtaaggcttaggaaaaatcaagagaatcaagggacccaattttcagtgggttttataatcataaagccacatgagtagttgactatcttcctgaataaattgttccatgttatcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaaagagagagagatagtgtcatcagacttgcaaggtggtttccggtttcgttgaggcaaatacatccaacaatacatccaacatcacctgtcatcctgcaggtccactggatactctctattaattactagtgttcagctatttttttcaggcacccatatgtacctacaaatctgcagatacattctattgatctgagactcacactttctccttttaaccttcctaattcacacatcagcaaagttaactcatgtttccatgactttattatgatttagtggcataacagatataagcagagttgttcaattatcatcgttataacttacttttggtattcattttttaaataattgctaacttgacttttgacttgtagtccttcatacagggtagttagaatacccaggtaaagccaaattgaaaacccctagggccaggtgtggtggttcacacctgtaatcccaacactttggtatgtcgaggcagaaggattgcttgagaccaggagtttgagaccactctgggcaatatagtgagaccctgtctctgcaaaaaaaggaaggaagggaggaaagaaggaaaatagggagggaggaagggagggagggagggaaggaaggaaggaagggaggaaagaaggaaaatagggagggaggaagagagggagggagggaaagaaggaaggaagaaaggaaggaccctataatagacagggaagatattgacactggaaccctagacagggaccaagaaaaggaaaaggactgtccccaaatcaaagcacacacataaagaggctagccggatgtagatggcaacttccctcctcactcccattgcccttgagttgattctgcatctctcactataaagcatttcatgtgcaatcatattgggccaaaaatggtttagatcagcattactggagagacagacaggaagtataatagatcagtacacttgcagtagcggtgtgagggccagtgctcgtccatggtaaattgcaaataaagtcaatggctccttgtagaacaaaatgcattcaatttaaagaattttgtttattctgagattactttttcagtggcaaggaaaattctttcttttctatcttttaaaataaaatattggtcagaatagatggttggtatcttttcagatacattagcagccctatttggttcataactttttttctgaaattgtgcttgtctgtgaaatccaaaaataaggacacttggtttaatgatttctggaggttctttccaatcttatggtgccgtgactccactggtaagaaggaagaagcacaaactcaagagtgagggacatacagcccaagccccaggcaaatgtagataatgggaacacacttagagaactcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtaccccaataaagagtcatgggatagctaaacaaaccttacccagaatgtacaaggaatgagaactgacttggtattttttaatttttattcttacttttattttttttgaggcagggtcccactctatcaccctggctggagtgtaatggtgtgatctcagctcactacaacttttgcctcctgggctcaagtgatcctcctgtctcagcctcccgaatggcgaggactacaggcatgtactaccatccctggctaatttttgtatttttagtagaggcaggctttcgccatgttgcccaggctggtcttgaatcctgggctcaggtgatccacccgccttggcctcccaaagtgctaggactacaggcatgagtcaccattcctggctgacttggtaattgagcagcgtgagagagatctcatttcctgtcactgaagctgcctcctcttacccatcttacctcacctcctgcatatctgcttacacggtgtaagggatgtgctttgtgggtgtctgcacagactgtagctaaagaaaagtgaatgtaggaagcaacttacaatttttccaaccttgtgatggtacaaaagtgataattccattcttgtttttcacttaaaatacagtattcaataagttacatgagatactcaacactttagtataaaataggctttgtgttaggtgactttgccccactgtaggctaatgtaagggttctgagcacatttaagctaggctaagctatggtaggttagatgtattaaatgcatctttttatttacaatgttttcaatttatgatgggtttatcaggatataaccccatcataagtcaaggaacatctatatataaagagatttattatgaggaattggctcacctgattatggagactggcaagtcccataatctgttgtctgcaagctggagaccaaggaaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataatgcccacccatactggggagagcaatctgctctactcagtccaccaattcacatgttcatgtcttccagaaacaacctcacatacatacccagaaataatgttggaccaaatatctgggcatcctgtggcccagttcaattgacatataaaattaatgatcacagggtgcagtgcttggcagtgtacatcacagtgaccatgtttattttctccacagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgtta

SEQ ID NO: 2518 - DNA, 13124 bp, Homo sapiens
  source 1..13124: mol_type = genomic DNA
attttcctcctcccaacgattttaaattagtttcactttccagtttcctcttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgaggtcagtgaaataagaatgcataatcatgcttgtttttgagtgcaaattgtaagttgagtttcttactgtgcaggcacattcctgaattgtcctgatgtttatagattcaatatgtctttatcagtctgagcatttgtaagatgtttgaggggtttttccctgtggctttttttggtgtacacacaggcttcttaagtttctggaatggttccctacggaactacatggggggaggcagggtggggaatgcatcagctcatgtttcctccctgtgtgcagctatttcctgcaatgagaggaaggcttggcaggagcggtgtatttcactcagccacaaacttggctgattcaagggtagacctaagggaattactcttttgggtttttctgttattgtcattttgtttgaaaagattaagtcacaggctttttttcttgtaattttaaaaggaggaatttattttcaacagatattgtgaaagatacaatcagtactgcaaacccactcatgaagaaggcaattttgccctgaaacgttgcattactttaaggtgggaagtggaagaaacaattcttacaaatgggcatttttgtcatttcttatataaaaacaaacccaaagcttagcatttatttttattgatgtagtgaatgctggtcagcagcaaaaaaagaatttctcctcaaaagtgtaatgacctaatctattatctaaaactagtctaatctctaatggtgggaagcagatcagtggttgcctggagatggtggggattgagtaggaaggctcccaaaagaatctttttagaatcataggaatagtctatagggaggtagtgatggtggctacatatgcataaacatttaccaaaactcatcagactatacactgaaaatgggtgcatcttattgtatataaagcataatctcagtaaacttgatttttaaatttatatattgacctcctggagttcttcaggggatagcatgttagggagaactaagagaaaaggatgcctttcccaccaagcatctctaggaaaggagtgaggaggtgattgccagggagggaagaccccatcgaccattcaggggggcagaaaaggaaaactggattccctaccttactctgccccaaggacttgaagatgctctgcaatgtcatgtttggggatgagatgggtaagaggaattcactgccaaatacctcagtatatagaatacccttttatatagaataagttcctggtcaagagtgatgttaattgtgtctgtgtgagtgggattgaccagagagcaaggcgtcttagtagccagcttgcaggaaaggttttacagggtcctgtctttaggtgtgtctatagccactgacctgaggaggtctgaggggggctctctgaactatgctggactcaggttcacatcaaggtgctcctatttccagaggctataggaacaggaagagattgggctgctcctccccagttgtgctaaaaatttccaaatgggaaaatcacctggagaactcactggcacgtgccagctgatgggcatcctcctctgccccatccactgaggaactctgttgctccctttacacactcacaaattcacttaaaattataacacaaatatattagtaccagcaatcatggtggtaacatttctttgtgatctgtagttagtggtttcatgcaagtccgtgtgaagagaccaccaaacaggctttgtgtgagcaacaaggctgtttatttcacctgggtgcaggtgggctgagtccgaaaagaaagtcagggaagggagataggggtggggccattttataagatttgggtaggtaaaggaaaattactgtcaaaggggggttgttctctggtgggcaggtgtgggggtcacaaggtgctcagtaggggagcttttgagccaggatgagccaggagaaggaatttcacaagataatgtcatcggttaaggcaggaacaggccattttcacttcttttgtggtggaatgtcatcagttaaggcaggaactggccatctggatgtgtacatgcaggtcacaggatatgatggcttagcttgggctcagaggcctgacaagtgggcactgtgttaaacacgttttacgcatgacctcatatcacccttccaacagccctaggaagtaagagctattatttctattattagcctcattttctagatgaccaaaatggggcttagaagggcaaattacttgcccaagacatcagatagagagcaggtgtcagagcagagtcattaatggaggcaccaaactctactgctgatcatctgactctatgcccaatggccaaaaggtgaaagatcttaatgctttcaactatgctcactttagagagggggccagggatgggcttcctatctggagagtaagggccagcctttgatggttacccatgccttagagtggccaaagccacaagaactgaacccagatcttggagaagggtgaaagtggttctccccagggcataattttctatcatttggatgaagggaaaaggaaattcatcctagggcattttaaggataagggaatgaggctcagtgatatgactcaagaaatatcccagaactaagcaaagaggtcactgaaatccaggtgtcctgtggttttcttcccttcactcaagatgcctgataatgctgcttaattcaccacattagctccataaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggactgcatagtcagtactgtcaatatacaataatcagaaggctcaggatccagttaaaagagtttattcaacaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgcagcctcagactcctgggctcaagggattctcccacccagcctcccaagtagctgggactataggagcacgccactatgcctggttaatttttttgtattttagtagcaatggggttttgccatgttggtcaggttggtcttgaactcctgaccttaagtgatgcacccaccttggcctcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttggagaccagcctgggcaacatagtgagaccccgtctgtactaaaaatacaaaaatcagccaggcgtggtggcacgtgcctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagaacagcctgaccaacatggtgaaaccccgcctctactaaaaatacaaaaattatccaggcatggtggtgcacgtctgtaatcccagctactcaggaggctgaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggcgtgagtgagctcagttctcacagattctgtttcagtttcccctcaagagggatcttgatagggttccatcagtttcactttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcgagtggcctgaatcatatcaacctgagtcttctaatagaatgcaaatttctaggtcctgcattctgaaatcctgattgagtaaaacagaaataaggtccagaaacaaacatatatttaaagaggaccacaagtacttcataggcatactgaatggcttacagaagaaatgtccatctccaaatcctctcttccttaaatgcatacaaggcttcctgcattgtatgtgtgtaaatgtgaaggaggaaaccccaagaggcaggaggggggaggggtgggaagaatgttgaaataaagcaaagcttgtttctgggcacagtggctaagcctgtaatcccagcactttgggaggctgaggcaagaggattgcttgagcccaggggctccagaccagaattggcaacaaagtgagacctacaaaaaaacaaaaataaaataaaaataaagcaaagtttgactgtttaaagggtaatttaagtatgagaaactggtgattggaaatcactgccaaaaagggaagtcttcccagagccttgctgctcacagtgtggtctgaagctgagatcccccgggaggttgtaagaaaggtaacatcccagcttatctgaatccagatctgcattttaaaaagatctccagatgtttgtgtccatatgtacattaaaggttgagaagtccggctctggagagttccttcacttgctttctgaagtgatggactccttggattgggcctgttctgaccaaccaactgagcacaggtctgccagttccttcacgtagtcagttggagcataaccagcacatgctggggacaagctgcacatgtgcagacaagagtggggaaatccccactcttaccacttcaagaaagccactttctgaaaatttcaagattctactctagtaatagctttgactgggaaggagatgtggtatctaccctggagtctgtgggcaagacaggtggtcatgatctgggttaggtgagagactgtaactatgttgattctggggatttcctaaggactagcagcactagctttaactgctttagtaagcgaaatcttatgtctgcaatccgaggtcatgggaaatctctttctggacctgagggaatcctatctccctaaggtcttctactagatgcagatccaggtaggactggcattctactccccaagtttcacctgaacctagctattctgttttttcttctttttcttttattctttttttttttttttttttttttttttttttttttgagacggagttttgctctttcgcccaggctggagtgtagtggcccgatcttggctcactgcaacctccgccttccggtttcaagcaattctgcctcggcttcccgagtagctgggattacaggcgcctgccaccacgcccggctaatttttgtgtttttagtacaggcggggtttcatcatgttggccaggctagtctcgaactcttgacctcatgatccacccgcctcagcctcccaaaatgctgggattacaggtgtgagccaccgcgcccggccacctagctgttctttatcaagtgactgtagtcatcatcccacctgcctgcttgtatttatttaaatatctgcattaattactgttaactaacttatttatacatataagaagtattcagagtaactttcaaaaacacatatgagataaattattaagtgaggaaaccttggcaattggagtatttgttttaagagggcaatagtattataatgaaaacctcctgacctgtggctctggggttcatgtttcttcttatcgaggtctcaggccttccagtccaatatattttgctccaaattttacttcaaggagagatcaagtatcaaatacctcatcaaattggagactttagggagtaaggcttaggaaaaatcaagagaatcaagggacccaattttcagtgggttttataatcataaagccacatgagtagttgactatcttcctgaataaattgttccatgttatcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaaagagagagagatagtgtcatcagacttgcaaggtggtttccggtttcgttgaggcaaatacatccaacaatacatccaacatcacctgtcatcctgcaggtccactggatactctctattaattactagtgttcagctatttttttcaggcacccatatgtacctacaaatctgcagatacattctattgatctgagactcacactttctccttttaaccttcctaattcacacatcagcaaagttaactcatgtttccatgactttattatgatttagtggcataacagatataagcagagttgttcaattatcatcgttataacttacttttggtattcattttttaaataattgctaacttgacttttgacttgtagtccttcatacagggtagttagaatacccaggtaaagccaaattgaaaacccctagggccaggtgtggtggttcacacctgtaatcccaacactttggtatgtcgaggcagaaggattgcttgagaccaggagtttgagaccactctgggcaatatagtgagaccctgtctctgcaaaaaaaggaaggaagggaggaaagaaggaaaatagggagggaggaagggagggagggagggaaggaaggaaggaagggaggaaagaaggaaaatagggagggaggaagagagggagggagggaaagaaggaaggaagaaaggaaggaccctataatagacagggaagatattgacactggaaccctagacagggaccaagaaaaggaaaaggactgtccccaaatcaaagcacacacataaagaggctagccggatgtagatggcaacttccctcctcactcccattgcccttgagttgattctgcatctctcactataaagcatttcatgtgcaatcatattgggccaaaaatggtttagatcagcattactggagagacagacaggaagtataatagatcagtacacttgcagtagcggtgtgagggccagtgctcgtccatggtaaattgcaaataaagtcaatggctccttgtagaacaaaatgcattcaatttaaagaattttgtttattctgagattactttttcagtggcaaggaaaattctttcttttctatcttttaaaataaaatattggtcagaatagatggttggtatcttttcagatacattagcagccctatttggttcataactttttttctgaaattgtgcttgtctgtgaaatccaaaaataaggacacttggtttaatgatttctggaggttctttccaatcttatggtgccgtgactccactggtaagaaggaagaagcacaaactcaagagtgagggacatacagcccaagccccaggcaaatgtagataatgggaacacacttagagaactcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtaccccaataaagagtcatgggatagctaaacaaaccttacccagaatgtacaaggaatgagaactgacttggtattttttaatttttattcttacttttattttttttgaggcagggtcccactctatcaccctggctggagtgtaatggtgtgatctcagctcactacaacttttgcctcctgggctcaagtgatcctcctgtctcagcctcccgaatggcgaggactacaggcatgtactaccatccctggctaatttttgtatttttagtagaggcaggctttcgccatgttgcccaggctggtcttgaatcctgggctcaggtgatccacccgccttggcctcccaaagtgctaggactacaggcatgagtcaccattcctggctgacttggtaattgagcagcgtgagagagatctcatttcctgtcactgaagctgcctcctcttacccatcttacctcacctcctgcatatctgcttacacggtgtaagggatgtgctttgtgggtgtctgcacagactgtagctaaagaaaagtgaatgtaggaagcaacttacaatttttccaaccttgtgatggtacaaaagtgataattccattcttgtttttcacttaaaatacagtattcaataagttacatgagatactcaacactttagtataaaataggctttgtgttaggtgactttgccccactgtaggctaatgtaagggttctgagcacatttaagctaggctaagctatggtaggttagatgtattaaatgcatctttttatttacaatgttttcaatttatgatgggtttatcaggatataaccccatcataagtcaaggaacatctatatataaagagatttattatgaggaattggctcacctgattatggagactggcaagtcccataatctgttgtctgcaagctggagaccaaggaaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataatgcccacccatactggggagagcaatctgctctactcagtccaccaattcacatgttcatgtcttccagaaacaacctcacatacatacccagaaataatgttggaccaaatatctgggcatcctgtggcccagttcaattgacatataaaattaatgatcacagggtgcagtgcttggcagtgtacatcacagtgaccatgtttattttctccacagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggacgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgtta

SEQ ID NO: 2519 - DNA, 36751 bp, Homo sapiens
  source 1..36751: mol_type = genomic DNA
gtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaccccccactaagcttacactcctgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggagtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatggctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtttctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggccggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttctttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttggtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggcggggggggtggagggggggggcggatggagtctcgctctgtcacccagactggagtatagtggcatgatcttggctcactgcaacctccgcctcccgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggacgactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggttttatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctacgattacaggcatgagccactgtgcccggcccagttacatttttaatggctgaaaaaggatcttttatcatcatctgcatcagcttgagtcattgtggatcttggcacatggagagtttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaactgagatcgcaccattgcactccagcctgggcaataagagcaaaactccatctccaaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtagagactctgcctcctctgctggttgccacctcctcttttttttttcctcagagatggggtctcactatgttgtccagggtggtcttaaactcctgacctcgcaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattctgcgcctgggacaccctgcccgcctcctggagtccattcagcagcactccctggatgcggttttagcgcggagcgacagtgcccagattgttgcagatatcaggaaggacatcgaccaggtctttgtaggtgtcatggccagtgtccatgtggggcgtgggcttctgatctgcagtctttttaaggagcaaatttatctgtctgcattcctcttgaccttctcttgcttctgtcgattcctttaataattttaaaaattgggctgcccttttttttttttttttttttttttttttttgtgacagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccagggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtattcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaggagtggcggcagcagagagggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctctattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggtttttttttttaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctgcaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttctttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccagtagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttgagacagagtctcactctgtcacccagactggagtgccgtggcgcaatcttggctcactgcaacctctgcctcctgggttcaagcgattcttctgtctcagcctctggaatagctgggagtacagatgcacaccaccacgcctggctaatttttgtatttttagtagagacggggtttcaccacattggccaggctgctctcgaactcctgacctcgtgatccgcctgccttggcctcccagagtggtgggattacaggtgtgagccaccgcacccggcctcatgttttttaacattgtggtgagaacacaacatgagatctaccctcttaaatgtttaagtgtactatataatattgttaactatagacgtcgtgttgtgcagcagatctatagaatttatcttgcacagctgaacctttatacttgcttattgctgagttcactaatttccttctttcatgcctaatctcacatctgtcccatccagtgtaactttcatctgacatccagaaataagagtctttttatatctttgatgttcttatttaatttttttaacatttggaatacaactataataactgttttgaatattctagactattatttctctatcacctgtgtcatttttggtctctttcgatgaactgttccccttgagtggttgtgttttcctacctttttgtaggcctgctaatgtttgtttggataccggacattgaggattttacgttgttgcatgctgaatattgaatatttttgtattcctataatctttttttttgtttttttgttttgtttttttgagacagcgtcttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaatctcgcagcagatctctggggttttttctctctgtgtagcagtctctttggcattttgtcctggaaactctgcctgcattggtcgccacagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacgcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggccgctcttagctgtttgcccttaggccttgccaacatggctgcttgcttcctaaaagccagcaagagacatagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttgaatgtggcccaacacaaatttataaactttcttaaaacattatgagatttttgtctctgtgttttttttttaagctcatcagctattgtcaatgttagcatattttatgtgtggcccaagacaattcttcttcttttaatatggccctgggaagccaaaagattgcacatccctgccttagagtctgtttgccacaacctctcagctggtgggctgctctaaggaacagagtccaggttctttttttttttttttttttttgagacagcatctcactctgttgcccaggctgtagtgcagtggcacaatcttgattcactgcagcctcctcctcccgggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaaagggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattcgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgcttttttttttttttttttttttttagatggagtctcgctctatcgccagactggagtgcagtggtgtgatctcggcccaccgcgacctctgcctcccaggttcaagcaattctcctgcctcagcctcccgagtagctgggtctacaggcgtctgccaccacgcccagctaatttttgtatttttagtagagactgggttttaccatgttagccaggatggtctctatctcttgacctcatgatctgcctgcctcagcctcccaaagtgctgggattacaggcatgaaccaccatgccagcctctgtgtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattctcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcctgactctctacgtgccttgtagttttttgttgaaaatggatgattttaaataatagaatgtagcaactctggaagtcaggttctcttcccaccccggggtttgttgttgttgccacttgttgtttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacatgtgtgtggccttctagattcccaggaatatgttggagcttttcaaagccccctgaggatatctcattccccagcttaaaactttggttatcctatcatttgctccgaccattattctctgtcttagaaaactgtgatgttcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcagatgcttttctggaatgaacacttccctgattgctgcagcctttggcgagtttccagagttctgagaaagttgattctgaccatttgccgatgtcttgttgctttcgtggaggagagaattctcagagcttgtgagagtctctttgctgacatccttctctggcttcaaggacagcacttgctggaaatcaggaggcatcccctgagccccacaaggtcagcttgtggcctttgtggcctttctgttccctgctggttgttggggaactagagtgagttcctggaagtgcttctccatcatgaagtctggtttctctctgtactgtgaagtcacatctgtgacctaaacatgtctcttaattatccaaagcccagccaagttctgtctcctctgtgggtgctttttctagccatctctgaagagtcaatcttgagaaatttctcagtatgtcttcatcatggcattatgtacatatcattagcataattcactcagatggaaggcagaaagggtgggaactaacattgatcacatttatggaaacctgccttctcgtgctgggcactttatatatgttatctccctttgtggtgcaatctcatgacatgcagtcattgtccatgtttgtgggtgaggaaacaggcttaggggtgggaggctcgcctgaggccccacactgttggctggagacagcgtggggcctgagtcttgctcacagcctgaacgctgcactctgctgctccgcgtcccaggaaggaaaagctgctgcagtgggtttgtgttgccaaatacatggaggcttttttctgggtgagtgcccagcagttgattgttctgtatgtccaagaaagtcaccttagaaaagaattaggttctaaatttagaaaataattgagttacaatatttagaactcagacagcatcccttgggcttggggtcacagccccgaaggggtgattaattttgccaattgaagatcagaggggcctgtggccagagtacccactgcttaagacacaggtgagctggaaccatgagttttaaaatgtcttggccaagtttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagtcctgatgcggtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctctgaaagatcgtcctggtgggagacacatggggatctagagtggaaatgttacgggatctctggggtgttgatttttctggctggaaacctctgcggccgcagcacctttgcctcagttcttgtcctgcatccaggaagaatgaggtacgcagattagtgaagggtgaagaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggagctgagagaggccaggcagtggaagcagacacccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagccccgcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggacgcttattcagtggcttcttccagggagaggttctcgagatgtccttaaaggaggtcttcatcctctggaaagcctttgggtggaggaagtttggaactgtgcccttgagcagggaccctgttgtgtaggagggagtaggatggtttcgggggaagacgttgggtggcgttccctgcagagagtaggatggttttgggggaagacgttgggtggcgttccctggagagagtaggatggttttgggggaagacgttgggtggtgttccctggagagagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacgttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcctgggcagtgctcagccgctgcagccgttcttggtgggagtggacttgactgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccactgcttgacttgttgccctttcctctgtctatgaagccagccgtgttacgtcttcaaatctctcccctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttgctgtggttcacacctggactctggggctcaggcctgccttccccctttctccctcctgggcgcagggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgaggtgagtagctcggcaccacccgccgccccatccttctgccctggctaatcctctgcgtcacctgtttctacgcagcaagctaaagtgaagctttctgcatgaaagtcgactctgaggctagctttttggaagagagggtggccttgccctggagagctgggtcaggcccgctccctcccttctgatgtcctgatgtgctcattgtcctcccctacctaagccttttcctcgtgggaggggtcggttctgttgggtggggcctcagtgctgcactgtggccccctgatgtgctccctctctgcctgtgtgccagggacctcccaggtgtggctgccacagaagagacgggtgtgcccctgctcttggtggacaccgccggctgcgggctgtttgagctggaggaggaggacgaacagtcgaaagggaaccctggtgagcttgcttgcagatggccagcttttttgtttaaacatacctccagctctttaaaaataaaaggcactttaattgcctaattccgggaggagctgagagcagttgttgatggccgtgaaaaaacggagccccacactgcaagaggctgagcagcatcgttttctccagggtgagcagaccgctcctgggtgagatgggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagctgggcatggctggtcctggggccctgggacacagatgattagctcccaggaagccacctgagtggaggatcagctggccatgatagacagaaacgtgcccgaaacacgtgttggtggtggatgcccacttggggcgaccttgtgctgctcacccgttctttctttccctccaggcgaagtccgcctcgtcagtttgcacatccaggctctggtggacgctggtgttccagcccgtgacattgctgtggtctcgccatacaacctccaggtacgagggtttccttttgtccctctacagagcagctggggctcacacaacctagagggtgaaagaaaaagggtgatttgttggctgtggtgaccgaaaagttcaggggtagggctgaccttattgtgactggatccagggcccaaatgatgtcgtcaggggcccctctgcgtgttcgtctgcccgccccaccttgccccgccctgcccggtgccccagccttctgcactggcttgtgttctggccagatttgctgggtgaccccggcagcctcaggctgacacagtccttccacgggcagccctggcggaacagcctgtccttttctggcatttcccacaggagtctcagccttgagccttgctggtctggctcaggtcgtgttcccatgcgtatctcatttggtaggaaaaatgtaccttctggagtatcgggaggatctgtggaagtggccatcataccttcctggtgtgcaggcatcacacatagggctgtctgaggctggcggctgtcataagccaaaagaaatgatcaaatgccagggacagggtgtggtattggcgtgcatgcgtgcccgtgaggagggcgaacgggaagcctttccccatggggctcctgcaggctccgcttcccaggtcctggctgtttcacagcgtgaggccctctgctgagctgaagggcagggtcttgctgcgctggcatgggtgggtgaggaaaccacagcccggctggtgtttcaggtggacctgctcagacagagccttgtgcacaggcaccctgagcttgaaatcaagtctgtcgatggcttccaaggccgagagaaggaggccgtgatactgtccttcgtcagatccaacaggaaaggtacggagccctcgccagagtcctttggggacagcacagaagtgaatttattgattgaggggcatattgggtgtctgctgggtgccacactggtttctggcagtgtgctcatggtgcaccttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgctgtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccacgcgtggccgggcacccgtgtggatggtgggccacgcgcaggggactacacttttggtggtggttactgataagggcgtaggagcctgactgtgtttcttagtctgaaacctgcttctcactcccctctggccttttgtaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggtaagtcaactaataagaacttggggcagtgtcccctcactggggtgctggccccacttggagcccacctgccaccatcaacagaaggaagggcttcctcctggtggcaccgtgcccgtgtcattttagctttattttcagtcatgccactcccagctccgtctgggctcccctaggtcggtgatcaggtcacgggcaccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccgtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcctcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaatctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcacccacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtcaccagtcttggctgcagtgtggattaggtaggcggaggctgggaggcagtgggaagtggccgcagggaccgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgataggcagagctgcaggatctgcctccttgcccctgtgagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactg

SEQ ID NO: 2520 - DNA, 16548 bp, Homo sapiens
  source 1..16548: mol_type = genomic DNA
acagccagcagcctgccgggagccaaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccggtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaaggtaggtggaggtcttaggcagagaacagtgcctagatggtgggggcacaaattctgactctcctttctttccttcccagggcctctcctgccgcctctggggtaagtatccctacttttaaaaagaatttcccaggttggccgaagggagcagagctgtcccaggcccatgccctccatgcccacctcagcctaggacagccaagttctttggctctctgggtatgtcaggtgccaccaaattctgggcttggaacagcttcagctcccacccgctcctccacacacagacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggtgagcaagtcatcctgtgacagtgcatgtgtacacgtgagtgtgtctggggtgggcatgagggccaggggatctctcaagcagtgctaggcatcctcagtgttctcctggaggacaccagcagaaggacccccaggccagtgtggtctccccagcccctgcttcccagcactgggctttccagaaggaagccaacgccaaagccagccagcccagagcagggggcctcacccagggccttgctcttgggtccttctagggcactgggaagagcctgaagatgaggaaaagtttggaggagcagctgactcaggggtggaggagcctaggaatggtgaggagaacctggctggcccaactgccccatgccaaggcctggcctgccgctcctgggcctgactgacccctgccctgttgcccacagcctctctccaggcccaagtcgtgctctccttccaggcctaccctactgcccgctgcgtcctgctggaggtgcaagtgcctgctgcccttgtgcagtttggtcagtctgtggtatgcaaaataataataatcaccttctaaacctaaaatctataaaactttttcacatgcattatctctttgaggattacaaaagaattaaatttattgaaacccttcagtaccaggcattacagccagtgttttacaggtatcaacttatttaattctcacaacagccatgtgaggtgggactattcttttgattctgatcagcgctgtgggcaagtcccttcagcctgttatgcctcagcttttatgtctgtaaaatggggatgagaatagttctacttcatatgcttgactgcgagaaatcaccaagcgtttttcagggtgcttctactattttcccctcctaccagcagtgtatgggagtcctagttgcttcccatctttgccaacacttgatggtgtaattttattttatttttaaattaaatatatttgaattttaaatatatgggaccctccatgaatttgcatgtcatcctcaggcacgggccttgctaatcttttctgtattgttccagttgtagtatatgtggtgccaaaacaagcataagtgttgtaattgtcataatttttctgcatatgtagtggtttgccattgtggttttaatttgtatcttccaatgactgatgaagttgagcacttttttcacatgcttattggctatttgtgtaacttccttgtgaaatatctcttaaagtttttttgtttttgtttttgtttttgtttttgccacataaaaaaacaatagttctggccgggcacagtggttcacacctgtaatcccagcactttgggaggctgaggcgggcagatcacgaagtcaggagattgagaccatcctggctaacactgtgaaaccctgcctccactaaaaaaatacaaaaaattagccaggcatggtggtgggcgcctgtagacccagctactcgggaggcagaggcaggagaatggcgtgaacccgggaggtggagcttgcagtgagccgagatcgcgccactgcactccagcctgggcgacagagcgagattccgtctcaaaaaaaaagaatagtcccacctcacatgactgttgtgagaattaaattaagttggtacctgtaaaacactggatgtaatgcctggcactgaataatttcaataaatttaattcttttgtaatcctcaaaactacctgatgaggcattattagtatcctcattttccagatagataaaatgaggcttggagaggggaggtctgtgggctggatgcacttctctgtactcttggaccaaagaaagagtcctaccatacataccatggtatacttaccatggtgtaagtaccatggtgcagggtgttggggcttctccctgccttaggaggccacatgtacctggaaggtctatttccactggggtcaaatcactcaaaccctttgactttccctccaacctccagcccccagccaatatcctatctggagaattgtagactgggagaacatctgcttggtccatgtcacaagcagttgtaaggaacactgaggcactgggttgagtgtgagaaccacttctgtggggaggggtgtgccatattgtgttggggtgtctcatctccttagctttggccaggtgatctagcacagcagggtgggtgcagggatttaaatgtctagggccttttcccgccctggtgacactcttactgaggacatttgctttagaattgaggccccttgaaagaaaggtgaatagtagatttcaggctatacagtataaatacagtcattagttgggggaggagggcagtgagcagagtggtccctgcagatgatcccacagcccttggcctggattctgagccctgcaccgccagccttcctcacccctctcctcacagggctctgtggtatatgactgcttcgaggctgccctagggagtgaggtacgaatctggtcctatactcagcccaggtacgagaaggaactcaaccacacacagcagctgcctggtaagtggacccccaagtcctggccccctagcctctgtcccctctggccattccccctcctgatttcaccctcttctagctccatccactctccggcaggggtctgagctgctatcctccccagagtcagtccctcggaccttctctctctgggtgatatggctttccagcccctggggaaggttctttgagcattggatagatgtgggtggtatgtaggggatggggagccattcctaatgcccccctgggagccaaattgcccccacttctttccttggcccccagccccactggaggctcttctgtgatctctcctcagactgcagggggctcgaagtctggaacagcatcccgagctgctggggtaggggctagggccagtgggccgggggtagggaggggcagggtctggagtataagaaacccttggagtccacttcagatatgggctaccacatctcagaagctcacagaacatattcattcattcattcattcattcatttgttcataacacattaattgcagtatctgtgctaagcactggaaatagaaagatgaatcttgggtcaggctcagtggctcatgcctgtaatcccagaactttgggaggccgaggtagaaggatcacttgagctcaaaagttcaagacgagcctgggcaacatggcaaatccccgtctctaccaaaaatacaaaaattaacaggacatggtggtgtgcatttgtggtcccagctactcaggaggctgaggcaggagaatcacttgagcctgggaggcaggggctacagtaagctgagactgcaccattgcacaccagcctgggtgacagagcaagactccgtctcaaaaaacaaaacaaaacaaaacaaaaacaaaaaacttgaaataaaagctaagaaagtcaagggtctaacttttttcccacgtactatttggattttgttttcgttttgtattttcttttttattgtgtataacatacatacataaaagtatgtaaagggtactgattttcttttttttttttttttttgagacagagtctcgctctgtcgctcaggctggagtgcagtggtgcaatctcggctcactgcaagctccgcctcccaggttcacgccattctcctgcctcagcctcccgagtagctgggactacaggcacccgccaccacgcctggctaatttttttttttttttagtagagacagggtttcaccgtgttagccaggatggtcttgatctcctgaccttgtgatccgcctgcctcagcctcccaaagtgctgggattacaggcgtgagccaccacgcccagccaaagggtactgatttccatgtccagttcttttttttttttttttttttggcggaatcttgctctgtcgcctaggctggactgcagtggtgtgatctcagctcactgcaacctctgccttctgggttcaagcgattctcctgcctcagcctcccaagcagctgggattacagacgtgcaccaccacgcacagctaatttttgtatttttagtagacatggagtttcaccatgctggccaggctggtcttgaactcctgacctcgtgatcctcccacctcggcctcccaaagtgctgggattacaggcatgagccgccacgtccggccaatttgtttttatatatgtatacacttgcataactagcacccagatcaatacataaatactgtgaatacatcacatactgtgatgttttctgaactactaaatgttttcaacttcattttctttttgccttcttaaaattaaagttggcctgcctctttggcaactcattaaagactattcaacaccagagttttgaaaacacagatgtgtatatcatggatttcatttcttccttcattaagtagacattgattcatttattcaacagatatttattaatttctgtgtaccaggcaaatccctggacactggaaatattaataaatcaataaatgaagatgacaaaaaacccgaccccacggagctggtgtcagggtcagggtgggggtgaggaaggacacaacaaacacatggagatgtgaagaatgcagtaagttagacagtgattagcactaaggagaacatttgtggaagggctggggaaggttgggagttgtagaggtcagggatggtctcattctggtgagcagagacctgaaagaggtgagggaggagccatatatttgagggaagagagaatagccagcaaaaagggcctggggtgggagtatgtcaggggtgtttaagaaatagtaaggagggggccgggcgcggtggctcacgcctgtaatcccagcactttgggaggccgaggctggcggatcacgaggtcaggagatcgagaccatcctggctaacacggtgaaaccccatctctacaaaaaatacaaaaaaatcagctgggcatggtggcaggcgcctgtagtcccagctactcgggagcctgaggcaggagaatggcttgaaccccaggaggcagagcttgcagtgagccgagatcacaccactgcactccagcctgggcgacagagccagactccatctcaaaaaaaaaaaaaggaaaaaaaaaagagagagaaacagtaaggaggtccttaataactctgcagcagagttattaaggacacaaatgccataggctgtgcgcgatggctcacgtctgcaatcccagcactttggggaagctgaggcaggaggattgcttgaggttaggagctcaagaccagcctggccaacatgagcgaaatcccatctctactaaaaatacaaaaactagccgggggtggtgacacacgcctgtaatcccagctactcgggtggctgaggcaagagaatcgcttgaacccaggaggtggaggttgcagtgagctatcgtgccaatgcactccagcctgggcaacagagcaagactccctctcaaaaaaaaaaaaggacacaagtatcaagaggtaaggtcagaaaggtcacagttctgaacagaggaaaatgacttgttttaaagaggttacaagatctttctgcagagggagaagcagggagaatagctcttctccgaccacacactagggtctccacgggcttggctttgggcagctgctaggagcaaagtctggtctgaaatgatgacacacgctctgccctccgagagcctcccagtctagggggtttgaaggaaactccaaagggtcagtcggggatgcagaagaggtgaggaagtctaagctgcgctctctttgcctctcccaccagccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctggttccctgcctctgtattcaggtaggagcagagtctagctgggtgccagaagaggagtgggaagatgatgatgggggtgatccctgccttcctggtctcaccattcttcaaacccttcattgaggtggagactgtggctccctggggtggctggccctcccttgacccttgctgtcctatgccttctgtctattacattccctgaatgctctccctgatcctccacagaactcctgcttattcttcatggccccattcaaatgtcaccttctccttgaaacctttccctactcctccagttctgtctttgtgttcccctggcgggcagagcatgtgctacgaacttggactggtttgaatcttggctcttgccatttgctagctgtgtaaccttgggcaagtcacttcacctctgtgagcctgtttctcatctgtaaaatgggaataataatagtaacagcctcatggggctgttataagaatgtgtgccacacccaggcttaaatatgctggctctttcctcttcctctgtacatttatttatttttttagacaaggtctcactctgttgcccaggctggagtgcagtggcacaatcatggcacactgcagcctcagccccatgggctcaagtgatcctgctgtctcagcctcccaagtagctggaactactggtgagcactaccatactcagctagtttttttttgttttgtgtagagacggggtcttgctatgttacccaggctgttctgaattcctgggcttatgctatcctcccacctcagcctcccaccaagtgctgggattataagcatgagccactgtggcttgccctgattgcactttttttttttttttttttaagacagagtctttctctgtcgcccaggctggagcaccgtggcgtgatctcggctcactgcaagctgcttctcctgggttcacgccattctcctgcctcagcctcgctgagtagctgggactacaggtgcctgcaaccacgcccagctaattttttgtattttcagtaaagacagggtttcaccgtgttagccaggatggtctcgatctcctgaccttatgatccacaagcctcgtcctcccaaagtgctgggattacaggcatgacccactgtgcccagccgctgattgcacatttaattggtcatcaggtctcatccatcttacctctgacattaatgtctctcattttctttccccctcctctccatctcagtccagcttagggctctatcatctgttttctagactgtttcaacacctccaagctcccctcccttcccatcactttcctggcattctgggcccatattctgcccccaacggtgccttttcactctattttccccatgattccccttcatgagaacattgttacatccagtggagctacttaccaagatacagctagctccctgccttttctcaggtggttcccattacctcaaatgccctcacctccttcccaaagcttttccccaaccacccggcctctcctagctccaaatccccttgcacttctatctttccttgtccatttatcacttcatttcttttattttcttaaattttttttttttttttagagacagcattttgctctgtcacccatggtagagtgcagtggcatgaacacgtctcattgcagccccaagctcccaggttcaagggatcctcctgcctcagcctctgcagctgggactgcaggcatgcgccaccatgcctggctaattgtttccttttttttttttttttttttttaatggagtttcactcttttgcccaggatggagtgcagtggcgtgatctcggctcactgcaacttccgcctcccaggttcaagccattctcctgcctcagcctcccaagtagctgagattacaggcacacaccaccatgcccagctaatttttgtatttttagtagagacagggtttcaccatgttggtcaggctggtcccaaattcctgacctcgtgatccacccgcctcggccgcccaaagtgctgggattacaggcgtgagccactgtgcccagcctgttttcattttttaatgttttgtggcgatgggccaccacacccagctcaatcacttactttcttatttgggcatctaatttcttcttgtacacaacagatgctcaataaatattatgaaatgaatgagtgttttactaatttatataaatattttatccttactacaagtgtgagtttgtgatttccttgaaggcaagcaaatcatatctaattcaaatgtaatagctttgcaagagccttgcacatagcgcctacttgttttttgtttttttgtgtttttgttttttttttgtttttttgtcttttttgagacagagtctcgctctattggcaggctggagtacagtggcgtgatctcggctcactgcaatctctgcctcctggattcaagcaattcttctgcctcagcctcccaagtagctgggactacaagtgcatgccaccatgcccggctaatttttgtattttcagtagagacggggtttcagcatgttggccagatggtctcgatctcttgacctcgtgatccgcccaccttggcctcccaaagtgctgggattacaggggtgagccaccgcgcccagccttgttttgtttttaaacaaggtaacagtatgaggtcctcactgttgaatgagtgaataaatgttactgcctaacacagccataggacacagcagatgttcatgagatgtatgctgtgatttaaatggcttcattgccaaacacagtgcctgccacatagtcggtgttcctaactaaaggcttgatggataaattaatgtattacctctagtgcttagcatagagctatgcacataataggcactcttgaaatgtctgttgaaagaataaatgaatgtgtccttagaacttagcacattccccaacacatagcaggtgcttacacaagtgattgtggaatgaattaaaattaattatccaccaggcacagtggctcacacctgtaatcccagcactttgggaggccaaggtgggtggatcacgaggtcaggagtttgagaccagcctggcctaacatagtgaaacccagtctctactaaaagtacaaaaattagccaggcatggtgatgtgcgcctgtagtccctgctacttgggaagctgaggcaggagaatcacttgaacccaggaggcggaggttgtggtgagctgagatcacaccactgcactccagcctgggcaacagagtgagattccatctcaaaaaataaaaaaataataaaaatttaattatccaaggtctcttgtgcttgccatactgctaagacacaatggtaggcactcattaaaagtctgttgaatgggccaggcgcggtggctcacgcttgtaatcccaacactttgggaggctgagacgggtggatcacttgaggtcaggagttcgagaccagcctgatcaatgtggtgaaaccccatctctactaaaaatacaaaaattaaccagttagccggccgttgtggcatgttcctgtaatcgcagctcctcaggagactgagatgggagaatcgcttgaacctgggaggtggaggttgtagtgagccaagattgcaccactgcactccagcctgggcgacagagcgagactctatctcaaaaaaaaaaaaaagtttgttaatgaagatgttgccagtgcccagcattatgtttgctggaagaatagatgtgagcacctccaggttttgtaaaaggcaggaagacccagcaagtgtttgtgaaatacctgctgaatgagtgcatccccactgtccagcagagggccaggcacatgcccatggaggggacctgagcagacccccatttcctttccaggtgtggcctctggaacctgactccgttaggacgaacatctgccccttcagggagggtgagccgaccggcctggggctggggttggggtgttgcgagcgatgggtacctggcctgcggtgactgtgccctttccttgcagacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtaagtgaagcagagggcacctcccgtggtgaggggagagtggggaaccgggggtccccttttgtgatcccacccattcctctctttccacagaaggttctcgagttcccattgctgaaaggccaccctaacctctgtgttcaggtcagaaaggggtgcatagtgctgggctggaggctggacctgggcagaccccccagccaagggggtcttagttcttgggccgctaaagcatagtggttgccagcttcctctatgggagttccactgcctactttagtagtgcgcgggaccctgggcaactcacttcacctctctgaacgtcagtttcctcatctgtttaatgcagatgataatacagtaactacctcatggagtggttgtgacaatgaaataagagaagtgcttccccttaggaatcggtacagactaaatgctccataaatgtagccacttttattattgctatccttattctatttccatacctgtagaatgggttgctctacagtttcaaagggtgattataagaacattcactcatccggccaggcgcggtggctcacgcctgtaatcccagcactttgggaggccgaggcgggcagatcacgaggtcaggacatcaagaccatcctggctaacatggtgaaaccccatctctactaaaaatacaaaaaattagccggtcgtggtggtgggcacctgtagtcccagctactaggaaggctggggcaggagaatggcgtgaacctgggaggctgagcttgcagtgagctgagagggcgccactgcactccagcctgggtgacagagtgagactgggcgacagagtgaaactccgtctcaaaaaaaaaaaaaattcactcattcaagattttttgagcagcacaagtcactgttttaggcacttgtgatagaccctaacatctctaccctcatagaacttatattgtaatggagaaaggcaggcaacagacattgtaaataaatcatatagtatcttaaaattgcatacaaataccatgggaaagggataaggtgggactggggttgcaatttttagcagggtggtcatgtgagaaaggaatctctttgagaaggttagatgagaggggaaccatgctccgtaagacataaaaacagctttagggtcagaagacgctttatacagatgatctcacaaggctggggcagagaaagatgtagtgattcctaatcacccagccttgaatccacatctgcctcaggtcagattgagtgcagattcccaacccaacaggccttctgttgcctgccccattctggtctttctgcctttggcttttgcttttcttagtggccctaaccatggtctcttcccagcaggtgaacagctcggagaagctgcagctgcaggagtgcttgtgggctggtgagttgggcctgggggcagctggggcagggccacctcctaggggtgaaggtcagggcatgggaggcaggcaagtggccaatcccagcaaggatgggtcttggtcagagtggcctctcaccccttccagactccctggggcctctcaaagacgatgtgctactgttggagacacgaggcccccaggacaacagatccctctgtgccttggaacccagtggctgtacttcactacccagcaaagcctccacggttaggactgggcgaccctcctccacagatctctccaaatgcatctcacatctggcctcaaattttcactccatccaccctgtgccggtctctgggaacatggggggtgactcagaccagggccatattcagcggcatcaccaaagtctcccagtcccctctacctcattctacccagctgtagcctggtaggtgctgccctaagggtgctacctccaggtaacagtgcccccatcctttggcttggcagagggcagctcgccttggagagtacttactacaagacctgcagtcaggccagtgtctgcaggtgagctggtggaagaagggccccacctcaatgcctaggggcaacaggcctaaaactagcactcacctactgtctatttaggcttattttatgttcagccctgggaaagttaagagtagaagaagcacagttcctatccccaaggagcacactgttggctagacacccataaacagataaccacacctacaggtgctaagttttgggttccagggagagcttccgggaagaatttcttcctataagccagatttggtatggaagaagtcataccctagtcagtgggcacagcacaaaggcagagcagctgcaggaaccttagccgggagatatgcatagttgatgctgggaatttggagatcaggccaccagagcttggtgaatattggaacacctggctggtgccctggatttggttctgtttgtatcttacagctatgggacgatgacttgggagcgctatgggcctgccccatggacaaatgtgagtattgtaagaactgcctttcctttctgtaccaggagtggggatcttgacagggaccactcttgggcacagcacatgcaatggccttgtccttccctgagatcagataaacagagggtcattccttcattcactcaaaaaatgatgagagcttgcagggatcgcaggaacaccaaaaatataaatccttgcccccgccccacccctagaagactagcaagacatgagccagtcacttacatttaaagtgggagctactgaagcaccaccaagtgttcagtgctgtaaatgcatacaatgtggacctgacctgggtggggtgaggggtgaggggctcagggggaaggttccagcaaaactctgaagactgagctaggggaagggggtagagatacagggtcttggacaggcaggtttctgtcatgagataaagatgcaggagacatgtaggggatttggatcttatgttgagagcagcaggagctacgatcaaatttttatatatttcacacacacacacacacatatatatatatatatatatatatatatatatacttatttttttatttatttttgaggcagagtctcactctgttgcccaggctggagtgcaatggcgcgatctcggctaactgcaacctctgcctcccgggttcaagcaattctctacctcagcctcccgggtagctgggattaataggcgcctgccaccatgccctgctaatttttgtatttttagtagagatggggtttcaccatcttggccaggctggtcttgaactcctgacctcgtgatccgcccgcgtcggcctcccaaagtgctgggattatagtcgtgagtcaccgcacctggcccaaatttatatttttaaaagatctctgaggctgtcatgaatcaattcaaggcaaatcaattggaggtaaaaaaaaaaaaaaaaagacagggcagggacaccaggtagttgcagacacccaggacagcaagatcaagggcccagcaaccctagcttaggggagaaaaacagctgacattttagcacttaagatgctcggcattgtgttaagtatgtattaacacattgtgttaagctttatatgtattaatatatttagtcctcacaccaaccctatgacacaggtacaactttacagaggagaaaactgaggcagagggtgacattacttattcaaagacccctaaacagatggagctatattcatccactggctctgacactgtgctgtggactctgggcaaatcatttcttcgttttttgttttgttttgttttgttttgagaggagtctcaccctgtcgcccaggctggagtgcaatggcgcgatctcggctcactgcaacctctgcctcccgagttcaagcgattctcttgcctcagcctcccgagtagctgggattacaggcgtgtgccaccacgcccggctaattttttgtatttttagtagagacggggtttcaccgtgttagccaggatggtcttgatgtcctgacctcgtgatctgcccgcctcggcctcccgaagtgctgggattatataaaggcatgagccaccgcacccggcccaattcatttctgttaagtctcagtttttcttctctgtggagggtaagtttctaactcttcttctctgggtctcccagacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccca

SEQ ID NO: 2521 - DNA, 16548 bp, Homo sapiens; identical to SEQ ID NO: 2520
  source 1..16548: mol_type = genomic DNA

SEQ ID NO: 2522 - DNA, 16548 bp, Homo sapiens; identical to SEQ ID NO: 2520
  source 1..16548: mol_type = genomic DNA

SEQ ID NO: 2523 - DNA, 16548 bp, Homo sapiens; identical to SEQ ID NO: 2520
  source 1..16548: mol_type = genomic DNA

SEQ ID NO: 2524 - DNA, 16548 bp, Homo sapiens; identical to SEQ ID NO: 2520
  source 1..16548: mol_type = genomic DNA

SEQ ID NO: 2525 - DNA, 16524 bp, Homo sapiens
  source 1..16524: mol_type = genomic DNA
aaaacgaaagcactccgtgctggaagtaggaggagagtcaggactcccaggacagagagtgcacaaactacccagcacagccccctccgccccctctggaggctgaagagggattccagcccctgccacccacagacacgggctgactggggtgtctgccccccttgggggggggcagcacagggcctcaggcctgggtgccacctggcacctagaagatgcctgtgccctggttcttgctgtccttggcactgggccgaagcccagtggtcctttctctggagaggcttgtggggcctcaggacgctacccactgctctccggtgagtctggaaccctggggagacgaggaaaggctcagggttcagtttttggctcagcaaagccttagcctggctcctgtcactgctgccactgccagaactgccctgtctggtctgtctggtgctgatggtagaagagaagaacggggaaggggcaagagctgggtctgtctttctctgggagggtctgggaatacggagccccagaaaaaggtaggtggaggtcttaggcagagaacagtgcctagatggtgggggcacaaattctgactctcctttctttccttcccagggcctctcctgccgcctctggggtaagtatccctacttttaaaaagaatttcccaggttggccgaagggagcagagctgtcccaggcccatgccctccatgcccacctcagcctaggacagccaagttctttggctctctgggtatgtcaggtgccaccaaattctgggcttggaacagcttcagctcccacccgctcctccacacacagacagtgacatactctgcctgcctggggacatcgtgcctgctccgggccccgtgctggcgcctacgcacctgcagacagagctggtgctgaggtgccagaaggagaccgactgtgacctctgtctgcgtgtggctgtccacttggccgtgcatggtgagcaagtcatcctgtgacagtgcatgtgtacacgtgagtgtgtctggggtgggcatgagggccaggggatctctcaagcagtgctaggcatcctcagtgttctcctggaggacaccagcagaaggacccccaggccagtgtggtctccccagcccctgcttcccagcactgggctttccagaaggaagccaacgccaaagccagccagcccagagcagggggcctcacccagggccttgctcttgggtccttctagggcactgggaagagcctgaagatgaggaaaagtttggaggagcagctgactcaggggtggaggagcctaggaatggtgaggagaacctggctggcccaactgccccatgccaaggcctggcctgccgctcctgggcctgactgacccctgccctgttgcccacagcctctctccaggcccaagtcgtgctctccttccaggcctaccctactgcccgctgcgtcctgctggaggtgcaagtgcctgctgcccttgtgcagtttggtcagtctgtggtatgcaaaataataataatcaccttctaaacctaaaatctataaaactttttcacatgcattatctctttgaggattacaaaagaattaaatttattgaaacccttcagtaccaggcattacagccagtgttttacaggtatcaacttatttaattctcacaacagccatgtgaggtgggactattcttttgattctgatcagcgctgtgggcaagtcccttcagcctgttatgcctcagcttttatgtctgtaaaatggggatgagaatagttctacttcatatgcttgactgcgagaaatcaccaagcgtttttcagggtgcttctactattttcccctcctaccagcagtgtatgggagtcctagttgcttcccatctttgccaacacttgatggtgtaattttattttatttttaaattaaatatatttgaattttaaatatatgggaccctccatgaatttgcatgtcatcctcaggcacgggccttgctaatcttttctgtattgttccagttgtagtatatgtggtgccaaaacaagcataagtgttgtaattgtcataatttttctgcatatgtagtggtttgccattgtggttttaatttgtatcttccaatgactgatgaagttgagcacttttttcacatgcttattggctatttgtgtaacttccttgtgaaatatctcttaaagtttttttgtttttgtttttgtttttgtttttgccacataaaaaaacaatagttctggccgggcacagtggttcacacctgtaatcccagcactttgggaggctgaggcgggcagatcacgaagtcaggagattgagaccatcctggctaacactgtgaaaccctgcctccactaaaaaaatacaaaaaattagccaggcatggtggtgggcgcctgtagacccagctactcgggaggcagaggcaggagaatggcgtgaacccgggaggtggagcttgcagtgagccgagatcgcgccactgcactccagcctgggcgacagagcgagattccgtctcaaaaaaaaagaatagtcccacctcacatgactgttgtgagaattaaattaagttggtacctgtaaaacactggatgtaatgcctggcactgaataatttcaataaatttaattcttttgtaatcctcaaaactacctgatgaggcattattagtatcctcattttccagatagataaaatgaggcttggagaggggaggtctgtgggctggatgcacttctctgtactcttggaccaaagaaagagtcctaccatacataccatggtatacttaccatggtgtaagtaccatggtgcagggtgttggggcttctccctgccttaggaggccacatgtacctggaaggtctatttccactggggtcaaatcactcaaaccctttgactttccctccaacctccagcccccagccaatatcctatctggagaattgtagactgggagaacatctgcttggtccatgtcacaagcagttgtaaggaacactgaggcactgggttgagtgtgagaaccacttctgtggggaggggtgtgccatattgtgttggggtgtctcatctccttagctttggccaggtgatctagcacagcagggtgggtgcagggatttaaatgtctagggccttttcccgccctggtgacactcttactgaggacatttgctttagaattgaggccccttgaaagaaaggtgaatagtagatttcaggctatacagtataaatacagtcattagttgggggaggagggcagtgagcagagtggtccctgcagatgatcccacagcccttggcctggattctgagccctgcaccgccagccttcctcacccctctcctcacagggctctgtggtatatgactgcttcgaggctgccctagggagtgaggtacgaatctggtcctatactcagcccaggtacgagaaggaactcaaccacacacagcagctgcctggtaagtggacccccaagtcctggccccctagcctctgtcccctctggccattccccctcctgatttcaccctcttctagctccatccactctccggcaggggtctgagctgctatcctccccagagtcagtccctcggaccttctctctctgggtgatatggctttccagcccctggggaaggttctttgagcattggatagatgtgggtggtatgtaggggatggggagccattcctaatgcccccctgggagccaaattgcccccacttctttccttggcccccagccccactggaggctcttctgtgatctctcctcagactgcagggggctcgaagtctggaacagcatcccgagctgctggggtaggggctagggccagtgggccgggggtagggaggggcagggtctggagtataagaaacccttggagtccacttcagatatgggctaccacatctcagaagctcacagaacatattcattcattcattcattcattcatttgttcataacacattaattgcagtatctgtgctaagcactggaaatagaaagatgaatcttgggtcaggctcagtggctcatgcctgtaatcccagaactttgggaggccgaggtagaaggatcacttgagctcaaaagttcaagacgagcctgggcaacatggcaaatccccgtctctaccaaaaatacaaaaattaacaggacatggtggtgtgcatttgtggtcccagctactcaggaggctgaggcaggagaatcacttgagcctgggaggcaggggctacagtaagctgagactgcaccattgcacaccagcctgggtgacagagcaagactccgtctcaaaaaacaaaacaaaacaaaacaaaaacaaaaaacttgaaataaaagctaagaaagtcaagggtctaacttttttcccacgtactatttggattttgttttcgttttgtattttcttttttattgtgtataacatacatacataaaagtatgtaaagggtactgattttcttttttttttttttttttgagacagagtctcgctctgtcgctcaggctggagtgcagtggtgcaatctcggctcactgcaagctccgcctcccaggttcacgccattctcctgcctcagcctcccgagtagctgggactacaggcacccgccaccacgcctggctaatttttttttttttttagtagagacagggtttcaccgtgttagccaggatggtcttgatctcctgaccttgtgatccgcctgcctcagcctcccaaagtgctgggattacaggcgtgagccaccacgcccagccaaagggtactgatttccatgtccagttcttttttttttttttttttttggcggaatcttgctctgtcgcctaggctggactgcagtggtgtgatctcagctcactgcaacctctgccttctgggttcaagcgattctcctgcctcagcctcccaagcagctgggattacagacgtgcaccaccacgcacagctaatttttgtatttttagtagacatggagtttcaccatgctggccaggctggtcttgaactcctgacctcgtgatcctcccacctcggcctcccaaagtgctgggattacaggcatgagccgccacgtccggccaatttgtttttatatatgtatacacttgcataactagcacccagatcaatacataaatactgtgaatacatcacatactgtgatgttttctgaactactaaatgttttcaacttcattttctttttgccttcttaaaattaaagttggcctgcctctttggcaactcattaaagactattcaacaccagagttttgaaaacacagatgtgtatatcatggatttcatttcttccttcattaagtagacattgattcatttattcaacagatatttattaatttctgtgtaccaggcaaatccctggacactggaaatattaataaatcaataaatgaagatgacaaaaaacccgaccccacggagctggtgtcagggtcagggtgggggtgaggaaggacacaacaaacacatggagatgtgaagaatgcagtaagttagacagtgattagcactaaggagaacatttgtggaagggctggggaaggttgggagttgtagaggtcagggatggtctcattctggtgagcagagacctgaaagaggtgagggaggagccatatatttgagggaagagagaatagccagcaaaaagggcctggggtgggagtatgtcaggggtgtttaagaaatagtaaggagggggccgggcgcggtggctcacgcctgtaatcccagcactttgggaggccgaggctggcggatcacgaggtcaggagatcgagaccatcctggctaacacggtgaaaccccatctctacaaaaaatacaaaaaaatcagctgggcatggtggcaggcgcctgtagtcccagctactcgggagcctgaggcaggagaatggcttgaaccccaggaggcagagcttgcagtgagccgagatcacaccactgcactccagcctgggcgacagagccagactccatctcaaaaaaaaaaaaaggaaaaaaaaaagagagagaaacagtaaggaggtccttaataactctgcagcagagttattaaggacacaaatgccataggctgtgcgcgatggctcacgtctgcaatcccagcactttggggaagctgaggcaggaggattgcttgaggttaggagctcaagaccagcctggccaacatgagcgaaatcccatctctactaaaaatacaaaaactagccgggggtggtgacacacgcctgtaatcccagctactcgggtggctgaggcaagagaatcgcttgaacccaggaggtggaggttgcagtgagctatcgtgccaatgcactccagcctgggcaacagagcaagactccctctcaaaaaaaaaaaaggacacaagtatcaagaggtaaggtcagaaaggtcacagttctgaacagaggaaaatgacttgttttaaagaggttacaagatctttctgcagagggagaagcagggagaatagctcttctccgaccacacactagggtctccacgggcttggctttgggcagctgctaggagcaaagtctggtctgaaatgatgacacacgctctgccctccgagagcctcccagtctagggggtttgaaggaaactccaaagggtcagtcggggatgcagaagaggtgaggaagtctaagctgcgctctctttgcctctcccaccagccctgccctggctcaacgtgtcagcagatggtgacaacgtgcatctggttctgaatgtctctgaggagcagcacttcggcctctccctgtactggaatcaggtccagggccccccaaaaccccggtggcacaaaaacctggtgaggcctcccccttcccaagtccattcccactgtaggccgatgcctgtgcaaaggacgcagtgccatatcagagaggatccttgaagaggactcaccccaagcaagggaaaattggtgggggaacttctgccttcctggtttccttgactttggcctcctcctcttcctccttatcttctccaacctccttcctttatttgttccacagactggaccgcagatcattaccttgaaccacacagacctggttccctgcctctgtattcaggtaggagcagagtctagctgggtgccagaagaggagtgggaagatgatgatgggggtgatccctgccttcctggtctcaccattcttcaaacccttcattgaggtggagactgtggctccctggggtggctggccctcccttgacccttgctgtcctatgccttctgtctattacattccctgaatgctctccctgatcctccacagaactcctgcttattcttcatggccccattcaaatgtcaccttctccttgaaacctttccctactcctccagttctgtctttgtgttcccctggcgggcagagcatgtgctacgaacttggactggtttgaatcttggctcttgccatttgctagctgtgtaaccttgggcaagtcacttcacctctgtgagcctgtttctcatctgtaaaatgggaataataatagtaacagcctcatggggctgttataagaatgtgtgccacacccaggcttaaatatgctggctctttcctcttcctctgtacatttatttatttttttagacaaggtctcactctgttgcccaggctggagtgcagtggcacaatcatggcacactgcagcctcagccccatgggctcaagtgatcctgctgtctcagcctcccaagtagctggaactactggtgagcactaccatactcagctagtttttttttgttttgtgtagagacggggtcttgctatgttacccaggctgttctgaattcctgggcttatgctatcctcccacctcagcctcccaccaagtgctgggattataagcatgagccactgtggcttgccctgattgcactttttttttttttttttttaagacagagtctttctctgtcgcccaggctggagcaccgtggcgtgatctcggctcactgcaagctgcttctcctgggttcacgccattctcctgcctcagcctcgctgagtagctgggactacaggtgcctgcaaccacgcccagctaattttttgtattttcagtaaagacagggtttcaccgtgttagccaggatggtctcgatctcctgaccttatgatccacaagcctcgtcctcccaaagtgctgggattacaggcatgacccactgtgcccagccgctgattgcacatttaattggtcatcaggtctcatccatcttacctctgacattaatgtctctcattttctttccccctcctctccatctcagtccagcttagggctctatcatctgttttctagactgtttcaacacctccaagctcccctcccttcccatcactttcctggcattctgggcccatattctgcccccaacggtgccttttcactctattttccccatgattccccttcatgagaacattgttacatccagtggagctacttaccaagatacagctagctccctgccttttctcaggtggttcccattacctcaaatgccctcacctccttcccaaagcttttccccaaccacccggcctctcctagctccaaatccccttgcacttctatctttccttgtccatttatcacttcatttcttttattttcttaaattttttttttttttttagagacagcattttgctctgtcacccatggtagagtgcagtggcatgaacacgtctcattgcagccccaagctcccaggttcaagggatcctcctgcctcagcctctgcagctgggactgcaggcatgcgccaccatgcctggctaattgtttccttttttttttttttttttttttaatggagtttcactcttttgcccaggatggagtgcagtggcgtgatctcggctcactgcaacttccgcctcccaggttcaagccattctcctgcctcagcctcccaagtagctgagattacaggcacacaccaccatgcccagctaatttttgtatttttagtagagacagggtttcaccatgttggtcaggctggtcccaaattcctgacctcgtgatccacccgcctcggccgcccaaagtgctgggattacaggcgtgagccactgtgcccagcctgttttcattttttaatgttttgtggcgatgggccaccacacccagctcaatcacttactttcttatttgggcatctaatttcttcttgtacacaacagatgctcaataaatattatgaaatgaatgagtgttttactaatttatataaatattttatccttactacaagtgtgagtttgtgatttccttgaaggcaagcaaatcatatctaattcaaatgtaatagctttgcaagagccttgcacatagcgcctacttgttttttgtttttttgtgtttttgttttttttttgtttttttgtcttttttgagacagagtctcgctctattggcaggctggagtacagtggcgtgatctcggctcactgcaatctctgcctcctggattcaagcaattcttctgcctcagcctcccaagtagctgggactacaagtgcatgccaccatgcccggctaatttttgtattttcagtagagacggggtttcagcatgttggccagatggtctcgatctcttgacctcgtgatccgcccaccttggcctcccaaagtgctgggattacaggggtgagccaccgcgcccagccttgttttgtttttaaacaaggtaacagtatgaggtcctcactgttgaatgagtgaataaatgttactgcctaacacagccataggacacagcagatgttcatgagatgtatgctgtgatttaaatggcttcattgccaaacacagtgcctgccacatagtcggtgttcctaactaaaggcttgatggataaattaatgtattacctctagtgcttagcatagagctatgcacataataggcactcttgaaatgtctgttgaaagaataaatgaatgtgtccttagaacttagcacattccccaacacatagcaggtgcttacacaagtgattgtggaatgaattaaaattaattatccaccaggcacagtggctcacacctgtaatcccagcactttgggaggccaaggtgggtggatcacgaggtcaggagtttgagaccagcctggcctaacatagtgaaacccagtctctactaaaagtacaaaaattagccaggcatggtgatgtgcgcctgtagtccctgctacttgggaagctgaggcaggagaatcacttgaacccaggaggcggaggttgtggtgagctgagatcacaccactgcactccagcctgggcaacagagtgagattccatctcaaaaaataaaaaaataataaaaatttaattatccaaggtctcttgtgcttgccatactgctaagacacaatggtaggcactcattaaaagtctgttgaatgggccaggcgcggtggctcacgcttgtaatcccaacactttgggaggctgagacgggtggatcacttgaggtcaggagttcgagaccagcctgatcaatgtggtgaaaccccatctctactaaaaatacaaaaattaaccagttagccggccgttgtggcatgttcctgtaatcgcagctcctcaggagactgagatgggagaatcgcttgaacctgggaggtggaggttgtagtgagccaagattgcaccactgcactccagcctgggcgacagagcgagactctatctcaaaaaaaaaaaaaagtttgttaatgaagatgttgccagtgcccagcattatgtttgctggaagaatagatgtgagcacctccaggttttgtaaaaggcaggaagacccagcaagtgtttgtgaaatacctgctgaatgagtgcatccccactgtccagcagagggccaggcacatgcccatggaggggacctgagcagacccccatttcctttccaggtgtggcctctggaacctgactccgttaggacgaacatctgccccttcagggagggtgagccgaccggcctggggctggggttggggtgttgcgagcgatgggtacctggcctgcggtgactgtgccctttccttgcagacccccgcgcacaccagaacctctggcaagccgcccgactgcaactgctgaccctgcagagctggctgctggacgcaccgtgctcgctgcccgcagaagcggcactgtgctggcgggctccgggtggggacccctgccagccactggtcccaccgctttcctgggagaacgtcactgtggacgtaagtgaagcagagggcacctcccgtggtgaggggagagtggggaaccgggggtccccttttgtgatcccacccattcctctctttccacagaaggttctcgagttcccattgctgaaaggccaccctaacctctgtgttcaggtcagaaaggggtgcatagtgctgggctggaggctggacctgggcagaccccccagccaagggggtcttagttcttgggccgctaaagcatagtggttgccagcttcctctatgggagttccactgcctactttagtagtgcgcgggaccctgggcaactcacttcacctctctgaacgtcagtttcctcatctgtttaatgcagatgataatacagtaactacctcatggagtggttgtgacaatgaaataagagaagtgcttccccttaggaatcggtacagactaaatgctccataaatgtagccacttttattattgctatccttattctatttccatacctgtagaatgggttgctctacagtttcaaagggtgattataagaacattcactcatccggccaggcgcggtggctcacgcctgtaatcccagcactttgggaggccgaggcgggcagatcacgaggtcaggacatcaagaccatcctggctaacatggtgaaaccccatctctactaaaaatacaaaaaattagccggtcgtggtggtgggcacctgtagtcccagctactaggaaggctggggcaggagaatggcgtgaacctgggaggctgagcttgcagtgagctgagagggcgccactgcactccagcctgggtgacagagtgagactgggcgacagagtgaaactccgtctcaaaaaaaaaaaaaattcactcattcaagattttttgagcagcacaagtcactgttttaggcacttgtgatagaccctaacatctctaccctcatagaacttatattgtaatggagaaaggcaggcaacagacattgtaaataaatcatatagtatcttaaaattgcatacaaataccatgggaaagggataaggtgggactggggttgcaatttttagcagggtggtcatgtgagaaaggaatctctttgagaaggttagatgagaggggaaccatgctccgtaagacataaaaacagctttagggtcagaagacgctttatacagatgatctcacaaggctggggcagagaaagatgtagtgattcctaatcacccagccttgaatccacatctgcctcaggtcagattgagtgcagattcccaacccaacaggccttctgttgcctgccccattctggtctttctgcctttggcttttgcttttcttagtggccctaaccatggtctcttcccagcaggtgaacagctcggagaagctgcagctgcaggagtgcttgtgggctggtgagttgggcctgggggcagctggggcagggccacctcctaggggtgaaggtcagggcatgggaggcaggcaagtggccaatcccagcaaggatgggtcttggtcagagtggcctctcaccccttccagactccctggggcctctcaaagacgatgtgctactgttggagacacgaggcccccaggacaacagatccctctgtgccttggaacccagtggctgtacttcactacccagcaaagcctccacggttaggactgggcgaccctcctccacagatctctccaaatgcatctcacatctggcctcaaattttcactccatccaccctgtgccggtctctgggaacatggggggtgactcagaccagggccatattcagcggcatcaccaaagtctcccagtcccctctacctcattctacccagctgtagcctggtaggtgctgccctaagggtgctacctccaggtaacagtgcccccatcctttggcttggcagagggcagctcgccttggagagtacttactacaagacctgcagtcaggccagtgtctgcaggtgagctggtggaagaagggccccacctcaatgcctaggggcaacaggcctaaaactagcactcacctactgtctatttaggcttattttatgttcagccctgggaaagttaagagtagaagaagcacagttcctatccccaaggagcacactgttggctagacacccataaacagataaccacacctacaggtgctaagttttgggttccagggagagcttccgggaagaatttcttcctataagccagatttggtatggaagaagtcataccctagtcagtgggcacagcacaaaggcagagcagctgcaggaaccttagccgggagatatgcatagttgatgctgggaatttggagatcaggccaccagagcttggtgaatattggaacacctggctggtgccctggatttggttctgtttgtatcttacagctatgggacgatgacttgggagcgctatgggcctgccccatggacaaatgtgagtattgtaagaactgcctttcctttctgtaccaggagtggggatcttgacagggaccactcttgggcacagcacatgcaatggccttgtccttccctgagatcagataaacagagggtcattccttcattcactcaaaaaatgatgagagcttgcagggatcgcaggaacaccaaaaatataaatccttgcccccgccccacccctagaagactagcaagacatgagccagtcacttacatttaaagtgggagctactgaagcaccaccaagtgttcagtgctgtaaatgcatacaatgtggacctgacctgggtggggtgaggggtgaggggctcagggggaaggttccagcaaaactctgaagactgagctaggggaagggggtagagatacagggtcttggacaggcaggtttctgtcatgagataaagatgcaggagacatgtaggggatttggatcttatgttgagagcagcaggagctacgatcaaatttttatatatttcacacacacacacacacatatatatatatatatatatatatatatatatacttatttttttatttatttttgaggcagagtctcactctgttgcccaggctggagtgcaatggcgcgatctcggctaactgcaacctctgcctcccgggttcaagcaattctctacctcagcctcccgggtagctgggattaataggcgcctgccaccatgccctgctaatttttgtatttttagtagagatggggtttcaccatcttggccaggctggtcttgaactcctgacctcgtgatccgcccgcgtcggcctcccaaagtgctgggattatagtcgtgagtcaccgcacctggcccaaatttatatttttaaaagatctctgaggctgtcatgaatcaattcaaggcaaatcaattggaggtaaaaaaaaaaaaaaaaagacagggcagggacaccaggtagttgcagacacccaggacagcaagatcaagggcccagcaaccctagcttaggggagaaaaacagctgacattttagcacttaagatgctcggcattgtgttaagtatgtattaacacattgtgttaagctttatatgtattaatatatttagtcctcacaccaaccctatgacacaggtacaactttacagaggagaaaactgaggcagagggtgacattacttattcaaagacccctaaacagatggagctatattcatccactggctctgacactgtgctgtggactctgggcaaatcatttcttcgttttttgttttgttttgttttgttttgagaggagtctcaccctgtcgcccaggctggagtgcaatggcgcgatctcggctcactgcaacctctgcctcccgagttcaagcgattctcttgcctcagcctcccgagtagctgggattacaggcgtgtgccaccacgcccggctaattttttgtatttttagtagagacggggtttcaccgtgttagccaggatggtcttgatgtcctgacctcgtgatctgcccgcctcggcctcccgaagtgctgggattatataaaggcatgagccaccgcacccggcccaattcatttctgttaagtctcagtttttcttctctgtggagggtaagtttctaactcttcttctctgggtctcccagacatccacaagcgctgggccctcgtgtggctggcctgcctactctttgccgctgcgctttccctcatcctccttctcaaaaaggatcacgcgaaaggtgagcgcttcccggctccccattcccctgggggaggaccagagtggctgtgggagttctccgagggaaagcggcggccgagctcactggctgcctccgcccctctcccctaacagggtggctgaggctcttgaaacaggacgtccgctcggggggtgagtgggagcaagcgctgggcggagggccgcccccggggagccaggcctgtgccagctcacctcttccctccccatctgttttctccggcagcggccgccaggggccgcgcggctctgctcctctactcagccgatgactcgggtttcgagcgcctggtgggcgccctggcgtcggccctgtgccagctgccgctgcgcgtggccgtagacctgtggagccgtcgtgaactgagcgcgcaggggcccgtggcttggtttcacgcgcagcggcgccagaccctgcaggagggcggcgtggtggtcttgctcttctctcccggtgcggtggcgctgtgcagcgagtggctacaggatggggtgtccgggcccggggcgcacggcccgcacgacgccttccgcgcctcgctcagctgcgtgctgcccgacttcttgcagggccgggcgcccggcagctacgtgggggcctgcttcgacaggctgctccacccggacgccgtacccgcccttttccgcaccgtgcccgtcttcacactgccctcccaactgccagacttcctgggggccctgcagcagcctcgcgccccgcgttccgggcggctccaagagagagcggagcaagtgtcccgggcccttcagccagccctggatagctacttccatcccccggggactcccgcgccgggacgcggggtgggaccaggcgcgggacctggggcgggggacgggacttaaataaaggcagacgctgtttttctaccca

SEQ ID NO: 2526 - DNA, 16548 bp, Homo sapiens; identical to SEQ ID NO: 2520
  source 1..16548: mol_type = genomic DNA

SEQ ID NO: 2527 - DNA, 16124 bp, Homo sapiens
  source 1..16124: mol_type = genomic DNA
gggcagctccaccctgggagggactgtggcccaggtactgcccgggtgctactttatgggcagcagctcagttgagttagagtctggaagacctcagaagacctcctgtcctatgaggccctccccatggctttaggtaagctccttccactctcattttttcacctgagaaatgagagaggaaaatgtctacaattggtgtttatcaaatgctttcaggctctggtgagcaagcgtccaggaaaatgtcaagcgcatggagctccaggcctgtctgggggatctgggcacggggaggcatccatgggagaccatgcaggcactctgaggcaggggctgcaagcctagtgcctgctggggcagcaggtgaacagagaggtgtaactgctgtgacagaagtcatggagtccttggagtgtgagggtcattttccactgttgatagaatagggaaattggtgaaatagccctgttaaatgagagaaagaacagtgtgagctcaatgagaaatactaatagaatgtggcactgagccacaaggtctgagggttgattgataaggaagggtggggactgtggagaattaagggcttggcacagtcagttccaccagttgtcacaagagaatgcaggctcaggtggccagaacttctcgcttttccagaagagtccgatattctgatttcattatatatagtattctgattaaaccagacaataaagcaagcagataaaatatttaaattataagctgccagtttgcaacctccggttaggatttgtgtggggcaaagaaaaaaactctcaggatcattggtatgtagactctaattttaagtttctaatttaaaattggcccctgaggctgggcgtggtggctcacacctgtaatcccagcattttgggaggccaaggtgggtggatctcttgaggtcaagagttcaaggcctgcctggccaacatggtgaaaccctgtctctattaaaaatacaaaaattagctgggcatggtggtgcatgtctgcaatcttagctacttgggtagctaaggcaggagaattgctggaacccgggaggtagaggttgcagtgaatggagatcacaccactgcactccagtctgggcaatagagagagacgctctctctaaaaaaaaatatgtaaagataaataaaatgaaataaaataggcctctaatgagcaggccattctcctttctgggtcttactttccttgcactcctttctgggtgttaagaggaggtctagaggaagctggacaactcttagcttgtagtaagcacagtggaagtgtcagctcttaatgggtcatggacacgttacaagctaggcgccttgctgagcactttacatggtttatcccactgaaccctctcaataaccctatgaggaagggctattattgctcacattttcagaagaggaaatggatatagagagattagataatttgcccatggccagacagctagtataagaggaggaggtggattgactgcagacattctgtcttcaaaccactacactatgctatgggggcacagagacttaatgaaatcatggagaggggaattgctttgtcaaccacaagcagttattccgggggcagcagatcctcccctgtcccccagtgggtacaatggtccctggtgggttgtgctacaatgttagcccatggtcttatgtgtttttcaaatgtgtaaagtaggatgctggaaccactcttagaaccagataccaatacattgtgaagaaataaatctctgtgcttaaaactggttcatcccaaaatattttgaactgacacacaataggtgctaaataaatgtgtgttaacttgaattggattgaattcgggaaaaaagtgcaataagcttagtgaagacaccatgttccctgggtagaggaaccacattctccatctaaggccaggagtatgggaggtatcaatgtttgcccagcacagaacagggtgccaagaagagaaaagttgacggggtgcatactcggactggaaactggaagggtgagaacagagggtaaaggatagagatggaaccatgtgcatacactttgtgttaccttggacaagtcattcatttctctggacctctgctttctctctacacaatggggtcccaccacttcccttacagctgacttgtatgaagaaggaggtggaggaggaggagaaggtgaagacaatgctgactcaaagggtaaattatttttaggatccaagtttgaaaacaattttaggctactagatatgaacaacatcttgattatgtagttgaaggaaattaaagatgaatggtttaattaaaaattaatcagaatgaaaacgattgattactaatatatctgcaatggtttattttcctgagtggcagactcactaaggtttttgaatactcctgtgtgattgctctatgtatgtatgtatgtatgtatgtatgcatgtatctatctatctgttgtctaataaaatggatcacatctctgctaataaaaacactacactggcagggtacaattataatcattaactgtgcctggaatttgcagcagcagccaccagaggtaccagtgccctttaagggttcataatttagaataatccaattatctgagtttttcagggactgaggggtttggcaaggtgtagaactttcagtaataaagtcaagaaagtcctggacaaaccaaggtagttggtcactctagtccataaccaggtaaagagctttccctgtaacctgtgtaaggttttagaatcatttctttccttattaccaaaaatcctccccaaattttcaagaaattatgaactaaatagttactctatgagataggagttcagcccaaaagaaacaccataagaacaaatataattcttgcttatgttaaccatgcaatgaagcagagagaaaaagtcagtggcctctttaggaggactgtagtgtgggaagaaataactaaactgggtttcaatcctggcctggccaggatctggagcaagtgagttaatctttctaagccttgagtagtttcttcttcttcttcttcttcttcctcccccttctcctcttcttcttcctcctccttctcctcttcttcttcttcttcttcttcctcttcttcttcttcctcctcctcctcctcctcttcttcttcttcttcttcctcttcctcttcctcttcttcctcttcctcttattcttcttcatcgtcttcgtcttcgtcttctttttattttcaaagtgaaagcaagtttattaagaaagtaaaggaataaaagaatggccactccatagacagagtagcctgaaccttgagttcttctataaagtcactatgaatttatactcattttgaaagtgggtgtcaatatgtctgtccactttgcacagctgttatgtggacaaaaggagatctgtgtgaaagtgtaacacagagcctaaactataacaggtaagcaacacagttgtccccttccccatggtgtctgttcttctccatttcctcctgtctgcagggggattataaaactaatcatcaaagccaagaaggcaagagcaagcatgtaccgctgaaaacacaagataactgcataagtaatgactttcagtgcagattcatagctaacccataaactgctggggcaaaaatcatcttggaaggctctgaacctcagaaaggattcacagtaagttaaccatgtagatctgagaggagagtagcttcttgtagataacagttggattatataccatgtcctgatccccttcatcatccaggagagcagaggtggtcaccctgatagcagcaagcctgggggctgcagcttggtgggtagaggtactcaggggtacagatgtctccaaacctgtcctgctgccttagggagcttctaataagttgatggatttggttaaaattaacttggctacttggcaggactgggtcagtgaggaccaacaaaaagaagacatcagattataccctgggggtttgtatttcttgtgtttctttctcttctttgtactaaaatatttacccatgactgggaaagagcaactggagtctttgtagcattatcttagcaaaaatttacaaagtttggaaaacaatattgcccatattgtgtggtgtgtcctgtgacactcaggattcaagtgttggccgaagccactaaatgtgagatgaagccattacaaggcagtgtgcacatctgtccacccaagctggatgccaacatttcacaaatagtgcttgcgtgacacaaatgcagttccaggaggcccaaatgaaaatgtttgtactgaaatttgttaaagcttcccgacaaactagatttatcagtaaggattgttttctgcaagggggatgaaacttgtggggtgagccatttgggctgaggaggagggaggttggagctgagaaatgtggagacaatttccctttagaaggactgaatctccctgcctctctggggtgcggcagccagcaggatccaatggtgtatatgtctccccagctccccattcagtgatatcatgtcagtagcttgaaattatccgtggtgggagtattatgtcatggaaattggcaaatggaaacttttattggagattcaattgttaaacttttaccagcacaacactgccctgccttcagagtcaatgaccctatccaagtttaatccatctgtccactgtctccaacacgatctttataaaacacacctgacaacattacccttttattcagttttttaaaagataagtttccagctcatcgggctggctttaaaggccatttctcctctggacctcacccaacttttcaaatcacttttcctacccctacctctaaatgctactcaaactccagccatcctgaataataagacttttgaaaagtagattatgggctgggcacagtggctcacacctgtaatcccagcactttgggaggccaagatgggtggatcacctgaggtcgggagttcgagaccagcctgactaacatagtgaaaccctgtctctactaaaaatacaaaattagttgggggtggtggcacaagcctgtaatcccagctactcaggaggttgaggcaggggaattgcttgaacctgggaggcggaggttgcggtgagcctagattgctccactgcactccagcctgggcaacaagagcgaaactccatctcaaaaaaataaataaataaataaagtagattacatcagatacctctggcctaggttgtttatgaccaactctcctgctgagaataactagaaaagctagacaaaacatatttccaaaagatctctttggaggcatcagagaatggccaaggctgtaaggaactgcctgagcccagagaggtggagcccagcactggtgccctttactcctggggacatgtgctggtttcaaaaacttcagctgagtttttgagcattcatggaacttggtgggggagatgaaatttgtaccttaaatcctgcctacagggagggtccctgataatccccacccaatttggaaatctgggtcagccttcacaggtactgaagccctcctctgaatgatctcaagtcctgctagggtagaggttacctgcttttgaaaggctcctggcctacctgtgcagcaggagcaaaagtgaaccatctcagggtacagataacaatcatccagagccttgaatgacctctactgtgcttaatatatagtattcagcagtcagtaaaaaggatttaggcacatgcaagatgacctgtgtatcagggagaaataggcaataaattgagatccagcagggatttgaatcatggatttgaatcaggggcagccttcgaaagaactgtggagaatatactcagatttaaaacataagattggaatttttggcagagaactaacaactgtacaaaaaaggaaccaaatggaaatcctagaactgaaagatgcaattaaccgatgttgagaaatagccaacatctattgaacacttcccatgtggacagctgtgctaaacactttacaggcatcaacataagatgtgtccccttacagcagtgcagtgtccctcctaagacatggacagcctggtttccctatctctctgcttcatcaaaacccctttacgtggggcttagacactcctgttgtctctagtgtctagtagcacagggctcagcacatggaagccactagatacaatttgatgaccaggacctccgatgaaagccatgggtgctgattgggaaggcattgtcttttatgtgctatggtcttaaagcttcatccaggaagcagaactcggggggtgctgaggacccagaaccgagaataagattagtcagagatttcctgtgggcagaaatcataaggacgccaactgtttgggtgagataagacgaaaccaagagtggacttgtggccagaagcgtgaggaagagggagagagcttcccttgtcccctttcttcctctccctaagccacagtgattgacagccccccccctttggagtcagagcaggcttgagactggactgggaaaggagggtgggtcaggatacagagcaggaaggctgggagtgcagggcaggagcaaggggctggggcattcattgtgcctgatctctcccactttacctggggtaaagaagcatatgcaaaagccacggtgtgagtatttcccaagtgccagggtcagggcatgattcatcacgtgcagcatttcattcaatccttatagtaaccgatgatgtggcttctattattagctctatcagataatgaaactgagaccaagacaggctctgcacattgtgtggggtaatgacacagggggattcagacctagactccataactcctgccccagggaccacccccaccctcaccctgtgcatgtcgacaaaggacagactgggccacttctcaggacacagcggggaaatgacacagagcagggaggttccaggagccccgagcgtcttttctccaggagaatactctctgaattcagactggggtcagagaaacatttacccaggagccgcagtgtgggtggggctttttacttgaaacgctgtctgaaggcagtggccaggatggaactctccaccctaccttggcaagccacttctcttctgcaatctgtaaggacattgttgagagaattatggtcttccaattccggagggttgaagaaagacaaataggagagaacctatcatagtcaggtgctagctgccttctctttcagagagtgtgagaataaagtgatacacttgattattagcaaatactttggaaattttaaacgctaatattcaacacactctggaagaggcaaataagtagacaggttcatatacatcatctccttcagctagtcctcacaaaaacaaacaaatgaataaacaaaattcttctttggccctcataggaagacactgtttcttgaacgtgtttcaaaaaggatgggtgactcactcaaggtcacactgtttatgaggacagtacaggaatacagacatgccattttgcctgaaaaaatccatcacccagggaggtgacacaattttgcagaaatgttctatttcctctgaaggatacattctttaaacctttgggaaattcattcatagtcttcctcctttgaaggattaactctctggacacaaagtgtttgattctgatttgttggttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttgaaacacgtttgagaaatagtgtcttcctttgagggccaaggagacattttttttgtttatttgtttgtttttgtgaggactagctgaagggggtgatgtatattaacctgcctacttatttgcctcttcccagagtgtgatgaatattagggtttaaagtttctgaagcatttgttaataaagcccggggctggaggtcagaagacctggatttctctgcatacttttgccatcagcaagctgtgtgaccttggacagatcccttttttgtctaaatctttctgagtcttcttgaaaacaatgccaggttgggacaggatgattgccaagctcccgtccagctctaaaacactgcaacgtatgcttctgcaccagcactgtccatcctgtagatcatgcagaaattctcttcaactttttcctacccataaaataggagcatgcttacctttttcctaatgttccaggccccgggtctagaatattgtaagtaaggaagttaatgtgtatcagagcccattatgggccagaagttctcctcttccttcctacacctgcttcctccctccctccctccctctttcccttccttccttccatccatttgtgaagaagacatgatcaccctcattctgagagtgaagagacagaggctcaactaatgaaatgatttgttcaaggtcacacgggtggcacaaggcaagtggcagaggttgaatttagacccattcctgtccaaatgctgagtttatgtcatcgtcccgagaccataactttaaagatgtaagatagtgggaaaagagttgatttcaaagcacctctcagaaggactcactttacatcaggggtcagcagactcaggccaaatccggtccattccccgcttttgcaaagaaagttgtagtggaacacagctaggcttattgatttatggattgccaacgtccttttgtgaaacagacagctgagctgagtaatcgtggcgcacaaaacctaaaatatttactatctcgtcctttacagaatgtttgccaatctatggtccggagtccaaggctgtccatttttcaaagaacacaaagtgacatgagactgtcccatgtgcagggagccctatcattttattatgaaaaaacggcctttctgctcaaatctgttttttaaaaagtcaacaaacagactctgggtacctgtcaggaacagtagggagtttggtttccattgtgctcttcttcccaggaactcaatgaaggggaaatagaaatcttaattttggggaaattgcacaggggaaaaaggggagggaatcagttacaacactccattgcgacacttagtggggttgaaagtgacaacagcaagggtttctctttttggaaatgcgaggagggtatttccgcttctcgcagtggggcagggtggcagacgcctagcttgggtgagtgactatttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcaggtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacatgtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggatctcaaatcaccccaaaacccagtggcttgaaacaaccaaaattttttcttatgattctgtgggttgaccaggattagctgggtagttctgttccatgtggtggaacatgctggggtcactttggaagctgcattcagcagagtgcctggcttgcgctgggcatccaaggtggtccctcatcctccaggctctctttccatgtgatctctcagtgtttaagagttagttggagcttccttacagcatggcggctgacttccaaaagggattattccaaaaagagcctcaacatgcaggcgcttattatgacttctgcttgcatcatcctattggccaaagccagtcacgtggctaagtctagccccctgtgagaggagactgcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaagcttaacctcaatgtgagtggccatactgtggcactgtcccatccctcaccagggacactgttctggagggtgactgcctgttctgtgaggagtggggatggctaggacattgcatggaacacaccaccaccccatcttctcagagctcaaaccctgacagaacaccagctccacaggccttggcttctgctgatggtgccgtgtatttaccagacttagtggtccaaggccagagtggccagatttcccaaagtcaaggtgtgacagtgggacagcctctttgtgtctttgctgtcctaagaaacctgggccaggccaggcgcagtggctcacgcctgtaatcccagcactttgagaagccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggcgacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 2528 - DNA, 16124 bp, Homo sapiens; identical to SEQ ID NO: 2527
  source 1..16124: mol_type = genomic DNA

SEQ ID NO: 2529 - DNA, 6456 bp, Homo sapiens
  source 1..6456: mol_type = genomic DNA
atttctttataaaccacaactctgggcccgcaatggcagtccactgccttgctgcagtcacagaatggaaatctgcagaggcctccgcagtcacctaatcactctcctcctcttcctgttccattcagagacgatctgccgaccctctgggagaaaatccagcaagatgcaagccttcaggtaaggctaccccaaggaggagaaggtgagggtggatcagctggagactggaaacatatcacagctgccaggggctgccaggccccagagggcctgagaactgggtttgggctggagaggatgtccattattcaagaaagaggctgttacatgcatgggcttcaggacttgtgtttcaaaatatcccagatgtggatagtgcgaccggagggctgtcttactttcccagagactcaggaacccagtgagtaatagatgcatgccaaggagtgggactgcgattcaggcctagttgaatgtgctgacagagaagcagagaggggcaccaggggcacagcccgaaggcccagactgatatgggcaaggcctgtctgtgctgacatgtcggagggtcccactctccagggaccttggtttccccgtctgtgacatctgtgacatgagagtcacgataactccttgtgtgccttacagggttgttgtgaaaattaaatgcacagataatagcgtaacagtattccgtgcattgtaaagagcctgaaaaccattatgatttgaaaatggaatcggctttgtgagaccatcactattgtaaagatgtgatgctgatagaaatgacaggactgcttgtgcatgccctctgcagtgtgacattccagcagtgaaatcatgttggggtgacttctcccccactctgacctttatgtttgtctgggccgaggctgcaagtcgggctctgtgggtgtatgagtgacaagtctctcccttccagatatggggactgtctgcttccctaggttgcctctccctgctctgatcagctagaagctccaggagatcctcctggaggccccagcaggtgatgtttatccctccagactgaggctaaatctagaaactaggataatcacaaacaggccaatgctgccatatgcaaagcactttggtttgcctggccacccctcgtcgagcatgtgggctcttcagagccacctgatgaggtgggtacagttagccacacttcacaggtgaagaggtgaggcacaggtcccaggtcaggctggccagagctctgtttattacgtctcacagctttgagtcctgctctcaaccagagaggccctttaccaagaagaaaggattgggacccagaatcaggtcactggctgaggtagagaggaagccgggttgttcccaagggtagctgctcctgcaggactctgagcaggtcaccagctaatggaggaaaggctctagggaaagacccttctggtctcagactcagagcgagttagctgcaaggtgttccgtctcttgaaacttctacctaggtgctatggtagccactagtctcaggtggctatttaaatttatacttaaatgaatgaaaatagaagaaaatttaaaatccagacccttggtcacactatccacatttaaagaggtcaatagccacatgtggttagtggccaccctattgggcagtgcagctacagaacatttttgcatcccagaaagttcttttggatgttgctgctctacagcatgctttgctgaaacagaagtgccttccctgggaatctcagatgggaagcaagtaaggaggggagtcaaatgtgggctcactgctcaccagctgtgagggttgggcctgcctcttaaccattgtcagcctcagtcttctcatccatgcatgccgtgggtatactaaaatactatacccctggaagagctggatgcaaatttgacaagttctgggggacacaggaaggtgccaagcacaaggctgggcacatggtggctgtgcactacagctgagtccttttccttttcagaatctgggatgttaaccagaagaccttctatctgaggaacaaccaactagttgctggatacttgcaaggaccaaatgtcaatttagaaggtgagtggttgccaggaaagccaatgtatgtgggcatcacgtcactttgcccgtctgtctgcagcagcatggcctgcctgcacaaaccctaggtgcaatgtcctaatccttgttgggtctttgtattcaagtttgaagctgggagggcctggctactgaagggcacatatgagggcagcctgaagagggtgtggagaggtagagtctaggtcagaggtcagtgcctataggcacagtggtcccagggccacagctgggaagggcaaataccagaaggcaaggttgaccattcccttcctcaagtgcctattaaggctccatgttcctatgttgttcaaaccctaactcaatcccaaattaatccaccatgtataaggttgagctatgtctcttattcctggacaccatactcagccatattctggtccacacattaaacaagctggatgaccttgaagaagcttcacccactctgttcctcagctttcccttcagtgggatgatatcaactggacaacaggatgtgcgattcttttagttccagccttccaggatgttttcactcccctgtttgttgttgtaggatggtattacctccaccttcccaccttccctatgccctggttctgtctcctgtgcctcgctctgaaagtggatgagacctacaattcctgtcctggtagttctcctaatgaacacactgaagcacgaggaagctgagatttttgttgctacatgagagcatggaggcctcttagggagagaggaggttcagagactcctaggctcctgtggagccccactcatggccttgttcattttccctgcccctcagcaacactcctattgacctggagcacaggtatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcatcctggggaaagtgagggaaatatggacatcacatggaacaacatccaggagactcaggcctctaggagtaactgggtagtgtgcttggtttaatcttctatttacctgcagaccaggaagatgagacctctctgcccttctgacctcgggattttagttttgtggggaccaggggagatagaaaaatacccggggtctcttcattattgctgcttcctcttctattaacctgaccctcccctctgttcttccccagaaaagatagatgtggtacccattgagcctcatgctctgttcttgggaatccatggagggaagatgtgcctgtcctgtgtcaagtctggtgatgagaccagactccagctggaggtaaaaacatgctttggatctcaaatcaccccaaaacccagtggcttgaaacaaccaaaattttttcttatgattctgtgggttgaccaggattagctgggtagttctgttccatgtggtggaacatgctggggtcactttggaagctgcattcagcagagtgcctggcttgcgctgggcatccaaggtggtccctcatcctccaggctctctttccatgtgatctctcagtgtttaagagttagttggagcttccttacagcatggcggctgacttccaaaagggattattccaaaaagagcctcaacatgcaggcgcttattatgacttctgcttgcatcatcctattggccaaagccagtcacgtggctaagtctagccccctgtgagaggagactgcataagagtgtgaacaccaggagacacggtcactgggggccaccactgtaaccatctaccacaggacctgaatctctgtgtgctactcccttgctcaagggcccccctacccacgcagacctgctgtcttctagcaaagcccatcctcaggacctttctcttccaatccttattgactcaaattgattagttggtgctccacccagagccctgtgctcctttatctcatgtaatgttaatgggtttcccagccctgggaaaacatggctttgtctcaggggcttgctggatgcaagcttaacctcaatgtgagtggccatactgtggcactgtcccatccctcaccagggacactgttctggagggtgactgcctgttctgtgaggagtggggatggctaggacattgcatggaacacaccaccaccccatcttctcagagctcaaaccctgacagaacaccagctccacaggccttggcttctgctgatggtgccgtgtatttaccagacttagtggtccaaggccagagtggccagatttcccaaagtcaaggtgtgacagtgggacagcctctttgtgtctttgctgtcctaagaaacctgggccaggccaggcgcagtggctcacgcctgtaatcccagcactttgagaagccaaggtgggcagatcacgaggtcaggagtttgagaccagcctggccaacatggtgaaaccctgtctctattaaaaatagaaaacattagacaggtgtggtggtgcatgcctgtaatcccagctactcaggaggctgaggcaggagaatcgcttgaacccaggaggtggaggttgcagtgagccgagattgtgccactgcactccagcctaggcgacagagcaagactccgtctcgggaaaattaattaataaataaataaacctaggtcccagagtcccacagaatggcagacaggagcacctgggggcttttagggtatggcatttcccctgtactaactctgggctgtccagagggccatttcatggcgtggagtggagagggaggcagcacaggacttcctaggcctcagctctcacctgcccatcttttgatttccaggcagttaacatcactgacctgagcgagaacagaaagcaggacaagcgcttcgccttcatccgctcagacagtggccccaccaccagttttgagtctgccgcctgccccggttggttcctctgcacagcgatggaagctgaccagcccgtcagcctcaccaatatgcctgacgaaggcgtcatggtcaccaaattctacttccaggaggacgagtagtactgcccaggcctgcctgttcccattcttgcatggcaaggactgcagggactgccagtccccctgccccagggctcccggctatgggggcactgaggaccagccattgaggggtggaccctcagaaggcgtcacaacaacctggtcacaggactctgcctcctcttcaactgaccagcctccatgctgcctccagaatggtctttctaatgtgtgaatcagagcacagcagcccctgcacaaagcccttccatgtcgcctctgcattcaggatcaaaccccgaccacctgcccaacctgctctcctcttgccactgcctcttcctccctcattccaccttcccatgccctggatccatcaggccacttgatgacccccaaccaagtggctcccacaccctgttttacaaaaaagaaaagaccagtccatgagggaggtttttaagggtttgtggaaaatgaaaattaggatttcatgatttttttttttcagtccccgtgaaggagagcccttcatttggagattatgttctttcggggagaggctgaggacttaaaatattcctgcatttgtgaaatgatggtgaaagtaagtggtagcttttcccttctttttcttctttttttgtgatgtcccaacttgtaaaaattaaaagttatggtactatgttagccccataattttttttttccttttaaaacacttccataatctggactcctctgtccaggcactgctgcccagcctccaagctccatctccactccagattttttacagctgcctgcagtactttacctcctatcagaagtttctcagctcccaaggctctgagcaaatgtggctcctgggggttctttcttcctctgctgaaggaataaattgctccttgacattgtagagcttctggcacttggagacttgtatgaaagatggctgtgcctctgcctgtctcccccaccgggctgggagctctgcagagcaggaaacatgactcgtatatgtctcaggtccctgcagggccaagcacctagcctcgctcttggcaggtactcagcgaatgaatgctgtatatgttgggtgcaaagttccctacttcctgtgacttcagctctgttttacaataaaatcttgaaaatgccta

SEQ ID NO: 2530 - DNA, 16124 bp, Homo sapiens; identical to SEQ ID NO: 2527
  source 1..16124: mol_type = genomic DNA

SEQ ID NO: 2531 - DNA, 2550 bp, Homo sapiens
  source 1..2550: mol_type = genomic DNA
cagagccccacgaaggaccagaacaagacagagtgcctcctgccgatccaaacatgagccgcctgcccgtcctgctcctgctccaactcctggtccgccccggactccaagctcccatgacccagacaacgcccttgaagacaagctgggttaactgctctaacatgatcgatgaaattataacacacttaaagcagccacctttgcctttgctggtgagtagcttggataagactggcctgcagcagtgaggggtggtggctgcctaaggccaaaaggcctcatgggcctttctctcccttcacccccacaggacttcaacaacctcaatggggaagaccaagacattctgatggtaagagctcagcccgtggatcccgatccacttcctgcctgggtgacttcagccatgtcattccatcttacctagccttgctttcttcatctgtaaaatagggttaatagcacctatctcagtgggattgttatgacaatcaaatggcacaatgtgcatgttctggcccagcatctggcacttaagagttcaatacatggccacagccatggctataataatgaaaatgacttttaaattagaaaatgaaaaggcagttctaggtgaggaataccaagggccttaaggtcagtgtttggtagggcagactctggactgacagacagaaatttccccctcagatgtgccagcttctttttcccttaaaaaattgagtttgtgttttccaccctcattggctgtggcattatcatttacagttatttttcatggttccagttggttgcagttgttctgtctcacctttgcatgacatttcttgggtcaaacaagaagtggaagcctttgctgagttcctgggccatctgtgtttggggcactcacagctcacatgctgcacccatttccatgctggggtctctgtgattttcttcttgatttctaggagactttaattcagtcagggcatgaacactgttatcagcctctgagctacaaatacttcccttggaaaaccccctgtcttttgtagagcttctttttggagatattttttcccccaagtgcagaaagatccacctaggtaccccctccccacccatttttttttttttttttgagacaagagtctcactctgttgcccaggctggagtgcagtggcacgatctcagctcactgctacctctgcctcctgagttcaagcaattctcctgtctcagcctcccaagtagctaggattacaggcatgcaccaccactcccatttttgtatttttagtagagacggggtttcaccatattggtcaggctggtcttgaactcgacctcaggttatctgcctgcctcggcctcccaaagtgctgggattacaggcttgagccactgcgcccagcccacctaggccctttatgtagctcaaatggagccagagactgggggcttgaggaaaccaggtcctgcctgccactcacttctaggcctgtgcccttgggcagggacccacctgaggcaagaacgggactaggagggaacccgaggatgtccccaacagtgggcttgggaaactgtgggggtgacttccacctgcttgtgggagggatactctgtaacctttcccccttaagtgtattctctgccccgttaggaaaataaccttcgaaggccaaacctggaggcattcaacagggctgtcaagagtttacagaacgcatcagcaattgagagcattcttaaagtatgtgaagctgttgagggtttgggatccctgtgttggccctgccctgcctctggggaggagagcagggcccactccctttccaagggaatctctgaccatctgctttggtctctttccacagaatctcctgccatgtctgcccctggccacggccgcacccacggtaagctgtcccccaagatgcccgtcatggcttgctcctcagctggtcatcaccattacagcctggactcacctaatgccaccttcttggtttctttatagcgacatccaatccatatcaaggacggtgactggaatgaattccggaggaaactgacgttctatctgaaaacccttgagaatgcgcaggctcaacagacgactttgagcctcgcgatcttttgagtccaacgtccagctcgttctctgggccttctcaccacagagcctcgggacatcaaaaacagcagaacttctgaaacctctgggtcatctctcacacattccaggaccagaagcatttcaccttttcctgcggcatcagatgaattgttaattatctaatttctgaaatgtgcagctcccatttggccttgtgcggttgtgttctcatttttatcccattgagactatttatttatgtatgtatgtatttatttatttattgcctggagtgtgaactgtatttattttagcagaggagccatgtcctgctgcttctgcaaaaaactcagagtggggtggggagcatgttcatttgtacctcgagttttaaactggttcctagggatgtgtgagaataaactagactctgaac

SEQ ID NO: 2532 - DNA, 5636 bp, Homo sapiens
  source 1..5636: mol_type = genomic DNA
cgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcactgctcttagagttttcccagcctttttcaaataggggcaggactggggcaggccatctcacaaggggtccctgatgctgagggggataagtgaacctcccagtctagagctccagccaagtctatccaaggtgggaacgggggccaggatccctgctcagagctccgccattgtcccccatcacagtgaatggatgtaagctcacccactctgtgcccctgcctccctgctactctttggggataataataaaacaaaaaccattaccatcagtcagtctgtccacccactggcatgtaccaagccagacactctgccgtgttctgggctttacaacagaggatgagagtggtcctttctctcagtctaataaagcacttcccatgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactctgaggttttctgaagtaaggcaacttgttgaattgtatttagccatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcagagatggggcaagaacctagggctctgactcaccgtgcagcttctcttccagcaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattggggcagcacaaaccaggctctaagcaaaggcaaataaaatactacacctctcagcaaagtgaagacacaggctctggggccacctgaagcttctatgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacacgtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatgtgtgcatgcatgtatctgtgtgtaaccatgtatgtgtgagtgcaggtatgtaggtatgagcatgtgtgtgtatatgtatatgtgtgcatgcatgtatctgtgtatgtatgtatctgatgtatgtgggtggtgaggggatgtacagagaggaatgagaccctcttttgctctcagcaacatcacagggtgtagaaagttgtccaaacaattccaaaggggggcttatcaagacagggttcagaaaaaggcctgagacccaagggacattaaaggagggggttgaatctattttggggtgtagaggcttgaagatttgaccctgaactagagggtggagtggaggtggtacaatgtgcttccatgccttgatgtccactctgagccagtggacaggagaagccatgtcatgacagctgctgagaagcctcccttctgcccagcctgggggcaggccgtcttacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaa

SEQ ID NO: 2533 - DNA, 6106 bp, Homo sapiens
  source 1..6106: mol_type = genomic DNA
ggagagtcccacctctaacatctcctgtaggcctggcaatggcaggcaggaaagacagaggaaggaaggagggagaagggaaggagtgaaggaaggagtgaaaaaggtaaggaagaaagggaataggggaggaagggaggaaatgggaagggaaagaaggaaaggaaggaaagagggagggaagaaaggaagggaaaagggagggagtgagtgaatgaaagatggaaagaaggaagaaagggagggaggcagggaggaaagaaagtcgcgcttcccttgagctgccatgggcactgactcttagggtctgaaagcccctgagatgcaaaagcctagtgctcacaaagagctggaaagcctcaaggaagttcttcaatatttctggaaggaaactgtctccagaagcttccctccccacgacagataatgagcagcaagtgcttctggcgacttagggtgatgtgaaatcacgctgggaatcctgctcctcctcaggtcctggcagtttcagggcccctccctaggccttacttaaaaggctgaggcatccttggaggaacaggcagactccacagctcccgccaggagaaaggaacattctgaggtatgctctggggcgctggtggtaccggagctctctcctgaccccagacccagaatctgctccgtggaggctgttcacatgctggggagctcggtgcagctgcttgctccccagaccccagccaactcagcctctctctccatgattttctgttgtttattccaaaataggggagtctacaccctgtggagctcaagatggtcctgagtggggcgctgtgcttccggtgagtgtatgaggccctggtttggtggtgtcctccggaggaagtgagttctggatagacccgttgtccagctctgagcaggagggaggaagggaggggctgccattgcagctgggaaattgtgaccagcacctcactgctcttagagttttcccagcctttttcaaataggggcaggactggggcaggccatctcacaaggggtccctgatgctgagggggataagtgaacctcccagtctagagctccagccaagtctatccaaggtgggaacgggggccaggatccctgctcagagctccgccattgtcccccatcacagtgaatggatgtaagctcacccactctgtgcccctgcctccctgctactctttggggataataataaaacaaaaaccattaccatcagtcagtctgtccacccactggcatgtaccaagccagacactctgccgtgttctgggctttacaacagaggatgagagtggtcctttctctcagtctaataaagcacttcccatgatgtgttctatgggactcgattagaggagtcccacagaggcatccaggagatgctttacacagtggagctctctgatcaagtaaatgcagggaattctgctttctacatcctctcataagagaaccacagcccagctcagcatatgagtgactctgaggttttctgaagtaaggcaacttgttgaattgtatttagccatgcatcgacccaatttttacactgcatccttttcccccatataacttttggagaaacccactttaggatacatcttccacctcataggatgccaggaaatcaactgagttcaaagatgagaaacaactttgaaaagttaaataaaagaaatttaaatttaaagaaactcctcacttagtaaggaatatatgaccaaatagaaatacatgtatcttgaagaattgaagaatcaggctttaacgtggaagaggcctggatgttatccaacccatcatcttagtgtagcaatggggaggctcaggcccagagtgggcgagagagttgtctcctgcgactcagcagcattggaggcagagatggggcaagaacctagggctctgactcaccgtgcagcttctcttccagcaggagatgggttggggcagaaaaggttgaatagggtgaaggagcaaaccacagactccagtgggagactgtggggtcatcctccttgtagggcatgagcccagcagggctgggagacaaggctgtgctgttacttctggcacagtaggaagaaagagagacaaaatgcctgagatcagggggttctctggatccagggcatgctggagtgtccaccctcctcctaatgtagtcctcaccccttcctgatgtttcagaatgaaggactcggcattgaaggtgctttatctgcataataaccagcttctagctggagggctgcatgcagggaaggtcattaaaggttggtgatgaaacatgacccactttccttggtctctatacactctcaggggagggggcctgaagagggcttagaatagtcatacagattagcataggcctacagagcccaggcattggggcagcacaaaccaggctctaagcaaaggcaaataaaatactacacctctcagcaaagtgaagacacaggctctggggccacctgaagcttctatgcagaagtgggaatgttttccaagaggcttgtcttgtcattcccttacaggtagatttaggtcaagcattgcattccctgggagccagtaagtaccaaggagagaactaacgtagattctctataccttttttcccatatgggagtgggtttctgcctctccaccctgggtcccctctgctctctgaagatcctcagtcacttagagtggagggacccagagaacaggtggcattgttggacctcctgcttgctcactctgccccatgcactgcaacacgtccctctctaaaatagtttgcacctgcccacctggggcacccttgctgagcacagatgccaggtagatccttcagctaggccatatgtgtatgtgtgtgcttactggtgtatgtatgtgtgcatgcaggcatatatgtgtgagcatgtgtgcatgcatgtatctgtgtgtaaccatgtatgtgtgagtgcaggtatgtaggtatgagcatgtgtgtgtatatgtatatgtgtgcatgcatgtatctgtgtatgtatgtatctgatgtatgtgggtggtgaggggatgtacagagaggaatgagaccctcttttgctctcagcaacatcacagggtgtagaaagttgtccaaacaattccaaaggggggcttatcaagacagggttcagaaaaaggcctgagacccaagggacattaaaggagggggttgaatctattttggggtgtagaggcttgaagatttgaccctgaactagagggtggagtggaggtggtacaatgtgcttccatgccttgatgtccactctgagccagtggacaggagaagccatgtcatgacagctgctgagaagcctcccttctgcccagcctgggggcaggccgtcttacagcagtcctgtgccctagagcccaggacaggggaagaaggagggaaaggcatccagggccctgcatctggcctctttcccacaggtgaagagatcagcgtggtccccaatcggtggctggatgccagcctgtcccccgtcatcctgggtgtccagggtggaagccagtgcctgtcatgtggggtggggcaggagccgactctaacactagaggtgagacttggggcatcctcactggggactcagccacagatgctgagcctactgaagccgggcagcccacagccctggtgctgtgggacaccctagcaggattctgttgatggcagctttgcctcctccctaaggatcctgcccagccctccctctgcccctgcttctgccctcacctgacctcccctcctctgccggcagccagtgaacatcatggagctctatcttggtgccaaggaatccaagagcttcaccttctaccggcgggacatggggctcacctccagcttcgagtcggctgcctacccgggctggttcctgtgcacggtgcctgaagccgatcagcctgtcagactcacccagcttcccgagaatggtggctggaatgcccccatcacagacttctacttccagcagtgtgactagggcaacgtgccccccagaactccctgggcagagccagctcgggtgaggggtgagtggaggagacccatggcggacaatcactctctctgctctcaggacccccacgtctgacttagtgggcacctgaccactttgtcttctggttcccagtttggataaattctgagatttggagctcagtccacggtcctcccccactggatggtgctactgctgtggaatcttgtaaaaaccatgtggggtaaactgggaataacatgaaaagatttctgtggaggtggggtgggggagtggtgggaatcattcctgcttaatggtaactgaccagtgttaccctgagccccgcaggccaacccatccccagttgagccttatagggtcagtagctctccacatgaagacctgtcactcaccactatgcaggagagggaggtggtcatagagtcagggatctatggcccttggcccagccccacctccttccctttaatcctgccactgtcatatgctacctttcctatctcttccctcatcatcttgttgtgggcatgaggaggtgctgatgtcagaagaaatggctcgagctcagaagataaaagataagtagggtatgctgatcctcttttaaaaacccaagatacaatcaaaatcccagatgctggtctctattcccatgaaaaagtgctcatgacatattgagaagacctacttacaaagtggcatatattgcaatttattttaattaaaagatacctatttatatatttctttatagaaaaaagtctggaagagtttacttcaattgtagcaatgtcagggtggtggcagtataggtgatttttcttttaattctgttaatttacctgtatttcctaatttttctacaatgaagatgaattccttgtataaaaataagaaaagaaattaatcttgaggtaagcagagtagacatcatctctgattgtcctcagcctccacttccccagagtaaattcaaattgaatcgagctctgctgctctggttggttgtagtagtgatcaggaaacagatctcagcaaagccactgaggaggaggctgtgctgagtttgtgtggctggaatctctgggtaaggaacttaaagaacaaaaatcatctggtaattctttcctagaaggatcacagcccctgggattccaaggcattggatccagtctctaagaaggctgctgtactggttgaattgtgtccccctcaaattcacatccttcttggaatctcagtctgtgagtttatttggagataaggtctctgcagatgtagttagttaagacaaggtcatgctggatgaaggtagacctaaattcaatatgactggtttccttgtatgaaaaggagaggacacagagacagaggagatgcggggaagactatgtaaagatgaaggcagagatcggagttttgcagccacaagctaagaaacaccaaggattgtggcaaccatcagaagcttggaagaggcaaagaagaattcttccctagaggctttagagggataacggctctgctgaaaccttaatctcagacttccagcctcctgaacgaagaaagaataaatttcggctgttttaagccaccaaggataattggttacagcagctctaggaaactaatacagctgctaaaatgatccctgtctcctcgtgtttacattctgtgtgtgtcccctcccacaatgtaccaaagttgtctttgtgaccaatagaatatggcagaagtgatggcatgccacttccaagattaggttataaaagacactgcagcttctacttgagccctctctctctgccacccaccgcccccaatctatcttggctcactcgctctgggggaagctagctgccatgctatgagcaggcctataaagagacttacgtggtaaaaaatgaagtctcctgcccacagccacattagtgaacctagaagcagagactctgtgagataatcgatgtttgttgttttaagttgctcagttttggtctaacttgttatgcagcaatagataaataatatgcagagaaagagaa

SEQ ID NO: 2534 - DNA, 8693 bp, Homo sapiens
  source 1..8693: mol_type = genomic DNA
tgcatcgttagcttctcctgataaactaattgcctcacattgtcactgcaaatcgacacctattaatgggtctcacctcccaactgcttccccctctgttcttcctgctagcatgtgccggcaactttgtccacggacacaagtgcgatatcaccttacaggagatcatcaaaactttgaacagcctcacagagcagaaggtgagtacctatctggcaccatctctccagatgttctggtgatgctctcagtatttctaggcatgaaaacgttaacagctgctagagaagttggaactggtggttggtggcagtccagggcacacagcgaggcttctcccctgccactcttttttctgagggtttgtaggaagtttcctcagttggagggagtgagagctgctcatcaaggacttctctgtccggttggaggttaactctgtctcttgctctctcatttctgcctggaccaagactctgtgcaccgagttgaccgtaacagacatctttgctgcctccaaggtaagaagccgtcccacggtctgttttagcaaatggggagatccatccccaaatgtctgaacaagaaacttgtctaatggaaaacgagcgggcccaaattaactctaaggtgttagatgttttcaaagaacgagaagtctgatctttactcttaagcatgttttggtctttctggtttcacttgatttagaagacatgtaatagaaagcttacatgctgtagtcctgactcagatcctggtcaaagaaaagccctcttgggttttacttagctttggcatagtgcctggaacgtaggaggcactcaataaatgcctgttgaatgagagaatttttctggcccatacatttctgaaaaaccaaatactctcacagaaacagatattgagatgacaggttgagggagctttcattttgtctaagagacttcctatggcaacagaaaaggtatcgccagagcccctcctcttccacagcctggccacctaacagccctctgggttccggggctggccgtccagagctcctcagcttgctctggccggccgaactcccctccagctcggtctggaaccatcctgctgggcagcgtccagcacatccctgcttcgggctgcctgggcacctcgcctctctgcctcctgtgctgcctcacccccacccctctatctgtagtgggaggagatagatttgacagctgatagtgcattttctctgacaaacacatgactacagccgtatcaatagttttgtgcatttcagttcctgttttcatggaaacacacggctgagaatgaaagccccaaagcctcaatttcacagtggtctcctaactacctgctttccatgcaaactagggagatgatatggccaggagtgaagccctgtgtgttgggcagggtcacactccagcacccagaccatagaacagggcccatcctgcttcatgagggaaactgctcttcgggcctttagctggactatctcatttcattagttatcccgggagtccgatacaggatgagattctgaagggcaaatacacacttttttttttttttgagatagggtcttgttctgtcacccaggctggagtgcagtggtgcgatttcagctcatagcagcctccacctcccaggctcaagctatcttcctacctcagcctcccaagtagccgggacgacaggtgtgcaccaccacgcctggctaatttttgtatttttttgtagagatggagtcttgccattttgcccaggcttgtctcgaacttctgggctcaagcaatccgtccacctcggcctctcaaagtgctgggattagccactgcacctgggcaacagtttatgtgtgtgtgtgtgtgtgtgtgtgtgtgtatatatgtgtgtgtgtatatatatgtgtgtatgtatatatgtgtatgtatatgtgtgtgtgtgtgtgtgtgtgtgtgtataaaatctccaagtccatccaaccgagatggctcctactagaagccaagagtccaccgggttgagcactgggtctctggaggcctgtggcactgctgagaaggctctaacaaagccaagggaagggccacctcactagaagccaggcctggaggaagggtgagggctgagggcctggaggtaagactgcctgtggttttagacccagctctgccactgactagctgtgtggctggccttcagcacatcttcacacctctctgcacctcagtttccacatgtgaagatatgaaagtgattctgaaggtgattgcaaggttgattggaatccagctcttgagttagtgcaaagtgttattgtgagatgatataaccacgattaaaagcaagaacaggtgcagagaagcgatgattctaagaaggaggggaccgggttggaaaggatcaaaccatccaggatgccgagtctggggcaatccatctgggctgtttctggaagacccccgggtgcaggccaggacactgctgccctcccgtccttaactcccctcttcactcagtcctcactcacctccctctcacacacacaaacatctcctagaataatccccactgcctgccttcactcttacccgtctcatttgcctcccctgaacttcatcctcctggagttcacgatctcactcttcactcttttcttcccctcgaagattcagcactgcttacttacatgttaagatatttcagaacagtgaaatgttgctattttcaaaaacctacaaaggtggtatgcagaggaaaaggtacttctttgtgttcccaaagaaaacatctttccaaaatccagcctattgattttatttcttcgggggaacaagaattttagtatctctaagttgggtagcattctactcttggcagttgctggaaagaaggcactggtctaggtcctgggcttcacaggtaacacctgtcagggtgtctatgaagtcaaggctgtctgaggaacagcaaagtgggaagaagcaagctggctggctgatgaagggtttcttgggtggacaagtagttggagctatttcctatttaccaaagagagctaaagttcataattctacagagagttccataatgaacctcaaatacctctgttttttgaaggagtttctcatatacagcactagctgactatcctgggcaggatgggagataatgaatgcagtgccaatcgggctggatttatatggtcctcagtgaggctggtcaagaaccgagttagaactctcacagagtcactgccacagaagaaatctcccaagtggctgtttcctgacattcccgggagggacaggcctccttctgagtcactccctaagcagttctgaactgtgaggtcagccaggctgtccaagtgcactccctgagccactggcagacacactcagcagccagagctagacaggcaggtggtaggagtccagggccacggcagggatggagtgtcgccccctcgctgcgataccagagcaactaaaacgttaaggccttgcactaaagctgcccttaggatgcattcttttaaagtttttccatttaatgcagactcttttcaattcttattttatccttgtttcctttagaaagtcctttcaaaaatatctttagagggttttttcctatactatgtggccatatacgggtcaaaattaagtttaatttccaggctccaagccagcgtttcagaaaaatctcaccaaggtttgtggtaaaagaagcaaagggctgactttttggttttcttgaatctcactgttccctctgcagcagcatgcatgtctgcccacctccagacacacaggcaccatctgccgccccccatcagcccgtgtcccttccacctcgactcgcctacaaagcccagagaggtctgtttcttggcccccagagcccaaagatactgacacactcttacatttccaactagaatcaggaacgaggagtgactctcagtcagttcattaagtaaatgtctttctaaccgctctgcccatgggacatcacgccccacaggggaaaggggaagcttctgtagcctgggattctggtgcctcagtctgggtctagactttcctgaaaaaacgttaaaatatgaactgcattcctagaatttagcctacataaataagagatgaacacaaagatttctatagtttactcactgccgcttatttacagaagcaaaaatctgccacgataggggcctgacaaatgacagtaccactgtgcaatgcgtttctacgcagctctcaatcccatgttctctaataccaccgaagggcttaggaaatgcttatggtatatgtaaagagtaaagaagttacaaaacagtatcaacagttgacccctattttaaaaagtatttttaaaagtgtgacgatatttaccaaaatattaacagcaatagttacctctggctggtgggatgagtgaatgtatttttgttgaatatatgttacctttatagtaaatatatgttatcttgatcatcagaaaaaaaaatatgtaagaacttgaaagctgcttggacagcgctgctgatagaaacccctgagcatcttgtcactgttcttctgattcagagggtctgggtggggcaggggtggtctgagattctgtatttctaagaagctcccagtgatgtccatgctgctggtccatggaccacactttgagtatcaagggaccagagcatgtcgggggagaggctggggatagctttctttatctgaactggataaaggaactgggctcaagctaagaaccctctccaggttctgcatctttgttcttcagtgaaaaatgagaggacacaccaggccaggttcagactgagacacaatccctctcctgggttcccaatgacttgtctcttgtccattcccttctctaaggctaagggcccccaggaagagccatgtggccagaccctcacagttgctggcattccaaggagattctcactccgcatcatttggggccaaaaggccccttacagaagctctgcccaaggctcagatcaatggcacctgctcccagagcctcctctgatctcccaggacacctttccctgatctgtgcacttatctcttgctgcctggcaaaatgtcttagctcctcacttgggccatgtgctgctctcctctcccatggggagagccacacggagagtgctggccaaagcagcagagttcaggccaaaggatgtgcactcatttattcaacaggcatgcaggatttccagggaaagctggattttaaaacctctgggaacaagagcagaacctgactgagagctcatgtgggcacttttcatagcagaatagctcatgaggtatagagacacggacgcagaacgtgggctgtagcgacagatggtcctgcattctagtccccactgtgccttttcctcatgggatgactttattcaggtaccctttcggcaaaatcctccaagagaaaggaaactgggaggttctggggagaaggctgctgcgtttgcaattgggagaggttgttgacagaggtttatgtctgtggcaagcagccttccttcagtggaatacttgaagacaggtctgtagttgagcaaactcacctccatttgtcctcctggaaagaagaaatcaagaggaaaaatctctctcccatcctccaaatggagctggcacattgctatctgtggcatttgtctttccagaacacaactgagaaggaaaccttctgcagggctgcgactgtgctccggcagttctacagccaccatgagaaggacactcgctgcctgggtgcgactgcacagcagttccacaggcacaagcagctgatccgattcctgaaacggctcgacaggaacctctggggcctggcgggcttggtaagctgcactgtattcctggcaagccggccgcgtggctcctggtggacagcagcctcacttctaaacactccttaggagctgcagcacccttggtcaacccattcattcattcactcattcaataagtatttgctgaagttccacaagtgctgggtgtggttctaggtgctgaggacgtgtcactaaagacacgcaggccgagtccctgttctcatggaatgttctaatgggagagttagaaaaacaaacatgtaaaatgatggccagcagtgatacgtgctacaaagaaaaacatagaaataaagaacataagagtcatgggggagggggctgacttaggagctggtgacattatctgagcagatatttgaattgagggagcaggccacatgactaactagggagaccattccaggcagaaggaggaggtatgcaaaggccttaggatggaaatgaactaacttcctgtatttaaagaccagtaggaaggccagtgtggctggatcagagtgagtgaggggtagtttccaggacagcagatcacacaaggcctttagattccaccacgagtatggcagggaacacctgcagagctttgggcaggacaaagactgtacaatctgatttacgtgatttaaaagggtcagtctggctactgtgtggtaaataggctgaaagggggaaagcatagaagcaagatggcctgttgggaggctaccacagtaaaccaggctagagatgatggtggcgtggacagaatgaagcaagatggcctgttgggaggctaccacagtaaaccaggctagagacgatggtggcgtggacagaatgaagcaagatggcctgttgggaggctaccacagtaaaccaggctagagatgatggtggcgtggacagaatgggagcagttgaggtgaacagatttgggatatgactaaaaataaaaccagaaggatttgctgacagatcggttgtagggggtaagatacaggggaggaaaagatgacctctttgttcctgcccaaacccctctggcgatggtcagtactgtttacagagagatgaaagactggcggcaaggcagggctggaggttcagcagaagatcaagagttcaattttgtacatcgtacatgtaaggtggctcttggatagccaagtgaaggtgttgagaagatggttagaaaagtctggaacttaggggagaggtcagaacttgcaatacaaaaaggagagtccttagatagatactgctgaaaatctgaatgacagaaagggagagatcaaaggactgagcctgagatcaacacatggaggtcaggagaggaggatccagccaaggggcctgaggaggagtgaccagtgaggcaggagaacactggagagtgggcggtaccccaggaagccgttgaggacactcaaggagggagggttgactgtgtcaaatgtactgaaaggacaggtcaggtgaggaccaagaaaggcccctgggtttggctgatggaggccatgggtgaggctgatgtaaatggagaggcaggaaggaaagcccagctggagtgggctcaccgaggatagggtggcgagaggagacaaagaaggaacagtgagggcagaacactctttgaagatgtttagctataaggctgcagagaaactgacccacagctgcagggtggttatggagtgagggaagctcttttaaggttgggggtatacccagcatgttaatgcacctgggggaatggtccagtggagcaggaagaactgaagagagcagaaagaggaagaatcattagggggcagaagtccttgtagcccagagtggatgttatctaatatcgagtggaggaattaattggctttagaggagaacaaggacatgtatcccctctctgggcctatcaccttgtagacaatgggataggtcatgggataggaacttggcacaacacatgttctctcttttaattctctccattatcttatgaagcaggcaagtaggcaaacaattgtcccaactttacaaaagaaactgaagcttttataaattaagtagtacatcctaagcaatacaattaataaatggtagagctgagattcaaactgaagcagtggcctgggggtagcatctggaatccttcccacctttagggctgctgtgctgcggtgctgctgtttaatggcacaggagggccacatgactgaatctctctcagcagtccaggcagtcatgcagaaggcccagtagagcaccgggcaggtctgagccagcatcttcaagttccaccctctgagcaagcacctagctgtgacacacctctccagagactgcactcccccccgcgccacccaccccaaaagcagataggtaatggtatacagtaaccatttctagaagtgtaagtagtatgcacccaaaataggcaaaacctgctggcctagtgatagagacaactcccagtcaggctagactggaggccttggttttataagtgttcaggtgacaagtgccacagtaggcttgatcaagtagacaggcaggcaagacaaatgcttaccaatgcaagctaatgaaatgtttcttttgcagaattcctgtcctgtgaaggaagccaaccagagtacgttggaaaacttcttggaaaggctaaagacgatcatgagagagaaatattcaaagtgttcgagctgaatattttaatttatgagtttttgatagctttattttttaagtatttatatatttataactcatcataaaataaagtatatatagaatctaa

SEQ ID NO: 2535 - DNA, 8693 bp, Homo sapiens; identical to SEQ ID NO: 2534
  source 1..8693: mol_type = genomic DNA

SEQ ID NO: 2536 - DNA, 137262 bp, Homo sapiens
  source 1..137262: mol_type = genomic DNA
ttacataaaattatctcactccattttatttaagatttttttatccagttagtaaaaggaagatgtgtctctctttatacatatgtacaagttcagttataaaaatagcacattcaaagagaaaaggcttggcatttttctgattccctctaaatagcatctgtacacaggaatctgggtttgagcaggggaatcttaatgatttaaattaaatgattcccctataccccctactccaaaaaagttttaaaaatcaatctatcgaaactcaattccgcgattttcaggtgtgcaaatcagaggcttgcccgcccggaggtacctgctccaccagggacatcaggcagggacaggcagaaacacctcccatgcaaacactgcccctctgtctctactggagggcagcaagctcaggctggccgggctgggagggccggtgccgagcctgccccctctctccgccctcttcacctcactcctgctgtcccttcctctctcagtgcaatatagacagtgcatacagccaagcaggggactgaagggcatgagcagggagactgtgcattcaggatgggcaaaggggactctgcaagaggggcagtgaggctgtcctgctgattgaggtggctcctggtctctctactggcttctgggagtcccctgggtggaaggtgctacggttgctggtaggatctgaaggttctcttggtgtgaaccatgcaggatgggaggaattgctgggaacacaactgcctgtggatagacttcctctagcctctaccatgcttagcggcctccaccatctctcgcagtcactgctctctccaatgatgacactctggggttcagagacctggggagctgcctgaagactgtggacaacaggtatacaatctcccttactagccctatgagaaatcacactcttaagagaaatctctaccatggaaggctcttcacagcacctgcggagactttgcaagggacgtgtcagagccgaagagtggaatcgggatggaaacagtatgcctgagcatctaaagggggtctgtgtcaggcttgccccgtgagaggtttaagacttggctatacagttcacttgagatgcagtggggctgatccatgccctgtggccttcctcctacaggcaccccagatgctcctgatgagacacagatgataaaagtgctcacaccatccacctgcctgtccttcccctgctggacatttccacttctgactcaggatgcaagatgctgcacggggcaagccatccaaagaccactggcaggtcaggactctagccctggtttggttgaaggaagtcggagggcccagatggttaccgtcctccagaggggttggtgcctttgccctgtttccggaccagagagtctggggctaggctgctggtcatgtggaggttcttgggattcccaggaacattatttcccttgctcaaaggggaactcaaaggagaagaggcgcttgaaggtccaaagtcagcaaggccagcaggccgaacaagggatgtctgcagaggactgctggcggagattcctgtggggacggagagagacaagaacgtaagcaccagtcccgcgtaagcttccttggagcctgtggccttggttaccagagtctgagctggaggagaagtggtgggcaattcctccctgccactccttgctaacaacttcttggcatgtttgcttgctcttcctgtcaactgtcttttcagtaagaggaatagatttttaagagaaaatgatacctacccaaccctctctatactacttcatccacagatggtaaaatgttcatcttgacactctagatagagcacacattttacaatctgagacaccaaagttacaggatgagagctgtaacttactaggcacaaacaggtttttcctttcttctttcttggaacatcaagtttgataagatgtttccttttcaatttcatgctcctgctactctccagtaagtcgggccagagggtacaaggctgcccactctctatcctgtgtctatattcatacagttctccttgcgctggcaatggccacccctgctctccaaggcctgtgtcacttcaagggcacagctcaaatcccccatcttgagtgatgactccctgggcaacagtgaacttccctttttcctacataagccaaatccacttacatgtgataacacattgattcttcaattgtttcatatgtactggttttactttccaaaaaagaattctaagtgcttgatgggcagacatgtctctctcctcatccacagtggaaccacgggtactctctgaaccactcctttcccttgatttccatttccagttgccaagcactgttggtttttcttgtgctgctctaccccctctatctccctcaccctttctgccctctacacagtgcaggttctgaggagaaaccctgatgagtatatgcaatgccccagccatgggtgagaccctgccacggcagcctggactactggcatgactgttgttttccaaggatgtggtaagttggcaaagggctaagaaacactgggcgaggctattatacttcatatttcctctatcatacttcatatttcctggaagaaccaataaatgaaagctgagatttctgcagtaagagaaaaggcaagtaaactaacaattactgagcaattactacactccaagcactttctatactagtatgcctttacttgctacaactatgagctcatactaagcccacgtattgaatgggaagaaaggtctgtaagtggctctctctttctcaccacactcaaatgtcctgtactttatagctacaatcatccttcacatatcacggtcacaacagccacttttttcctcaaactgtctgcagccccttgtcacacatctgctaagctcctgcccagcaggcctcgccatgtgtttacaaccttgactcctactgctcctcttccatggaacctaagctgctcagtgacccccagtatgccttggccactgccagctctctgtcaccagtccaaatccttcctcattcttctcctcccttttgaatacagacaggcaacttatcagcaggaccatggttccctctcctcctgacctacaactgctgtggctgccttcttttcattcccctgtattttgccgtggattgctgttaagagtactgcatgcatggcttccccttctcattgctattatacactcaggagcaaggtccatgtggaatactcctttttacgttttttagtttttgagagagtcttgctctgtcacccatgctggagtgcagtgacctgatctcagtgcactgaaacctccacctccagggttcagtcaattctcgtgcctcagcctcccaagtagctgggactacaggcgtgagccaccacgcccatctaattttttgtgttttttggtagagacagggtttcctcatgttggccaggctggtctcgaactcctggcctcaagtgatctgcctgcctcagtctcccaaagtgttgggattacaggtgtgagccactgtgcctggcccatgtggtatacgcctatgcatgcagcaggtgcctcatatctaggtgataaatcacacagctgaatgaacgttaactatgctaatttggattactaaaatgtggatctcagaaatgaaagcctaggaagaaaacaaatccccaaagcaagaaaaattcagaatgtttaaagtagtacagttcacaattcagctctccctttttacaactacttccaatccacagacagccctgtaccgtcaggagggcaaggggtgagtcaacagtgcttattacaaagaagaagaaccccaattggggctctaggaagaaagctcccggcttcagggtttcctacatgttctacctgactgacagaatttctagactgtctctgaccagaacaaagtctgcagccaccctgggcttctgtacctttagacacgttgtacccgtatgcggcataggcagctgcagaggccgctgcagccccggctttggctcctgccattgcagcagcactgcctgccgtggactttcggctccggcccttccctgctcctttggctgtgcttcctgaacctttggggcggcctcggcttcgggctgagtgaccacgtcctgcagctggcatttcctgaatggaaattcctgtgggaacaaatgggccaaaagggaaagaaaaaaaaaaaaagtcaatctccaagatgttaacatcaccttctcctgacagggaaagcgagctcttagggcatttgttttaggacccatgaggaggtctatgtctccacttaatgatggctagaccactgagtcacacagaatactaagaattctaaacaatgaaaacatcctaactcctcaagctgcttttcattctgaagagcagttacattactcctgagtttcctctttaaatttgtccattacaaagggaagcgacttgctacctgggactcatctgcacactctaatgtgctcttgccttggagagtcaaattttaccctcgagttttgaacccagagctccccaagaaatggcagcaacactagaccccacacagcaaagtgaggaaaggcccagaaaagctaacattaattaaaaatcagcaaaaataatggtgaatctgaaagtcggggatgactagaaaagttttaaatctttataaagttacttattttgctttccctaaacctcgttttctcatttcacttgacaaagctattgaaagaataaaaataccattatcctagaaggaatcaggaccttacccacaaccaaaccagtgctgggcagtggaccaggcccaagctgtacaagacagcagcaattaccattcacggtatctgagacggagcctgttatggatgcgggagagttggtagctcgagactgaggggctgaggaggctgggtcatccacaatgaccagcatgtcactgctgctctcgtccaggggaatggagccagtgtgcagctcactgctgatggagatctagaagaggaagggttaagatcattacgaccccctgtgctcaccgcccatggccttgcacccagctaggaacatgcttcacagttgaggctgctttggcttctgagaaaccaacctgtcctcatttgtttttctccttacagacctcatgtgcaacctacttcaacaaggctggagaactccaggagaagcaaagactgcccagcagtgtgtccctgctacacggtcaggacactccttacggctgtgatgcaggcatctaaaaggagcctcacctcactgaaagggcttggcatggctgagtccacgctaatgaaggagtcatctccgtcagcagagaggttggagttatcagccgagggaacaaatgggatcaccaggttcacaccctcttttctccttttcccatccaattcatcttcttttttcttctgggaacacacggataaatatggaaaacgtgtgaggatgcaccccaaaagaaaagcgggatttgggaagaaaaggataacagaacttttattctttagtttataaacttctcaattagcatatttttacggaagaaaaactgcataaggaagaagggatagcttaacaggagtttgtgtgtatttcagtcgagtactgtggcacatgcctgtaattccaactacttaggctgaggtgggaggattacttgagcccagaaattggaccccagctcaaaagaaaaaaaaaaaaaagagcttatgaatatctgccacaataatagagtttaaagttggggcagtcacactgaaccagagccacaccaaccctgatcctaatgggccgaagagcctcaccagccgctggcacatccagcacttattgaggctgactgaatgcagtcccacaaaagagagggccaatgctttcaatatattttctacatatctgtttttaagacaaatttttaagacagttcaaatccttggtgtgaactagagaaaaacagatgaacagacatttagaaataaaccgggggtttatttttctagtgacagatgacactgagtggtacactagcagaattatggtaggtttgtggatctcatgacctcttaggccccttctaagattctatggagccttataagtaatgcccatcttagtcacattttagccttccacgctttgtaacagccctgacaaatggtttccataattaaactgtgaccaccgtaagggtgagtttgtgtggagagtacagatctaccaaggccacatttctcctgagcaaagcgtgagtcagcccagaaatgtagctgatcatacacagctggagcttgatagcaaccagtaaccaagatgagaagccatgtaccccaaagcctttttggtaagtaccccaggccccattagcccctatccaccattccaggctggaaataccttctctgcatacttttcccgcttccgcttgcgctctttcactcggttggtttcctcctgttgccgtttctcttcctgccgcagcctcactatcaagaaaatgaattaagacctgatgaagtacctgtggtaatcataatcctcactctcttaattaaggtggccatatcccctgatgtttattttccaagtatcacttctatctgtttaaggcagataaccagtggttttctaacttggattctcaattttgggtttaaatcacactcttattttaagcattatgggctggctcggtgtggtgactcacgtctgtaatcccagcactttgggaggctggggcaggctgatggctcaagcccaggagcttgagaccagccgggccaacatagtgaaaccccatctctataaaaatacaaaaattagccaggcacagtggtacgcgcctgggtcccagctaccccagaggctgagtcaggaggactgcctgagcccaggaagtggaggttgtggtgagccaggattgtgacactgtactccagtctgggcaacacagcaaaactctgtctaaaaaaaaattattataggcctttcctcatgttattctttttccctttttcatttcagccttttaatctctgctttgcacacattgagcatggctgtagagttctgaaaggttttagaaggtgctggcaaatgtgaacttactttctgctctaatgctgtggaaggcttcagaggctcacaggatgaatctgaaacccaatgctctcaaaagccagaaaacacatgggaggagggtttgtatggttacagctgcgtgcttctccaacttttccataaaaacatttttctgggcagaagagcaaattcactactgctaaggagtcagctgccttccttgtgcaagctacattatttgaagccacatttacctttaaaatacacacaaattttgccttctactccacaatgctttttttttttttttttttttttttgagatggaatcttgctcttgttgtccaggctggagtgcaatggcacgatcttggctcactgcaacctctgcctcctagcttcaagggattctcctgcctcagcctcccgagtagctgggattacacgtgcccaccaccacgcccgactaatatttgtatttttagtagagacggggcttcaccaggttggccaggctagtcttggaactcctgacctcgtgatccacctgcctcggcctcccaaagtgctgggattacaggtgtgagccgtcttgtgttttttgtttttgtttgtttttaaaagatggagtttcactcttattgcccgggctggagtgcaatggcatgatctcggctcactgcaatctccacctcctgggttcaagcaattcttctgctttagcttcccaaagtgctggaattacaggtgcccgctaccatgcccaactaattttttgtatttttagtagaggtggggtttcacaatgttggccaggctggtctcaaactcaaactcctgacctcaggtgatctgcccactttggcctcccgaaatgctgagattagaggcgtgagccaccatgcctggcctacaaacacattcttgtttgggtttttatataaaatatgagcacaaaaatactttccctaaatacagcctctggctttgcctacccttggcacacagccaagtacctcttccattctcagatacgtgaggggagtgtatagaggtttagagtacatacgtttcttctccaactcttcgtcgtctagaagaagactaaccacctctttgggtttcaaggtatctggtttgaagttcccacctgaaatcaccatccgctgaatctacaccaaagcagatcaaaatgtcacctccaggcatccattcccttatggcaaatatccagaaaaagatacacatcgttctcaacccactcctcaggggaggcctctggtttcctatttcttcttttctcccttttcatttcagttcatctgattggctcatccagattatttgtccgacagaaggaaaatgataacttctttgcttggaactgctaactagaaaatctaaggctactgaatcaggatgaaaaaaacaaaaaataacaaatttggcatacaattcagaggcagataagctgagagtactaggataggaactaaaaaatgtccatccttcttccactgaatgcgagaggccattaccggtgtcagtctccacatgaacaacagctggatccaggctatggaaaccattctaggggaaagggaatgaggcatggccagggaagtcaaaattgctattgcatgggacctgattttattttctattcagaagaaattgtagtttcgtcaggaccaatgaaaggcaagagagttttaaaatagtctcaatgcagtcaatgtggttggactttctgtttgctccaccagtgtaggaatttctttctcttgtgcttacctcactcttctccttggctctttgcagaatgcgttcttcaatggtgcctttacagatgagccggtacacagtaacctgctttgtctgccctaagcggtgggccctgtccatggcctgctggtccacagtggggttccagtcgctatcatagaaaatcacctgcatagaatatagcaaaaactgaagcactcttagggaaggaccagaaattctgagagcaacccagccaattgtctgtttgcgagtttggcgtcagtagggtctgattcgtttctatgatattgagctaagtaagatacatcttagaagatacaaagccgttccttcacatgccctgagcaaaagatacatgctcctgttttatttttttcagttttcacttaaaaagagtggcaataatattaatagttaaaacgtagtgtttagtacattaataacattaacggttaacacttacagtgcattgttctaagtgcattaactcatttaaatcccagaattatcactgttatttgtgctgagaaaaaaaatcccataatcgtcattatttaaatgctgttaagactcacatattttgtagtttaggagaatgaggcacaaatgagctagacaatttatccaagatcacattgcttaactaagcaccactgctcccaactattcacaaggctgaggtgggaggattgcttgagcctgggaggcagaggttgcggtgagctgagattgtaccactgcactccagcctgggtgacagagcaataccctgtctcaaaaacaaaacaggtcagctgtggtggctcacacctgtaatcccagcactttgggaagctgaggtaggtagatcacctgaggtcaggagttagagaccagcctggccaacatagtgaatccccatctctgctaaaaatacaaaaactaaccaggcttggtggctcacgcctgtaatcccatcactttgggaggccaaggcgagtggattacttgaggtcaggagtttgagaccagcctggctaacatggtgaaaccccatctctactaaaaatacaaaaattagctgggcgtggcagtgcgtgcctgcaatcccagctatctgggaggctaaggcaggggaattgtttgaacctgggaggcagaggttgcagtgagccgacactgcatcactgcactccagcctgggcgacacagtgagcctccgtctcaaaaaaaaaaaaaaattagccaggtgtggtggcaggcacctgtggtcccagctactcaggaggctgaggcaggagaattgcttgaacccaggaggcggggagtacagtgagctgagatcatgccattgcactccagcctgggcaacaagagagaaactctgtcacaaaacaaaacactggggctatgctggaaacaggcatggctttccctagaattctcaggctctcatcaacagtcatttactagcccatgaattcccaggatggaatgtttaaagggttctctggaagtgacttctagtttgctgagcaacaaacaaattaacaacaaaatatatcaccactaagtgagtgatcctaaaacaaactcctcagtcctcaacccttgaggctaccatccaacatggcggaccagttcaaaatggccctcatatctcatgtgttgtcctttatatccaatcaaaagtcaccaaatccagccactgcttcaaaaatgaacctgtcctttctactgtaacaatcccactgtttccattctagaccaggccctcacaacctacatctggattagcactctgttacatcagcaggactcttagatctcggtctctttcctcttcagtctaccttggctaccactgtgggccactccagctctctgccagttacacacctgcctcagcctcctgagtagctgagatcacaggtgcctgccaccatgtccaaactctcctaaataatcaggccctgctatagagagccaactttattttctattctttcctaacacaaatatgccctttccctttagtcagatgggtctcttcagtggtcctggcttataatacatttgtgtacacctcttattgctcaagctgtttctctgaactagaatcccaaaactcttctttattggtcctttcaggtttagttcaagcttctaggaagctcgccctgttttctcttgcctataataatgtctccttttcttttcttatccctattccccctggattcctattagaaataataatggctaaaatttgttgggtacttatgagcccaggactagtatgcatatatctctcactgaattctaaaaaaaaaaaaatcctatgtctatcctccatcttacaagcaaggaagagactggtctgaaatcacagcaaggggctggggtggggagtgacctaacagtctccctccacaacctacagtagtaacaaaacttggcattgcctacctaccttggtccaagtccccacttaatcactaacttctatggtgtcaattatttcatgtgtactatttgaaagagtgagtcatctttcttgaaactgtttctgtctctctttttcttttctgagacagggtcttgctctgtcatccaggctgaagtacagtggcatgatcttggctcactgcagccccaaactcctgggctcaagcaatcctaccatctcagcttcccaaagtgttggaattacaggtatgagccactgcacctggccaaaatggtttccctccatttttagcacaggttagaatccttgggaagaacaatgtaaactgctggcgaaagaaagtcaccgtgaatgcttattgttaatctagtgtcctgcaaacctaagatttagaagtgcacaatgcttgttgcctctagaggaacttaacaaacctgaccacacgacattttggtttcaaagaggacataagaacttccagaagaccaagtttgaactagaagaccaagtttgaactttcagggagaacagagctaacaaaagtgaagaccttcagttggactagaggataacattacttgcccagtgtatttttttcatctttttttctggttcatgttgtcccatgatgcccaatgtatttaaaatgaccacaaatgtggaatttgagggctgatgtcacacccaaaagacagtatcttgagctgtctaagcttgaggctatggttcagcacgaattcataatgtggggatgtgggtggtggaggtgggtggagggagagccatataatgaattgtttcataagtactgtcttaacatttacattttttcctagaagacccagtggcaaccaaacctgattcaacttgtgttcttttgagctcatgaacagtaagattaaagcctaaggagatgggtttacaatcttaacttcaaaaatctccaaatatggaagatatttatcctttacatggattccaagaggtggggaatttgggaggaaaacagaaaaaaataggattgtttagaaaaatacctgtgcagcggaaaatatgaaatacgtacaaactaataggttaagaacaagagtgagagaactaaaaaccaaggcagatgtatggttaccatctaatctaacactgaattaaccgtgatgtgaactggagggagtggtgagggagacaatgcaccactgtggaacagggatgatgcctatatttggcagttgggtttatggagctcagtgagacattccagaaaaaaacaagtaacaattaaaggattagaacaactgatttaactaggaaagattaaggcaagtcaatccacaaagcgtggcccagcagtgactaaggagaaatagtagtcaatgccttcatgacattgtaaacaccaagcagggcaggcacaagggaagagaggtgagagttaccatgcggtagaggggcctggctgtataggtcagtgagaaggagtttcaggggatgagagaatgagatttaaaacaggaaaatttctttctttttttttttgagatggagtcttgctctgtcgcccaggctggagtgcagtggcaagatcttgactcactgcaagctccgcctcccgagttcacgccattctcctgcctcagcctcccgagtagctgggagggactacaggcgtccgccaccatgcccggctcattttttgcatttttagagagacggggtttcactgtgttagccaggatggtctcgatctcctgacctcgtgatccgccagcctgggcttcccaaagtgctgggattacaggcgtgagccaccgggccctgctgaaacaggaaaatttctagaagaacaagtgggaaaagttggaccaacacttggagggtggagctttttctcccaagagaataagcggaggttcggcctctgcagagggctaaaagctgtcctgtgagacaggacttcttgaatccctgcaaagggagaaaagctcttcattctcactacacataagcatttaaaacaggtctgacacagaaacacaaacagtgcagtttataacaaccccttactaaacagagtcaaatgcaaagacaaccctacttcaggaagcatatacagtgacacagtaaaaggcagctgccatacatcatttgctaaaaccatgtttttactaaccaagtaggccagatagagtcccactatttataaatacatttttacatatgcattctcaatcataagacattaggtttttcctgacatttttaggttgattaatctcttccttgtccataaatggttctggggaaatcccaaagctaaataaatctcagggcaaaggaaaaatgccagacaagcaactaatcctactgtttctctagcaacacacacacagtatatcctcggaattaatttcaatcttgctgtctcatttttctaagaactattccaggagcttctgatttacaagtgaatccccaagcccttcccccaaaattaaaatgtaaattacttcagaattcagaaatcagagtattcagagcctttctctttttttcttgaggcaggagctctctgtgttgcccatgttggagtgcagcggcacaatcacagctcactgcagtcttgaccttctgggcccaagcaaacctcccacctcagcctcccgagtatctgggatcacaggcatgtgccaccacgcctgactaatttaaaaaacttttttgtacagatggggtcttgctatgtggcccaggctggtttcaaacatctgccctcaagcaatccacccacatcggcctcccaaactgcagggattacaggcatgagccaccatgcccagcctagagcccctttctggccttcaggatgaaaaaagaattcctactcttattcctctacttatggatcagaggcctaggcctactttgcttctttgtggctggcaggacgctctttactcctacagggcaaactatgtgaaccttggaagcaaggtgcagatctctctttaaatctgcttagtttttttttttctttaaccatttaaatgaacaaccggagaaactattccttaagaaaccatagactaaacctgagataggcaagctgagaagaagagaaacatactttaataaaatgaaattgtgctagaccttcccaggtgacctcatacagcctcttaaatatcatctacaacctgatgatttgaaaatacagctttaaggccaggagtggtggctcacgcctgtaatcccagcactttgggaggcggaggcaggcagatcacctgaggtcaggagttttgagaccagcctggccaacgtggtaaaaccccatctctactaaaaatataaaaattaactgggaatggtggtgcccgcctgtagtcccagctactcgggaggctgaggtgggagaatcacttgaacctgagaggtggaggttgaagtgagccgagatcaagccactgcactccagcctgaatgacagagcaagactctgtctcaaaaaataaataaataaataaaaagaaaaagaaaatacagctttaaccccaatctttctcctgaacttcagactctgctgcctgggtgatattgccacttaacctctgatactcctaactgatcttcctgtttatgtctccttgtagcatttcatttttttctcccactctaaacagaagctagaaggatgcatttaaaactcaaaccagatcatgttactcctctgttcaaattcttgcaatcgctccccatctcaaagtccttaccatggctactaacccctatatgatctgcttctgcaatagccatctcatactactctccccatagttgattctgttctacctgctctgggctgcttccttttgcttgattatgccaagcatgttctcaccttagggctttgcacttatctcctctgcctggaatgctcttctttctgccaggtatatgcttaggttgccgccttactttcttcagatcttggctcaaatgtcaccttatcagagatgccttaccaatccatataaaacagcaacccctgatcattctcatgctaccactccttacctgatgaatttttcttcatagcattcatattatcagttttttgtttgtttttgagatggagtctcactgtgtcacccaggctggagtacagtggcacgatcttggcgcactgcaacctctgcctcccgggttcaagcaattctcctgcctcagcctcccgagtagctgggactacaggcgcccaccaccaagctcagctaaatttttttgtatttttattagagacagggtttcaccatattggccaggctggtgtcgaactcctgaccttgtgatccgcctgcctctgcctcccaaagtgttaggattacaggtgtgagccactgcacctggccccatattatcagtattttttccatttctttatgctttgtctcctctcctgccactggaaatgtaatttatagtaactatgaagatagaaatggaactttgttttgttgcatgctgaattcccagtgcctaaaacaacgctgggcccttggtggatgctcattaaacatttgttgaatgaatcaatgaatgaatgaacaaatgaacaaactgttccaggtactagaaatagacttaggctggagtgcagtggtgcaatcttggctcactgcaacctccgcctcctgggttcaagtgattctcctgcctcagcctcccgagtagctgggaccacaggcatgcgccagcacatacggctaatttttgtatatttagcagagatatggtttcaccatgcaggccaggctggtcttgaactcctgacctcaagccatctgcccacctcagcctcccaaagtgctgggattacaagcgtgagccaccgcgttcagcctagaaatgcagacttttgacttccttccattgttgaggccaaagtctagtatgtaaaataattacttacaatgtattttgattaacttgaataaagggaggggctgggaaaggaatattgacacctgaatggggttttaaagaacaaacagaagttcaccaggtggaagaggagactcatgggaggatgacttaggctgagggaacagtttatccaacagtgtgatatggcatggtgtgttcagggaactagaagtcaatcattatttctggaatataaaatttggaagggaaagtggtctgataattaagctataaaggtagataaaggacacaaatgaagagccttatactttattttataattgatgaagaattcctgaagagttttaatcaaaggagtggcatgattaataaagggcagagagaaactaacagagtaccagcatagcaaagaatggatttggatcaacaggtatgaagccgggaactgagagtggagtccaaaagagcagctgggacaaagtgatgaatcttgtactcacattgagagtatgactatgctgaaattcttaaaagatacagagagcagggaaccaagagataacaaggaaaaaggcaagtttctactatctgatatggtagaaactatgtgatatggctcaagtgagccaccacatcagagaacccacaggaacaacacatgccacactgacagccctcccatagtatgacagatgctgatgatgtacagctacccagcaatgcctccagtggccctcaggcgctgacgtcttgccgtacctggttaactgaaagtttagatgccaaggaaggtgcatcctatagttgctattacagaatgtgtagtatcagattagtgagagagagagagagagagattccccctgctgctgtgaatctattcaagcctctacactcttgcacctcatttctccactaccctcatgagtttgctttctcctcacagttgtggggattttgatgttctatatgtcagagaggcaccacgatagttacattaagtgccatttttagagtcatgccttttataaaataatttcccatttacgtatttttaaatctcaaagttactaaaattcttattaaatatatttgaatcttagcaataattttgagattcaaaaagaatcctcttttctttttgagacagtctcactctgtcgcccagagtggagtgcagtggcatgatcttggctcactgcagcctctgcctcccgggttcaagcgactctcctgcctcacctcccgagtagctgggactacaggcatgtgtcaccacgcccggctattttttttgtttttttttggtagagacgtggtttcaccatgttggccaggatgatcttgatcttctgacctggtgatccacccgccttggcctcccaaagtgctgggattacaggcatgagccaccacgcccagccaggaatcctcttttcttcaccctttcaaacactgaagcattcctgcaagaagactgggtaggaaagagtggataatttgttggaatatcttttctactttatttttgaaattacccttttcattgctctccaaccaccttttgaagttcaggatacaaaaaatgggtttttccattaatggaataatgcataagagtaacaaaacaatcctttctgatgtgttcaattatagctcctaaaacaaatctggatggactgattgtttttccagtctgttttccctgatgtaccctaaatgtctcaaacagtatcagacacatagtaggcattagtgaaatatttgtcgaatgaatgtgtaagacacttattcaggcgaggtgcagtggctcacacctgtaatcccagtactttgggaggctgaggcaggtggatcacttgggcctcagagttcaagaccagcctgggcaacatggcaaaaccccatctctacaaaaaatacaaaaattagctgggcatggtggcgcatgcctatagtcccagctacttgggagggtgaggtgggaggatcacctgaggctggggaggttgaagctacagtgacccatgatcatgccactgcactccagcctgggcaacagagtgaggccccatctcaaaaaacaaaaacaaaaaaacttgttcaaagaaaatgaatagtaaagtccataaggaaagctaaaatactctagttccagtcaaagagcaactagagtcttttaacacaagaggcaaagaaataaaaagtttgcaagtttgtgacacaaaagcaaagggtaaaacaaacaatgccatattagaaaaacctacatagtaggtttcatagtagaaaacctgcatatctagttgattgtgctctcattacttactgtgtctgcagcagtgagattgatacccagtcctccagctcgtgtgcttaacaggaacacaaagatgtcattcctgcagaaaagggagagatatgttaaaggaaaaactgaaaagaaaaaatggcatgtatcaatagagagagatctctgaatacagaacataaagtctaggactaaaaagagttttggtggttacctaggcctgactgtatttctgtaaagcattatacaatgttgctctgttgttacaaccaaacatggaggtcatcttccaatttgcagataaacttttgctgcccactaatagatgactgataggcaacacaagtataaacatgtagcaaatataacagaaaaatgttaccatagatgtacagacctctctcactgtcatatttttaaatcaaaccattcctagcttcctggttttctctaagaatcatgacttataatagtctggggactaatgttattattccaaaacactcttttttttttttttttttttttttagacgtagtcttgttctgtcgcccaggctggagtgtagaggcgcgatctcagctcactgcaacctctgcctcctgggttcaagcaattctcctgcctcagcctcccaagtagctgggactataggcgctcgccaccacacctgcctaatttttaatatttttagtagagacggggtttcatcatattggccaggctggtcttgaactcctgacctcgtgatccgcccgcctcggcctcccaaagtgctgggattatagacgcgagccaccgtgcggggccccaaagcattcattttaagatgaagaaagttgagtcccagaaaaatgactcaaataactaagacccaggctgtgacttttatgtgctaacttgaatttaggatcagtccatgaagacaggctggaattaaatacttctggatgaatgtcaacataccccttacatacaaatgattaaatatggttttctcagtttccttctacttcctatgttctttcaaagaaacactgaattacaaataaaccaataggtaccactgtcactcactcgagcaacaaatatttacggaatgtcttctgggaacaagcccataccagatcacaaaggacaagttttgtttttttttttttgaagatggagtctagctctgtcactcaggctggagtgcagtggcacgatctcggctcactgcaacctccacctccttggttcaagcagttctcctgcctcagcctcccgagtagctgggattacgggattacaggtgcccaccaccatgcctggctaatttttgtatttttagtagagatgggatttcaccatgttgaccaggctggtctcctacctcaggtgatgcacgtgcctcagcctcccaaagtgctgggattccaggcgtgagccactgtgcccggcagaacaggcttttgactctaagatttatctacacacacacacacacacacacacacacacacacacaaataagggctcagtttggtgctttagatggcattaagaaattaattaaagaaagaaaaaagattagaaaatattctaatgcattacaggtcataaaggtaagtaatgttttgtgaagtttcaaatatagaataaaggtactaaaatcacagtgtaaaattaattttattttgtggattccagtaaggaaaacaaaaaacaaaaaacaccagaaacaaacatactgacatcaggatgctctcatcccttcaggctattcttccttggtaaagtcacttgactgctgacagtctgtttcctggactataaaatgaagatgctatgaatactgctgaagtgactaactgatgacgtatcaatgtcaaacataagtatcggtgaaagaactattttgaaataaacatcctggttaatcactaaggtaggtatgtcctgtacaaatctgcccattatttacattgaattaaacacaactttcctacagaggcatggataacagaccacgggtggcggtctctcagttagtgattccaaatgctttgtgctcccatgcaagttctactagcttatccttaaattttatcacaaaggttaatatttcgtaattgtatttatttaattcataaaacgccatctttatgattaaattgtgtagtgtaaaccaaaaagttgaagggcatctgccagtttttaaacacattttcccacagatatgggatgatgtaaatggaaggaggcagggtatctcacaggcccaaagaagagtatttaaccacaataaggcttcaaataaaaactgattgagctttttagggccgtactaatctctggaaggctgaggtgtgaggatcacttgagcctaggagttcgagatcagcttgggcaatacagaaagaccctgcatctacataaaattttttttaaaaaaattagccaggcatggtggcacacacctgtagacccagctacctgggaggctgaggcagcaggatcatttgagcccgagtccaaggatacagtgagctatatatcataccaatgcactccagcctaagcaacaaagtgagatcccatctcttaaaaaggataagtaatccttcccacttccgcactgagaagactgctcttgctccatacatcttcctctcctgctttggtgggtacaaaggcaaggaatcaaaggctcctctctgatacctgcgtgagagttgatggggtcatccaatggctaggacttttttttgttaattcttgaggagacccaaaatatgagcatggggtaggcgtcagggaatgggtacagggtgggagtatgggggactggtgggaaaagacaaggcatttgagaagtacaacaaaataaagtattagaagcaaaaagataagaaatttctggccaggtgcggtggctcatgcctgtaatcccaacactttgagaggctgaggtgggtagatcacttgaggtcaggagttcaagaccagccttggcaacagggcgaaaccttgtctctacaaaaatccaaaaattagctgggtgtggtggtacgagcctgtagtctcagctacttgggaggctgaggtaggagagtcactagagcctgggaggtcaaggatgcagtgagttctaattgctctactgtgttctactgcactccagagcctgggtgacagagtggcaccctgtctcaaaaaaaaaaaaaaaaaaaaaaaagaaagaaaagaaaagagaaagaaaaagatgggtaatttccatagtctgtacagccagagattagttcagatgtaatcacttacaaataggggctatatacagaagaacactagtgaaagaaatgtaggtaaaaataaattagtagaaaaacttagaaatacaatggtttcttttggatatcaattatgtattgaaaagatgccttgtgatgatgaggtagatgaattcaatgtaattttatcatattgtaataaaaaataagaattgcagacaccttgggttcttataatcaaagaaattagttcctaccgtggactatactgctgtaaaaaacaaaagtatctaaatcaaactactaagaagttcctttctactgaataacgctataatagtattgataatgtgaattaacattttaggggctctgactaaacaggagaaaacaaaatcccagaaggcagcatggtggtctgggtgccctctctaggaggctgaaaaggcatctcaactcagggtctcttagaacagaccttaaagactaggcatctggctggtctgtaaagaggcctataaaaccacacagcaaagacatgtgtaggtctcgctctcactcttctttaataacccactgaggtgactttgcaccaacatacccaaatagtgctaggcacatagctgactgcagtaaaggcttgttgaatgactgaaaaacaaccacaatgaaagacaactgtgaatctctacaacactcacaaagaaaaaatccatgctacagtcactttttcctcatgttttccaaagagtcacactgagtggtcagataatggggagaggatccatttggtaaaggtcatgggttaggaggaagggaagcaaaggccaaagcaccacagagcaaagaccttgtgaatggcttccaggatcacgcactggtcacatgccctgaatgctgccccgtcaggacatcctggccaaacagtctttagtctcagtcagactttttcctggaaggatccttcataaataaatcttgtatgaaaggaatgtaaatggctttttataggcgttgttgtttactctggctgacctttgaccacagggctttccagttgaaactgcaattttttcttttgatgtccttcattaacagtaattaaaatatttgggaaggagtgcttgtgtccaaaaacacctgtctttttctctatatcaggcgattgcagtcactcaaatttataagttgagcattttccgccctttggaggggtcagcatatgcatagtccagattctacacatgagaaatagattacttctttgccataatcccaactctaagcaaccagtttgtaatgtaggcagggatcagaaggagactttagtctctttttccattttgcccaatattagacagagggtgttaaaatgatggttacccaaatgttgactctaaataacattcactgttacctaagtaattctaagttgtagagtctgaaggctcaagcaagatttcctaataaaatctgtgaaaaattacatttttactaagtagagccaagtaaaatttaatggtgaaaatgccactcttttagagctaaacttttcaaaatcattgtgcactactactgggactgcccaagtaattctgcttcccaagttaagtaagatatttcagaggtaataaattatacacctcctgatttttttccaccacaaaggtactgcaaaatatactgagccctgggtctcacagcccagttttctaataattgggtaagccaggagaacgactgcggctctaaaactcagaagcccaaatcactagaagtcaacatactacagctctggttggggtctatattagcagaattttctacaaagaaatatacatagtcttaaatgttcttatcctttcactcagtaatttcccatgtttgaatctatgctaagacagtaatctaaaatagtgacaaagctttatacacaaaaatattcactcaacatttctagtagatatttctattcaatagaaaagtggtatatatacccagtgttaacagaatagtgatcattaaaaatgttgtcggcaaggctggatgcggtggctcacgcctgtaatcccagcattctgggaggccgaggcgggtggatcatgaggtcaggagattgagaccatcctggctaacatagtgaaaccttgtctctactaaaaatacaaaaatacaaaaatacaaaaaattagccaggcgtggtggcaggcgcctgtagtcccagctactcgggaggctgaggcaggagaatcgcttgaacccaggaggtggaggttgcagtgagccaagatcacgccactgcactccagcctgggtgacagagcgagactctgtctcagaaaaaacaaaaacaaaaacaaaagttgttggcaaaggctttttaatgatatatgaaaatggttatgacagaatattaagtagaagaaatcaggatacaaaatcccacctataatataatagtataaatataaccctatacatacattaaagactagaggatataccaaaatgttaaaagtagtgggattgtgggtgatttttcttttcttttcttttttttttttttgagatggagtctcgctctgtcacccaggctggagtggagtggtggatctctgctcactctaacctccaactcccgaattcaagtgattctcctgcctcagcctcccgagtagctgggattacaggcgcccaccaccacgcccagctaatttttgtatttttagtagagacggggtttcaccatgttggctgggctggtctcgaactcctgacctcagatgacccgcccacctcggcctcccaaagtgctgggattacaggcgtgagccactgtgcctggactttattttcatctttaaatatttttcaaatttttctcaataggcatttcattataatctataaagtccccaactgttactgaagaaaaacaaaacattactgttaaaaagatccttaaatgtacagtatcaaatatactagtggaaaataaaaacagtatcaggtgaaatacctattacttaatggcttttctcataattcacaaagcatgccaccccataccagtatgcccacatcacagatatactggcatgactggagaaaatacaggcactctgaggaaacatacagtctatagctcgcacataagattcttgtcaagttgcagctctgaggctggagtaggtaaggacatgacatgataaaatatgtatcactgatttcagaattaagaaaagatgaagatcacccagtaattttttttcctctttttgccaaaacaatgtggtggaataaggaggcacaatgcttatgtttcaaataattggttttagaatctactggtagcttccgctaggtgagaagctaggttaggctatccacacagctgcacgagggtaacaaatggaaacgggtttgaagcagatcttctccttattgttggtcaaacaggcacctggaattctggtgtgtagttttaacttaggaaaaattctttaaacagaggacactctatgttgaattgtggatgtgttttatgccaaattattttatgtctgaattaaactatgctttagaactgaatggaattaaaaattgtaatctaaataaaatggctatgtgcttaattttcttaataagaattcagaagtgaaatattaagaggccatgcaattaaaagccaaagtcaaagctgttctgatttactgacattaagatctgctttattccttggctctccaggtctaaggaggaaaactgaagacgaagttcaacagacccgtcactagtggagcctggctttctccttggagaaagcagtaaccagactctacctattacaatgagaagctgcactcaggataattatggctcggtaaaccatcagcattcagcaggcagtaattgaaatttcataggctcattagcaggtgggagaggtactgtggctgagagctgccagctgagtagattgtacagtattgcaatttgtcataaggcactgtactgctactatgttaaaaggaaagcaggaaaataaaaggtactttttcttatacaaaatgaaacacagaaacaaactaataactttaagtcattactcagaaagtgctactgttagtggccgggatcactggttcatccctataatcctagcactttgggaggtggaagtgggtggatcacttgagcccaggatttcaagaccagtctggccaacatggtgaaatcctgtccctactaaaaatacaaaaattagctggatgtggtggcgcatgtctgtaatcccagctacttgggaggccgaggcacaagaattgtttgaaccggggaggcggaggctgcagtgagctgagatcatgccactgcactccagcctgggtgacagggagagactgtctcacacacacaaaaaaaaaaaaaaaaaaaaagaaatggctactgtaagcaatgaggaatacaggctggtggatttttttctacatacctattatccattgaggaggatcttggttcatacttagaaatgatttcttttattatccaaagaaataggcactggtgtcataagaaagcatacttcaaacatacaaactatcaggtatattctctttttctctcccagacacatagatctgaattatgataagcagatttagtaacttcttaaaatggcaggaattacatcttgattccttaacaatctcagatgtcctggcatttaaaaaaaaaaaaaaacttaccatttcaagcactagagggaaattaaaaagataatttttgtaattcccatgaacattacctgttctgaaaatcagcaaccatgtctcgcctctccgagatcttggatgagccatcaagcctcatgtaggtatgcttcctgtaaaccatgtattcctgccaaccaggataaaaggacacagtaaatctgatgcaaattactgtattctgatttccacaggcatctacccatcttctaccttgtccacactggaggcaagccattataaccagaatggggagagagtaaccccaagagtacaagaagttaatctgtaaatgagtttactgccaatgtgtgaaaatccagggcaatctgaagattataatcactctcaatttcagtttggaacctaatcttattcctgtaaattcctgtaggtttcattaaaaaaaaaaaaaaaaaaaattccacaaaccaaaatagtttttcagtcatcaaccagatatctttcacagctatgaaaatacctactttttttgtcagtgaataacattcactgaaacgaatgtgtttccccagagcaaacctttactgattaaaatgcttaaatttacagcctaagcttccttctcccaacagagcatgcatcactgttatgggaggcctaagcatcagagtaaaacaaaagacaaggtaattttctatggcagagaatgttcttgacatcatcaagaggaattacaacttttaagaatgaagagactccaaaagatacaatagagagactgcctctccattcttagaaattgcaattcttcttatagttatgtccaaatgaacatttatttcctcttttgttatctctgattatgctacaaaaagtccacttgtagaagaactagtatcaaaaactcaacacagctgcctatttataagaaacagcataaaatagttgattcggttctaaaataacttctctattgaaaaagactaatcatttctacatttgggaaatgtttgtgttaattagttttctgtggtcaaatgttcttatactgcaatattttcatatgtaactcttatacttggtggggcattttagcacatcaggttgctgtagtttggaatatctggtgcagcgtatgtgacagcctattcttagatggagtgagtgccaagaacttggcagaggtctctggctagggtacatgtgaagcgaagctggtcaacaaagtagacaagctcattgacatatgcatcttcattgtgttttatatttggtttaattttgattttttaattttttaccatttctgtctcaaagtggttccttaagagctgtgataatcaaagagaagcataaaataaagtgagcttcaagttcatacttagtggtattgctatatcgtaggactgaactaatggcagaagggtagggggcgttttggataaaaaggacttcaagaaagaaggtataaaatgatagcaagatgatggtccttagaggcttgctataccttttgcagctaatccaatcacagaacgttgcaatcagaacaacaaagtaactagacaataccaagacagtttacagagacacccaaaacacagattataattttagcaaaaaggtaggcttcctgcacaggcactctttttttttttttcttttttttttttttttttttagacactgtcttgctcgtcacccaagctggagtgcagtggcacaatcgtggttcactgcaacctcctcctcccaggttcaagcgattctcctgcctcagcctccctagcagctgggattacaggcaactgccaccacacctggctaatttttctatttttagtagagatggggtttcgccatgttggccaggctggtcttgaactcctgacctcaggtgatctgcccacctcagcctcccaaagtgttgggattacaggtgtgacccactgagccaagcctgatttgccttttaaactgaacttctagcctcataaaagcattgatgaatgaatcttctagtaaattttgctgtttatatatttatatatcaaggccagcacaaccccggggatattaatcctagaccataatcaaaccaaccctgattatagagagcctgttactgaggcaacagaagtgaattattcccttccactgcttcaagtcttagctcttgaactaagacgagcagtgggacttcaggctttagtaaatttagagtctatttcagtaaatagcttcaaaaaaaaaaaaaacaagaaaatggacatggaaagatgtgttaaaaggctgaatagagcgacatctacatcctcacactataggaaaacacctaaaagacaaaggttggggccaggtatggtggttggctggacgaagtggctcacgcctgtaatcccagcactgtggaaggtcgaggtgggtggatcacttgagatcaagagttcgagacaagcctggccaacatggcgaaaccccatctctactgaaaatacaaaaattagctgggtgtgctggtatgtgcctgtagtcccagctactcaggaggctgaggtgggaagatcatctgagcccagggagtttgaggctgcagtgagccaagatcatgccacagcactgcagcctgggcaacagggtgattgtctcaaaataaacaaacaaaacaggtgaatggataaagaatatgtgatatatatacatacacacacacacacacacacacacacacacgaatattattcagccttaaaaagaaggaaatcaacatgaataaacctgattctgttaagtaaaatatgccagacatggaaagacaaatactgcatggttcaacttatatgtgcaagcttaaaaagttaaaactcataaaagtagagagtagaagggtggttgccagggggtaggggaaatggggagatgttggtcaaagggtacaaaggttcagttatgcaaaatgaaaaaatcctggagatctaatgtacatcatggtaactagagctaataatattgtatcgtatatgtgaactcttctaagagagacaatatcacatggtcgaccttaaatatatacaatttttatttatcaagcatacatcaataaagctgtagctggaaaaagcttcaaagattattctgatagcctatatcagcagctgagagcaaccactagaaagggaaggcaaggcagtttccctttgaaccttgccattcagcatggccctcaaatgggcagcacttgtaccacctgaggtctgttagaaatgcagaactgagggacacatcccttacctagtaaatcataatctgcattttatttttattttttttgagatggagtctcgctctgttgcccaggctggagcgcaatggtgagatcttggctcacagcaacttccacttccggggttcaagcgattctcctgcctcagtctcccaggtagctggattataggcatgcgccaccatgcctggctaagtttgtatttttagtggagatggggtttcaccatgttggtcgggctgatctcaaactcctgacctcaggtgatacatgcgccttggcttcccaaagtgctgggattgcaggcatcagccaccacacctggcataacgtgcgttttaataacatttgattcgaaagcattaattttgagaaacactattgtagaacatatgcggtttttgtttttaagttccttatactgttctttttttttttttattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgttatgttccccttcctgtgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgacatatgcgttttggttttgttttgtttttgaggcagggtcttgctctattgcacaggatgaagtatagttttcttggatcactgcagcctcgacctcctgggctcaaatgatcctctcacctcagcctcccaagtagttggaactataggcatgcactactatgcccagctaatttttaaatttaaatttaaatttttatagagatgggggtcttgctatgttgtccaggctggtcttgaactcctgggctcaagtgattctcctcccttggccttccaaagtgctaggattacaggtgtaagccactgtgcccggccaaacatacctgttttaaaagcatcggaacactttcttcaagcaaattcttacacggaacccctctaatatataaaatagataaaagcatcgctatcctgactgataaagagtggccatctccgcttaatatctactggtcctctaacacatcccatcagtctgaaaaccactgttttactatacaagttgagaagacaatgctctgcttgcatgccactgattaaaaagtaggacttacagatcacatccacacaccacatcagtggcatgcaaacagagctgccagcataactcaagatagttttactgagcattcactaactgccagtcactgttctattttacctggttatgtttatccaatcattatggcaacctttaaggtaggtgctattaaatatttttttaatttctcttttaattttttttcccccaggatcagagatcacaatcaaaatcttcatgatctgttctgtaacagcttccaatcacctcctttttaaattttttttttttagatttttaattttcatgggtatatagtaagggtaggtgttattattgtccctcctatcttacagatgttaaggtccctaaagtgacacaggcagtaggtggcagacctaggactgaaactcaagcagattggttccagagtccatggcttaaccctcctactgtttcccagatggaagggatgatcagtactactaagatgaaaatagaaagggagccccatttaaccctaaggttcttaatatatcctgtccataacctgatctatcatcatcataaaggataattggacacttgaaaaaataaaggcaaatgtttatatatcctattaccaacctttcattctgaaacttctattccaaagctggctctgactttcattttaaccagatttcattttgataaaacaatttaggggaaggactcaatatggtccacaaacctgcagatctgatgtaattttattttcttggacatgctgttttccatcttttggggtatatcattagcaaaaggctactctattacaatttttctgcagtccaagcaaattgaaccaagagttaaatatgacagccgtaattcccttatctaatacagagccctttggagcaagactagcaaaaggcaatcatgggcccaaaataatctgacttcaacctactcctgttatttccctttcttctatgccatatgttccagtcacaatggactactcttgtacctttctatctctctttttacatctggcttccttagtctcaaattcctttctccctgatggttgaaattctatttgttcttaagttcagatgccactgtctttgtgatgctttcctcaagagtgactcagttagaaataaacatatccttcttgctatcctcagctctgttcacgcttcattttgacattagtatcagggtacactgacaggtatttgtgtatgtatatgtctcctccactaaatagattccttaaagtcaaacatcacgtctaactaatatttgcatctgcctagcattaatgccttgctcaaaggtagcatggaggaaaaaagaatttaaaaaagcttatacacagcatggttgtaagctgacaaatttccttctacaattcttaagacctaataagaactctagttaacagtggccccaattttctttctttttttttttttgaaaggaagtaaagtacacttggaagaaggccaagaaggcaacttaagatatcaagtgtgccaatccaatttgcttttcattccatggggcattttcagaatacccagcttcccagtatcttcagaatcacagcttccaaaggtaacctgcatttctaagagaggccaactcataaatgacagaatgtctgctcaggataaatcttcccccagtgaggcactgcgcttggatagatgactgagcaagttacacaacccagggtctcaaatgtcattatgtatggattacctggatttaattctatattacactattatcatatgttggtagagttcaagatttgtctggatttcagtatttaacaattacaccacatatagcataagctgattaactctttccaagtactctttattgtataggaagtatcaagtggcctatttccttaaactacaaactcagttgctagatgcaataggaatgaaactcaaaagagaagactcagagataagtcatctgtaataagttaaaagctctttgctactagaatacagagaagagtccctaaccatggtaaaactggtggtagcaggaaaagttctgcctgacatccagctggataccaccatcccaaatgcacagggattatgtgttcccctagtatgcccaacagccaagatcctataggtggccaggcgtggtggctcacgcctgtaatcccaacactttgggaggccaagatgggaggattacttgaggtcaggagtttgagaccagcctggccaacatggtgaaaccccatctctacaaaaatacaaaaattagccaggcgtggtgatgcgcgcctgaaatcccagctgctctggaggctgaggaagaattgcttgaacccggcagctggaggttgcagtgagctgagatcccgccattgcactccagcctgggtgacagagcgagactctttttaaaaaaaaaaaaaaaagatcctataggcgattcagtaaatataaaataaactcataatgacatttattgatctatgatttcctcacctatttatgtccttggcttctgcccgtggcaaactaaaaactcctggcttggaaattaagcagtctcctcttcactatttttgtttttcttagtgcccatttgttacagcaaaagcactctccttttaaaaatcccctatctagaaatactactatttggatgccatgtgaaagaatacaacatttctgaatatagtctatttggaagaagatctgatatatacacaagaaatttaaagtcagatttttacccaagggaaaaaggaagcgatcaatgactttaaaaaatactgtgcaaatagtaatgtccaaaactagtatttctcacagaatggaaacctggccatagagaagtatgtgaattcttaatgtcttctagttctgccaagtcccagaaacagacagccagccatggctaaggcacataacaacaacaacaacaacaacaacaacaaccaccacaacaaaaacccaaaaaggctgttggatgaaagagagttgctcacatactccacagcaacacagagctttgatacccgcaatgtgagtttctaactcttactctattggaagcatttctttctctctttgaagagggtatacgatttcaagagaaaaaggaaaatcctgaaataaaaacaaaacaaccaacattttgagacttaagtttgtgttttttcttaagatcaagtatactcaatggacaggatctattcagaaggtcccactgcaagatcatgtaccaggtcatgctttaatgctgaaacatggctttaatgaatgttaatactcagagtttctattatgaaagtgactgaaaaacactctttcaaagataaaaaaacgcagacctagtgctgcaccatctcaagtcgtacaatatgtttatatttcaatcaatgattaaatatatggtaaacactttgggcattgtaattccatgctcataaattaaattctatttcagtactaatctcctggaatacagaatgtggttcatttgagtgggtaatattaaaacaaattaaaaatgaataaactttaagaaattaaaggaagaaccattagtgtagtattaaggaaaccagagaagaatttcattttagtttttaaaacatacaaatagttgcaacattttctggtttcaacatccaagatgcatgttatacatatggctaagcaatgtcagcagttgtgaaattcaggctttgaatttgcatttccctaatttggaattccccttagaaatacatctatgtttagagaggttctcaagctgcttgtttgcaaaacctacccactaggtccataacccaaaaataactgttggattatagatagagaggaagtgatcctggtgggtagagtttacagcacttatcctgaacaaagcttatcatactctgaattacttattttagtaatatttaatgagaacctagaagtgtgcgatacaccgagggaaggactataataaaggctgtatcaaacttaaaccacctacactcaccttcacctaccgaagctagtttatttttggattgctcattcacattcccttggaactttcctttcatatgaatcaacatgtaagactatagtcttggaaaagaaataccattatgtcccttaccagtatccttagcatactgctttttctttaattgttagcagctgaagatcactactttagctatactttccctgcctcttgaggacaaggaaagtgcactttacctaaaaagagccccactgcaggaaaagttactcatgttgttttggctgttgggatcatctgtttgaacagaacactagacatgcaggcagtccttttattttggattactactgttaggatatttaacatagttaatatatacatcaaacacaacagcttaatcacctctcttatggtgacttacattcactcataagcacttccatcatttaggaataagtggcctactcataatacaaaccagagagtttagtctgtcaacagcattcaaggggctatgaaacctaagacttagtgctgaaactgaccccaaaaatcatttatgtctcttgctaaaagaagttgccggattattaaaagaaacctcccactgatttcagataaattcattgcaaaattcaacaagccaatcttggcttccaaaaagcctgaaaaccctccttaatgctagccttcattccttctgtactgatatggtccctattgctttattcctagataaggaaaataacagtacaatttccacttacttattacgattccctggtgtagcagggcgagggtatgaagccttacacatgtaaaaacatgagaacatttatgtacttctgacaaccaggtacttctgcctctcaaactttatttatataaagacttattgtactagtttgtgattatctgttctcattttcactctcctgtttctaggtctgtgacctcctgtcccttaaaaaataagtcaccactcagacaagaaaaagaaaaacttcaacaaagaagcaattaaagaaacaaaagctgccttgcacagtcatatcttttccactaacttagtagctgtcaagcctggttgcatattagaatcaccccaggaccttttaaatatcctgatgcccaggcctcatttcaaatgtaataaataagaatctctggaaataggactagaaatccatatttttttaaagcttctcaggtgattgcgatatgtagtcaagttgagaatcactatattaactcaggttgaatagctgttctctgcttttttacgcagagaactaatcctaaatcttgttttccatacataattttagattcctaggctgtgacctactttaaaattaagaaatgtcttccctagtaaaaggatgtaaggggtgttctatttcactggtgtagggcagggggcagaagtccttcacatactccccatgccaggagctaactctgctccctttatagattgtaaaatcaaaaaaaggagttttgggggctgcgtgtggtggctcatgcctgtaatcccaactctttgagaggctgaggtgggtggatcacttgaggccaggagttcaagaccagcctggctaacatggcgaaaccccatctctacttaaaaaaaaaaaaaaaaaaaaaaaagagctgagtgtggtggtgcacgcctgtaatcccagctactcgggagactggagcagaagaattccttgaacctggaaggcagaggttgcagagccgagatcgcatcactgcactccagcctgggtgatagagtgagactctgtctcaaaaaaaaaaaaaaaggaaaaagaaaaaagacaaaagggagttttggggctcccattaagcaggactaacattagtcatggacatctgattcctacaaattaaatgtcaaggtatcctaggtccccaagattccctctcctacctccagtaggtctatcatcctggtcatctgggagtagataaggaccctatgcccttgagacttgagccgagtcagcaggacatcaagggcatacagctttccactgtcagtgatgaggctctccttgcctggggagaagaaaagggggtgagggggaactgtatttaattgaagcgacaaaatcactcaatgcaaagctgtatgcaaccacaatcactaaaaccaagatgcttgtcatcatgagatcagaaaagtgctctaaagggagaatgcaacgccctgaaaatatcacgactccaggagtgccctgggaaaaaacatccccaaagggggaagtgcagattccctgatcactcccaatcagacatgtgctcttaaggcacttaaaagcatccctgctccacatccttactcagaggacaccaggtatacatggacatctatgggtgacatctatgtcaatctgctgttaagtgacctgaaaattttgttttttctttgttcatcctatctctagatatctgtttctgctagttctgaaagcattgagaacgtatcctacctgcctttggagaaaagtaaacaaagagatttataacctctctcttttttttccctttttcaagacagggttccactctgtcacccaggctggaatgcagcagcgcaatgacagctcatggcagcctcgacctcctgggctcaagtgatcctcccatctcagcctcctgagtagcttggactacaagtgagctatcacacccagttaattttgtttctctttttttgtagaaacagggtattgccatattgcctaggctggtcttgaactcctgggctcaagggatcctcccagctcagcctcctaaagtgctgagccatggtacccagcccccctacccttttttttttttaaacccaaaactagctctcttggaggactgcaaataggttgactggtaaatgtcgttaaccctagttgtatgttaattcaataaagaaagcagggcttttcagaaagactgactttgagtttctctgcagtgaagctcctctcactcactaacttgtgctttctctttcctcttctcacaagaaaagcatttcagcaacagatctttaaagaacacttaactcacaaattttcatcttatccagttagtatcatttaactcctatcatattcaggaagtagagtttcctgtttgcagactggtccataaacatgccctgaacaattgctgtcattaagaggggaagagtttaggtttaaggggttgggtaagagtatatgtggaagtggccataggacacaaaaagggagagagaaagaatggagatattatatagacaactaacaactaaaagaaaaacacaatgttcctcctcagtttctgggtttgaacctatggcttttcttcagaaccacagtctgaccgttgacagcaatccaaaagttctcaacagtcattctctgttcttgccacaatttgccaaatgcacaattattgtatacaaggaacaagaacggatgtgctgacagcaccataacaaatcatcagccactctgtttttgctacaaagccacaggtcctggctgtttactccctctgcactgcagcctgccatttcccaccttcagaatgctgccaggccatgtctccttccaccacccgctccctgaagctgtggcacacacctttgttcagtctctttgtttggtcctgtttagattattgaaatgctcttctttttgttggtctccttaccaacacaatcaaatgactgcagctgggacagaattgactgctaagccctctccctggcaccagacaaggagtactgtataaattccaagtctgagcaggcagcaaagctttcataacaacttttaaggttttattcttaccacaattacccttctccagtaattgaattccctaaggtctctcaattttgatagctcctaaacattcaccacagagctaccaatcagctttagacatacttctttccgttctcattaaaagcacaaggtgaaaaaaaaaaagaccacatatttttcagcccttgagtgagggtgggcaagctaagttcgtaagatttctgtagcctgcttatcttctttctccatttagatatactctcttagcacaaatgttaatgcatataaaaatttgttttatgtctgaattttgagaaacttcaattatttcaaaatcatgattcaatggttttcaaacagtcctgcctcccacatctactttactttgctaatcagaatgaactgttcctaggattagaaaagctcagaaataaagatgtgcatatacttataaagacagaactctaacatgactaaaggaggcaagaagtggtacctgctgtcagcttgttatcttgttattgtgtaggtggggaagggagaagtggatggactggacttctttgtactgccctgaaggaaaatgactaagaagaaacacttcagcaacagccttaaaacacttcagcaaaatgaacactatctctgatttgctggtgagcatggagaaaatcagtctctagtatttgtccttagtaagatatgcaggaaaaacaggtttctttctctgaacacactagagtgacttctggggctggtatttgttagccaagtttttagcagtcacttaagttgcactggacaagagctccacctgtcgctaagcaggatacagagacacaaggaacacacttctctggaaatccagctgattctgctaagtcaaacctgtgcccagacccttctttaaaacaggagctttctggatcattgggtgttaaaaataaataaaataaaacaggagcttaaaaaatgtttaaatgaacaaacctatcctactctcttacaaactttcctacaatcctatagtactttcattagacacaggtttttaccatccacggtgtaagatcctgttcagagataaaaagaatgtagcctatggcagtaaaattagggcaaaagattaaataatatctcatttttccaaggaaaggggacttttgaagggattgtacatctttctggtgaaacatggagaagaaaaggtgtgaaacccagaagattttggtcagtctctcaaggaatatggaagcaacccttctcagggaaagagaaaacgtaaaagtataaaggaaagagagatgataaagggttccagtgagacacccccaacccccgccctgtcccagctagtctacagagcacaatggggtgaggagctggttggttctcacagtaaacagccagtgaggctggtgctttttatcgatgcaaaaagaactcagacgcttcctgctatttaaacaaggtccatttttctttcaaagaacaggaaaagccacaagagattcccacaacgccagcaataagccatctactcctgtaatgggaacttaggagccagaaccaagaagggagaaaaaagaagtaaggtgctatcttgcttctttcaataacggtgctcatctcttgcctgggattctgtagtttccttaccagcttgctttacacttaggttcccccactgattttcaaacaatatatttccactcactgcatgtgctttaagtcagctacaaggccatgtgtaatactgccttcagatacgcagaaagacatcttggagttctcaaagcactaacaggctggggcaaaccccttgacacttgacaaagttaaaataaagtggaaaaaccaggccttacacactggaatccagttatctcttagagacagaagaagacctctgttgaatgcttagctctagtttatttccattacatgccagtaaaagggatatagttggccgggcgcggtggctcacgcctgtaatcccagcactttgggaggctgaggcaggcagatcacgaggtcaggagatcgagaccatcctggctaacatagtgaaaccccatgtctactaaaaatacaaaaaattagccaggcgtggtggtgggcgcctgtagtcccagctacttggaaggctgaggcaggagaatggcttgaacccaggaggcggggcttgcagtgagccgagatcacgccactgcactccagcctgggcaacagagcgggactccatctcaaaaaaaaaaggaatgtagtcaaaatgtcagagattttggacaaccaaaactaacactatagctccaagctaccattccagtttgcctgcaggtgtaagcaaagaacgtgagcctatgaattatctgtgttcagtttccttaaaagtagtctcactaaggcaaagatgaaaacctagtttcctttcaacccccgactttgaccctaggggatctgggaatctgctagtattttggcatagaatgcactgtttttcctcttgttatcattcagatctctagtgcttcatgtaggacactgtttatgctatttaaatgaggctttctgtgagtgacgacattctcattcattccactggcaatggcacaagacaaccgtactcattcaacctagagcctttcctactaagtttatttctacctttttttttttaagagtggcatttctttctcagctgtaagcatgtcaaaggagtgtatttaagcacaaatctaaaaacatttctctctccactcatcataaattactaatattcttacctatgaattactaaggccaaaaaaggaagcagaaacctcaagaacagtaaattccaaatatctgaaaggaccacatgaagataaccctggttctccccttgccaaagcgaggaacacattccaagaggattgagaactcacctggaatcctgatgaaagaccagccattctgaggtctgatgctccacagacctccagctggctctgggaagaactgtgatcgtctatttagccagtctgcagccagttcaggggccccattcaacaaacactgcttggctgccagactccctccttccttcagaactcgcctttcatattctgcacttcggtcattgcagtaagaatccaatggcactgcggtaacctgcagttaaagattcacatgagatggctctttcacgttgtccatacacactatgccttttgggaacctcaactttgaaatcagactaatgtggatagttcttagactagtggttttaaatatctgttctggcacactaagctgtccctaatgaatgacttagtgagcttttccagataaaaagccaacctcttataaaatgaaacctgcaaacaaactaaagatccaaagagagctggagtttgcagataaatgagaataccaggtcagcaataactctattatatgcatatatatctgatcattttgccacctccccttcactgctagatattgttcttggcaaagttctcttaaccatatgcatgatggtgatgccagaaagggagctgcagctagtcagacttcatttaaaaactaaagaatattggcctggcatatttgaagtcatctttaatgcttttgtggcaaagctcccaaatttatcaacagctttctcctcttccctgaccaggttgctgactgacaaacctaatggaagagaaactttctttcaggccataaactggggaagggggagtgcggaggcaggggagggtagggaagcaattgccagagagtagcagatttgtttcctggcttggccaaaggctatacacaaattcttatctcaatacaaggtataaccaaacaacactcagctgctgctcactcgatggagtagagggctcctgccaattcagaaacacagattttatccttctttggctatctgggtttattcctactctaataggcagtattcagatacctgtgaagtcaactggtaaggaacttgaagatgacaaggctagcttttgttaaaatgtggaggctgtgattatctgtcaagcccacgctgacaaatatgctgaaagcccatttcaggttgaatatccctaatctgaaaatctaaaactttgagtgcctacatgatgcactaaggaaatgctcattggagcattttgggtttgggatttttggataagagatactcaatctgcatacgcagaattgctcagaagaaccctaaagctagactaagacatggggagaaacagcgtatgagaagcaaaggccacagcacaggagagatcagaacataaaacaccggctgtatctagttaggtagttctatcatttcgtggaagttaggcaccaagggaacttgatcttgctattaacttttctccttttgtgttgatcaagctttagggaaatggctgtcaggttttggtacacataaggacctcctttgaagcggaccaaaagtgtagattttgaaccagaagaactgagggaggggccaatagacctatgtttttgacaagcaccccagcgtcccaagttgaaccttgagaaatactgccttgagacatatgaacagctgaccatgggctgtaggtgcctctggagggtaccaacgtgacagaaagagcatcatttaccaataaccagagagtactctggcttgcagatgaagctgaactgagtttgctagggagcagtgccatctatggtccagatgcaaaactacagagggtcacagcaaactgggcctggagttccaaaaccagttcacaacaaaaatagtttatccaaacaatactagaatctcatatcacctttatcctctccaaaaggaacttgttttcggctgagcatggtggctcacacctgtaatcccagcactttggaaggctgaggtggcagatcgcctaaggtcaggagttcaagactagcctggccaagatggcaaaaccccatctctacaaaaaatacaaaaattagcctggcatggtggcgttcacctctaatcccagatagttgggaggctgaggcacaagaatggcttgaacctaggaggcagatgttgcaatgagccaagactgtgccactgcactccagcctgggcaacagggtgacagactgtctcaaaaaaaaaaaaaaaaaagttaaaaaaagaaggaacttgttttcttgcttccaacttattcatttttcccactaatacatgagcatgggcaaataaatatggaccaaaagaaagcaaataaatacaggaatacaaagcaggtggatgaaaattgggtctctctcccttctatgacttgacatggcagtatcccagcagatcgtgggtcagagcaaacatctcccatgtaggatgtgtgtcgcagacctgcaaaattaatagcagctatacttctataaaaagtttaaaaagtaagtctagactatagaaatatgaccagttctatatgtcttgaacagcatgcatactcttagataagtaaagcatatttagtcttctctagtaagactaaagcgcggtggctcacacctgtaatcccagcagtttgggaggccgaggtgggtgaatcacctgaggtcaggagttcgagactggcctggccaacatggtgaaaccccgtctctactaaaaatacaaaaattagctgggcatggtggtgcctgcctgtaatctctgctactctggaggctgaggtgggagaatcacttgaatccaagaggtggaggttacagtgagctgagattgcaccactgcactccagcctgggtgacagagtgagactctgtctcaaaaaaaaaaaaaaacaaaacaaaacgaaaaaaagaaacaaaaaaaaacaacaaaaaaacctcatacagaccaatttttatactcacagataaccgttttgatttaaaaatttttatttatttatttattttgtaaaaaagcagaacttatattggaattatacataaagactctgggctcatagtctcgagatgaaaagccaaaagctagaatctcagcatgaaagaacagagaaacaggaaaaatggtttttctgcctgggattcatttctaggcactcttatagtttaaaaacaaaacaactttttccagttataaactttcatctatttttcaattttcattttgatgatacccttccaggtctaggattgaatgcttaagaggtttgcaagacactgttcttagtgaaatatttttcagtgttttgagaggcttctttggccaggagcccaggatcaagatattaatatattcagaatcatacaatgtcatgttgtaagtatgtaagcaatgtacttatgaggtccaaaagagggcaaaaatgtccaatatacttagagtaaatcctgctttctaagtcagctgtatcccagacagcctccccctattctgctaaccccaagtgacctcccgatttgatcagaaggagagatgaagcatgacgtaccgttcttccctccccacaaaaaatgcatactctccctcgtcctacaggagctaacccctttcttgcttcattaacctctgaaactacagtaccttcaggggctgcccccttaagcgttcagcgcgtccttcctgaggacacgtatgttcctgctctagctgaaggaagcgtaaccgctccaagcgctgcagtattttggtaagaataattcctaaggccttaatttattaaccctgcagaattatttcctcagctaatgataaaacagctcctataattccttccatagtggcacagttcttcctgaactaaccctcaagttttcatagcatgtgtcagagaaattaatttgcctaattcaaggccagggttggcttcaaaggacatcagtttctctctccccaatacagatgggttagaagtcaatataagatataattagggtatctcatgaaattttgccttattcactgatctgaatccctaggactgatctgaaaggtaaaagttgtagatctgtgtatgaaatagagatatctaaactcttcttcctgtcctcctaataatcacggtgtaattactcccattttcaggtttagcacatactatgtaaagaaactctacaaacatgggaggggccaagtgggaaaggagcaccctttcagccaaacgataaaagctttctcctgctccctgcttgccaacacatgttcacagcaattagagttttcctcaagctacatttacttttcttgagagaaacagcagcagcaggcatggtagctgggatttctggctcctctaaaaacaatactgaagtagtatagatggggcatgcatgtgtgagagagtgggactgttcttgagagtggtgggttatagatatttggggagctccaagtggtaaaaaatgaagaactttcaggtcaacaaataaatacaattacaggccaagagagctcatctttattggctctttaaacactgggaacaggctgggcacagtggctcaggcctgtaatcccagcactttgggaggcttaggcaggaggatcacatgaggttaggagttcgagcccagcctggctaacatggtgaaaccctgtctctactaaaaatacaaaaatgagctgggcgtgatggcatgcacctgtaatcccagctacctggggggctgaggcacgataattgcttgaacctgggaggcgaaggctgcattcaaccaaggttgtgtcactgcactccagcctgggtgagagagcaaggctccatctcaaaaacaaaaacaaaaaaccccaacaaccaaaaaacaaaacactgggaacaggagaagttaaaaagacttgatgtgcctctctcagaaatctaaacttccttttattaggtctcttggtatacacctatcatactaagagaacaaaaccaaccacacaaccatgaaagactgaagcctgccttctatggaagctcttggctttaaatgcttcctagaaaaagtgcatttccctgcactaacttaagcttctgagaccaagaatactttggaagaacaggatatgtacaaaatccaaatactttctggatagccagtataaaccaaacaaagttgatagtgacaagggaattaaactcatatagcacaggagcagcagacagaaatctaggcaggcaggagtcaacaggattcatcatctttctaggggtcccctgtcagattctgtcttttgataaactgaataaagaacgcaagctgataaaaaataatggtagaaaaatattaacaagggagacagaaaaggctccttcttcttttaatagaactgtgaaaacaggctgggcacggtggctcacatctgtgatcccagcactttgggaggccaagacaggtagatagcttgaactcaggagttggagaatagcctgggcgacatgacaaaacctcgtctttacaaaaaatttaaaaagtagccaggagcggtggtgcgcacctgtagtcccagctacttgggaggctgaggtgggaggatcacttgagcccaggaggttgaggttgcagtgagctgaaataatgccactgcactccaggctgggtaacagagtgaaaccctgtctcaaaagcattaaaaaaaacaaaaacaaaaaaaaccaacaaacctgtaaaaacagtacacttgctaagatgagtggagaaacaagagaaaaacataaaagggtaagaaatgtcaacctcttagagcttcctggctaacggaaagttgcctcttggagcaaaaagaaatgaactgggaagacagaaattcattcttggctctaaccacagaacctggccacagttcgattatttcccttcttggtagatcttttctctggctctgatcaacatggataaaaaagaggatggaagatgtaggcaaagtaaataaccccagtgtgccaattaaagcctttccagcaatgcttgtcagcaatggcaagagggctctattttgataaacagggtattaggaaggatgcagacaactgctaaagttgaaaccacaatagaaactaagcccaatctgcaaacaacagtggacaaatggtgaatagcaaagaagatacaacagtcacttttcagatggaacagacatgtgaatgacagtccaagtgaggctgctttggaaagcaagaaaacacaacactgagaaggttcttgatgctggagtgttatgtttccttttgttatctggagactgtactgaggtgatatgaccggatcaaatctcccccaatccttaccaatctgacgccctctcatgaaaaccctcaaaacctcaacacaggtgacaaatggttccctcgccccgaccctgctattgggtgatatatattctacctgacagatggtttattcccactatagtttagagcccctgactaaataaaaagaagctatcgaccatacaactattcttaaatcaacaaatgaaggtgaatataagtgttgtctggggcaggccagaatcacaaatgcccacattttaaaatactagaatttatatgtttcttaaagtccaaatagtttaaaacaattctgtttaagaaataaatcccttaaaaattggtttatttctcctattgccatctatttcatctcttccctcctggagcacttactcgtggactggccacacacaaaaaagatggcagctcagtgagcaggcagcgacgcagcgaggaggtagctgatctccgctgatggacaacctggtctgagtagccactcactgctttacagtggctgctgaaaacaagagactgcaaaataaaaatgcaaatgaatgccaactataattatgtttaatgtaagcaaaatgaaaaaaaaagccacatattaaacatctaactttaagagctttcttccctgtaaatactattaattctaataaacaaccactaattagaaccaagtatataatacagttgaagcccatgttaatttcaaaatgtggttttattaatataccttaaacaactgtcatttataattctacctttttctggaagagatattgttaatcaaaaacaggcacagcaaaacttcattagacaaatcacttgtatgggaatgtcaggggaagtttggttcatctgttgcactgtggatgcaaactcatgtcttgtgttgaaaacaatgatgaccaacacaatttccttctaaatttttttttttttgagacacagtcttgctctgtcacctaggctagagtacagtggcatgacctcagctcactgcaacctccacctcccagattcaagctattctcatgcctcatcctcccgagtagttgcgactacaggcgtgcaccaccacacctggcaaattgttgcatttttggtagagacagggtttcaccatgttggccaggctggtctcgaactcctgacctcaggtgatccgcctgccttggcctcccaaagtgctgggattacaggcatgagccactgcacctggcaatttccttctaaatttttctttaaggcagtttagcaccatttgttttcttattaatttattcagagtaatcaatacaaggggtcagtaacaggaaattctatctctttagtgcctctgacaaccatttaaaatatatttattgttcacttatgttgccgtatcaaaaatgtattttaggccgggatcacctttaggtgatcacctgaggtcaggggtttgagactagcctggccaacatggcgaaactctgtctctactaaaaatacagaaattagccagcatggtggcggatgcctgtaatcccagctactcaggaggctgaggcaggggaatcgtttgaacccaggaggcggaggttgcagtgagctgagatcgcaccattgcactccagctgggtgaaagagtgaaattccgtcccaaaaaaaaaaagtattttaacagacttcataactcatgttacagcttcaggtcacagccagtcatatgaaagattttaagtatgaaatgttcacatacaaatcactcctcagtgggacatggtgttctatataagaaatgcagaagttccttcctcagtatgttattcgttttatctttggatctgcattcttatttgttttactgatatctcaataaggcaggttgatgaccaaaataaccatgtagatgaagataacatacaaggcagtctaatttatacattgttgtaaggtcaagaatacaaactgcaagatcagaacagcaacctggatcctctgtaagagaataatagttataataccagtaccaaatcactctgaggataatttgttcagctcatatcctgctcttccacttatacagctttattttccacagggcttacatctctgtaaggaaatgggttcttaaggctcatagtttgaaagcagtgatctcaagttgtctagtacgacatatgcactgttatctgtttccctgaaccaatcagcatcttctaaataactgtcatcaacaatttgaagactatagctattttccaggatagctgggctgtctttaggtggtttctgactacagactacagaagtgtttacaacatttgatatactgctaggcccatgtagctatgatatgtttggccttttctctaaatgttgaggtccctgtcattacccaaagaagaattttaacattctgacagcttttcaataacatctgtgttcccatcttgattttgggtagcatctccgttgaagttcattatctctctacatgtttatgcccattatcacttgaatgtctaacatgagtatcgttacaaagattagcaggctaggtgtcagactgttcttccaatactgaataattaggaggaaaaaggtaaaaagatgtagccacgttttttgtttgtttcctgaaagtgcatttctgacatcagcagtagcccatcttgctccctcactggggaggagagatgacaagtctagcaacttctgctcatcaccgccagctaagtagtagttcagggctgccagctgggacatccactgtcaatcagaccattcctgggcagatggctgaggcagcagcagtagctgacctgaagacttctgaattcttactaacttctacagaccagtcactaaataatgtctctatcaggtatcgcattaattcatcttcattttgagtattctaaaattcaaaattcaacagaaacctgtttcttactttgttccaataatataaaggtagaaaataaaagaatgaacatttcctccaattatcttctcttcagcactgtagttattactaagaaaagaatacaactcaccatagggagttcttttaacaaagcacattatttgttattacctttctggaaaaagtctgactagcaataattctattcccaggggtggtcattcccaaattagaacacattcatttatttttatttttgggacagagtctttctctgtcacccaggctggagtgcagtggtgcgatctcggctcactgtaacctctgccttcccaggttcaagcgattctcccacctcagcctcctgagtaggtgggcctacaggtgcgcaccaccacgcctttaatttttgtatttttagtagtgatggggtttcaccatgttggccaggctggtcttgaactcctggccacaagtgatcccctctcctcagcctcccaaagtgctgggattataggcatgagccaccacacctggccaacattcacttattttattttatttcttttggagacagagtctcactctgtagcccaggctggagtacagtggtgtgatcttatctcactgcagcctctgcctccagggttcaagcaattctcctgcctcagcctcccgagtagctgggattacaggtgtgcgccacacctggctaatttttgtattttcagtagagatggggtttcaccatattggcccggctggtctcaaactcctgacctcatgatccgtccaccttggcctcccaaagtgctgggattacaggcgtgagccactgtgcctggctcattcacttattttttatgagctgggttaaaatagtattctcattgaagttgctaagtcaaggtgatgtatagctttctgattccaggttttaaaaaataataactatgttcaaaatgctcaacatatagcctcaactttagagaaaccctgactacccctagaatgttttacccaatatatacttttctagattcttttctcttaacattagttccatcaaatctggtttagtatatgtgaaccttggtaccaccacactatccaatttcccttcatgtagcaacatgaactgctagacattgctagatatagaaaaatgtatgcctgacatggaagaatacaaagaataccttaagcaatattgtagatagaaaagaaagtttgttcattacttctttagtctaacttggtcatgaaagaaagaaagaagaaaagtgaaagagaagggaagagggagaaagaaagaaggaaaggaggggaaggaaaagagagggaaggagggagagaaggagagagggaggggaggaaggagaaggaaggaaggggaagggaggaaggagaagggaggaagggaggagggaggaagggaggaagggaggaagggaggaagggaggaagggagggagggagggaggaagggaggagggaggaagggaggaagggaggaagggaggaagggagggagaatgccatactatggggaatttgacctggttttcacgtggtcacagcttttgctattcttctgtccctttctcatgctcttgaatgtctcattaccccggaagcactggcagatgtgtgcgtcttgccgccaggactataatatgcacacagtagtgaagtcagccttttctaaagactcttttcgcaccatacaaaagtctcaagtgaaaataaataggccaggatgacaggctccatagctgcatactccttgccacagcacagcacagcacagcacagcacagcacagcacagcacagcacaggacagcacagcacagcacagcacagcacagcacaggacagcacagcacagcacagcacagcacagcacagcacagcacagcacagcacagcacagcacaggacagcacaggacagcacagcacagcacagcacagcacagcacagcacagcacagaaaacacaccgatgtttttccctcagacctagacttactcatttaataagaggtcatgctttgtactacatgttttatttaaaattaaaaatgcttatgttaaaaatttaggtctccagtactcaaaattagctttctacatcttttcttaaagagcatgtcaaatttagatacagaggaaaaagtttcactttaaatgaaacagcacagtgttgataaatcagctcttagattatacggattatatttccatggatattttaagcatccaaacaaaaagagggaaaattaatgcagagaaacacaatagtttcccagagctttccataaggggcatttgcagcactcacgatctcaggaaatgatgatatagatacaggtactgtagctgaaaactaacatttagtggaagagtttttgaaaacttcctgtttggggggtgaaatcttcaatcaatagcccgtcaaaaaactctaaggatttaatacagaatagtgtttaaaacttcaacatatgccactctcttcaaaacaactctatgtttagaacctttgtgtattttaaattgcaaaatctgaaatgcccccgatttttaggagtcacttgactcactagaactgtagagtatataaaatgttcaggccaggcgtggtagctcatgcctgtaatcccagcactctgggcggctgaggagggcggatcacgaggtcaggagttcgaaaccagcctggccaacataatgaaaccccgtctctactacaaacacaaaaattagccaggggtggtggcatgcgcctatagtcccagctactcaggaggctgaggcaggagaatcacttgaacccgggaggcggaggttgcagtgagccaagaccacaccattgcactccagcctgggtgacagagactccgtctcaacaacaacaacaaaaaaacaaacaaaaaaaactttcagcacgtactatgcataagtagaccattaccatgacaacagtttcaatgagacagacaggagacagaatcaatactggtactgtactctgtgtctgccaaccatcatttttaatttttaacatgacatttaattggaatagactcaaatctgttctgccccaagaaagataactaaatggcatatttacgacaggctctcttttttgtctttattcttctaagcaaaataaaattttatttttctatctctgctgcctgaatcagaattttttttttttttttttggagacacaatctcgttacccaggctggggtgcagtagtgtgatcatagctcactgtaatctcaaactcctggactcaagggatcctcccacctcagcctccttgagtagagagacagagtgagaccctgtctcaaaacaaacaaacaaacaaaatcacactctttatccactgcaaaacagtgtaagaaaataactctggccagaggtaccacagtgtgcagggaaggtgtgcgaaagttctgacccaaatctactcattcctgaaattcttaatagcaatgcagggtagaacacaagaaaattaagtagaatacagggagccatgctagtttttgttctacaaacataagagaaggaaatctctgaaaagtattcacatcaattaagagattttttaaaaaccccaaacttaggccaggcgcagtggctcacgcctgtaatcccagtactctgggaggccaaggcgggaggatcacgaggtcaggagatcaagaccatcctggctaacgctagagtagaaaccctatctctactaaaaaaaaaaatacaaaaaaattagccgggcgtggtggcaggcgcctgtagtcccagcttctcgggaggctgaggcaggagaatggcgtgaacctgggaggcagagcttgcagtgagctgagatggtgccactgcactccagtcttggtgacagagcgagactctgtctcaaaaaacaaacaaaaaaacccaaaactttatccaaaacacctctaagtatcaaccgatctgtgtccttagcctagttcttagcttcttgatgtttatgtgtatcatcctgaagctaataatacaagaatggtacttctttggattctgtaacaaaaaattcatattttatcttcaccatagggtgggtgagtgcaagggttttataggcacattatggggttgggggaggtaaggagaagagagcttctcactgtttggattcattcctttccctggggagtaagagaagaaggggaggactgggttagactgctgaatatggctcaggtagtatgtgacctcacacagcttaccaagaccaatatgacaacatgtagctaagtgaacactgatctgtctccacagaggaagaaaaacaaagtctttaccttgatctgatgataggaagttatatttaggagacaggctacaggaacaataactctctttatacaacaaatgaaggcgtagaaggaaacagaatgaaaaattttctgccttaagatgacaaagctgaatatggggaaattaactcaaaactaacttgttagctccaaaggagctttagtctaaaatattatttgaatttcgtaagaaaaagaatgatgagaccccttccaacttttacatttccccatgtctcttctcaggtttgttggccgaagaataaccccaaactttttaagactgatctggaacatggaatctgggttcaacttgcatactcttccattaaaaccttgaaacataatttgtcttcactggagaactgcttctcttctgcattatgtttccaaataattaaagttacataatcagaactaatgtggcaaattaaatgaaaatacagagcttgcaatgaaaagaaaaaaaatgctcacaaggagttaagagtttatgagtaaagaatccctgctgaaaatgaaacctcgttattatactatagttactatctttcccagctaacatttgctgtgaagaaacacgggtaacagagcacaaggatagagtccaaaatcctttctagttgaaaaactagttaagaactagtactacagtcagaaccatctacagtctaagccagaatctcagaacaggaaatccaaaacaaatttcataatgaaatatctgatataatgggatcagcatggaaataaggggctgtggtagttttatatggccacaaattccttggccaggtgtgatggctcacacctgatcctaacactctgggaggctgaggcaggggaatcccttgaggccaaaatccaaaaattagctgggtgtagtggcacctgcctgtaatcccagctacttgagaggctgaggtgggaggactgcttgagccccaaaggtggaggttgtagtgagccatgactataccactacgctcttgcctgggtgacaaagcaagactacatctctaaaaaaaaaaaaagaccgggcgcggtggctcacgcctgtaatcccagcactttgagaggccgaggcagatggatcacgaggtcgggagatcaagaccatcctggccaacatggtgaaaccccgtttctattaaaaaatataaaaaattagctgggtgtggtggcgggcacctgtaggcccagctactcgggaggctgacgcaggagaatggcgtgaaactgggaggcggaggttgcagtgagccgagatcacaccactgcactccaatctgggggacagagtgagactctgtctcaaaaaaaaaaaaaaaaaaaaaaaaaagtctggcgccttggcttacacctgtaatcggagcactcagggaggccaaggtgggcagatcacttgaggccaggagtttgagaccagtctggtcaacatggtgaaaccccatctctgctttaaaaacaaaacaaaacaaaacaaaaaaacccataaaattagctgggcatgatggcccacacctgtaatcccagctactcaaggaggctgaggcaggagaatcactggaacccaggaggcggaagttgcagtgagccgagatcgcaccactgcactccagcctgggcaacagagtgcaactctctctcgaaaaaaaaaaaaaaaaaaaaaaaaaaaaacccaaaaaaaccacatagctaagctgctcccaagttcccagccaacagaaacagtgtgagatatcaagtgtttattgttttagtctctaggttttaagataacatgttatataactactactacaggggctaaaatccatagttgagctcattagcaacctctattgcaagtttctatagattcacttctctctggtgttccttactacccaaggaacgtgtcacctctagttctcagatcaaatgcagggcaaaaataactaagtgcaataagatcaatgaatgatcaaacagattacctatcctgcccactttccctaaacccctagaagttagtgctcttcacaaaattctatttaaaatattaagagtaaaactgtacttttaattttaggctagaagacattccctcagattaatacataccatgttccaaagattagtaccaatccaccaatattgttattaatattaatactggtgcattaatataatgtgccattattcactaggtcattcagcaaacacttatttaaccttaaaagtgcccaaaataaccagaccacaaagggaagatgaattatataaaatgtccaaacatttaaattggttttagccaggcacggtggctcacgactgtaatcccagaactttgggaggccgaggcaggccagttacttgaggtcaggccggttacttgagatcaggagtttgagatcagtctagccaatatggcaaaaccccgtctctctactaaaaatacgaaaattagccaggtgtggtggcagatgcctgtaatcccagctacttgggaggctgaggcaagagaatcgctcaaacccgggaggtggaggttacagtgagccaaggtcactccactgcactccagcctgggtgacagagcaagactctatctcaaaaaacaaaacaaaacaaaacaaaaactaaaaatagattgatttctcacttgaaaaaagaacaaaaagagagagaaagagaaccacttaataggactttttttttttttaatgttaagcttaaggccgggcacgatggctcaagcctataattccagcactctgggaagctgaggtgggaaactacctgaggtcaggagttcgagatcagcctggctaacatggtgaaaccccatctctactaaaaacacaaaaattagccgggcgtgttggcacatgtctgcagtcctacttgggaggctgaggcaggagactactttgaacccaggaggcagaggttgcagtgagccaatatcgtgccactgcactcgagcctgggcaatagagcaagactccatctccaaaaaaattaattaattaaataaaataatgttaagcttagtgttagttgttctggacattttaaaacattctttgtggcagagaaatagctttctgttaattatacagcctgccagtattcacaagagtttttcatcctattaaaaagtatagttgggctgggtgtggtggctcacgcctgtaatcccagcactttgaaaggccgaggcgagaggatcacttgagaccaggagttcgagaccagcctggcccacatggcgaaaccccacctctactaaaaatacaaaaattagcttggagtggtggtgcacgcctgtagtcccagctactcaggaggctgaggcaggagaatcacttgaacccgggacgcagaggttgcagtgagccaagattgtgccactgcactttagcctgggcgacagagtaagactctgtctcaaaaaaaaagtgtagttaaccaacttgcgcacccccaccaaatgcctctcttgcccctcttcccttttctttttttttttttttttttttgagatggagtcttgctttgtcgtccaggctggagtgcagtggcatgatctcagctcactgcaaccttcgtctcccgttttcaagtgattctcctgcctcagcctccgtagtagctgggattacagccacaggccaccatgcctggctagttttttttatttttagtagagacagggttttgccatgtttgccaggctggtctcctgacctcaggtgatccgcccacctcagcctcccaaagtgctgggattacaggcatgagctactgcacccgacatcttcccttttcgttgtgaaatctgcaagactcttttctcttaaaaaagtcaactttcacttaaaccaaactcccctcctgaaataccttactttttaactgtcacacttcaatactcattctctacacctcctaaccaggatctttctccctaaaaatccttacaactgggcttctgccttctctttttaatctgtactcacaatcaaagagttcttaatctcactctttagtttttgctttaaacttgatatggaacttaagattccctctggatcctctcttgaactctggctttttgaagtaatttttccatctccagtgcccatccatatccaaactgatcaaagtcccttgatcccttttctataatctttctgttacaaccattgctatcgggtctttagtacctgacacttgaaacttttgcttaacatctgccttaacatggattgctgcctccattcttcctgatatcacactctgaggttaatcttcataaaatacaaataacaaagatcccaactggtttgatataatgactctggtaatttagcagccttactgaacctgctaccagaatactacttctcatggcttcacattggctaccaacacttgaccccgaggaatacaactttaagcatctgttgaagaaagtaagacaaatagggctgggacgacaagcttattatctaaacccgcatagggtggcattcaaagactttccaaacttacccttctagacttttctgtcattactgtcctttattttggctcaaatccttaacttggaattatgttcctcctatccaaatctctaccactcaaaatccaactttttcaaaattagagacacagtctcactatgttgcccaggctggtcttgcctcctggctccaagcaatcctcccacctcagcctcctaaagtactgagattaaaggcatgagccaacaccacacctggcctagatccaatttaacaatactatttctataaagtgatcttctcccatctgaactctaccattcattatctaccattactcaggcagttaattgtgtagtatttaaagtcttatcttgaaccacattcagtgtgtgtgtgtgtttttaagcatgagtgtatattttcaatatgtgcatgagtgactcttccaaatacagcacagggataatgattgttaacacactttgcctactgtggtatgcagtaatatgtttgtaaacaacattaattacgtatgtttctccttgctggactggactaacattgggaaaaggctgttctgaaggtagcctagagcaatgaaaaaagaagcaccagacaattcccaaagatcacagtctacactggagattcattcaatcgataagcacttacgatatacaaatccatgccctccacggacctttgaggtcaaataatttaaaatagtttgaaaaacaatgtacagcatgtaaaacacaggaatatcttctgtagtaaacactgagtctccactctaccaccattccctactcaaataaactgctcacatcggtggtttccaaggtaggcacacgtaaacttcacaatgtaaatattaatatgtgaatacatgtatataatttaaaacaaaatagcatacagacattggagaaatagagtacgaatgttgttattacagaggaacataatcaaaacatttggggactactgacctatactacctagactgctaaaaagaggtgagattaaaataagatttagccgagtacacgggctcacaactgtgatcgcagcactttgggagaccaaggtgggagaactgcttaagcctaggagttcaagaccagcctggacacaacatagtgagaccctgctgctaccaaaaaaaaaggaaagaaaatatgataaaataaaatttatatgccaattctaaaatttacatgaatacacgaagggctaagaacagccaaaacaatacagaagaaatgcaaagtcagaggatctgtgcaccagttatcaagacttaccgtgaagctgtacttattaagatagagtagcactggttcaaggatagtcaaatgggttcatggaagagaacagagttcagaaactgaccaacacatatatagacacctgcttgacaagtgatgctacagtccagtaagaatggtcttttcaataaacgggatatggagagaaatagaattatcttcgcgaatttgttggaggcaaagaattcttcaacaggacacaaaaattattcactattcatcagaagacaacattgaggctgggtgcagtgggtcatgcctaagtcccagcactttgggaggctgaggccggaggattgtttgaggccagagttcgaggccggcctgaacaacacagcaaacctaaccctaacctaaccctaatcctgagctacgactgcatcagtgcattccagcctgggcaacagaacaattcagatcctgtttcaaaaaaaaaagggtgggcaggggaaggtaccactgaaaatgagaaagttacagagtagaagatatttgtaatatacaaagaactacaaatcataagaaaaatacagtcagcccaatagaaaaataaacaagaattctgaacaaacatttcataaaggcaattatccaaatggccaataaacaccagaaaaggtattcaatatcattttcacaggagaaatttaactaaagacataataagacaccactacccaacaaagtttaaatgaagagacagacaatgccacattcctgcaaagacgtagagggtctcactctgtcactctccgaggctcagagtgcagtggtgggatcaccgtttattgtagcctcaacctcctgggctcaggcgatccttccacctcagccttccaatcctcccacctcagcctcccaagtagctggaactacaggtacacggcatcatgcttggctaatttttgtatttttctggtagagatggggttttgtcatgttggccaggctggtctctaactcctgggctcaagcgatcatcccgcctcagcctcccaaagtgctggaattacgggaatgagccacgatgcctagcctctacattgttgttaattgttacacctggagcttctagttcttttttttttttttctttctttttttgagacggagttttgctcctgttccccaggctggagtgtaatggcgcgatcttggctcattgcaacctccacctcctgggttcaagcaattctcctgcctcagcctccctagtagttgggattacaggcgcacaccgccacgcccagctaatttttgtatttttttagtagagacggggtttcactacattggccaggctggtcttgaactcctgacctcaggtgctctgcccgccttggcctcccaaagtactgggattaacaggcatgagccactgtacccagccggcttctagttctttattcagaacctaggctaacctttaagagtggataatatctaacgatcattttgcttggctgaaaggaaagatttccttttttttttttttttttgaggcagggtctcgctctgtcactgaggctggagtacagtggtgcactcagggttcactgcagccttgacatcctgggttcaagggattctcctgcctcagactactgagtagctgggactacaggcacccaccaccatgcttggctaatttttaatttttaattttttttttttttttgagacagaatcttgctctgttgcccaggctggagtgcaggtgcatgatctcagctcactgcaacttctgcctccgggttcaagagattctcctacctcaggctcctgagtagctgagattacaggtatgtgccaccacacccggctaattgtttttgtatttttaatagagacagggtttcaccattggccaagctagtcttgaattcctaacctcaagggatccgcccacctcatcctccccaagtgctgggattacaagggtaagccaccacgccccacctaatttttaaaattttttagtagatatggggtctcactatattgcctaggctggtcttgaactcctgggctcaaatgatactctcaccttggccttccgaagtgctaggattacaggcccaagccaacactcctggccctgaaagcagagatcttttaaaactgacagtcttttttctgagagggagtctcgctctgtcacccaggctggagtgcagtggtgtgatctccactcactgtaacctcagcctcccgtgttcaagagtttctcatgcctcagcctcccgagtagctgggattacaggcgtgtgccaccacacccagctaatttttgtatttttagtagatgtggggtttcactacgttggccaggctggtcttgaactcctgacctcaagggatccgcctgcctcggactcaaaaagtgctgggattacaggtgtgagccaccacgcccggctgacagtcttatcattaattatgagaaccataagctctagcaaaatacactacttggttggtatttcaatatacatacatatgttggagataaggatgatgagattgaaagcagaacagtgtctccacacatatataagctttcagctccccgtggcccaatagctcattaattcagtgtatactctaaaccactacaagagcaaattaaaatgagtaaatataagtgaatctttcaactgcgtaaacatattttatgaccagtttcccataaagcatactacccacatctgcatttctcagacggttctaactgatataaggacctcactaagcagacgctctggaacatactacaatattttcagaaaacagagaagaatacaaatgagtgatgcatatctctagcgttaagaaaaatgcaggtgtccatataacagggaacaacaatgtcttggaagaatggtgctttttgtataaaaagcagaactgataaaaatgtattacagtagtaacatatattaccaaatttaggggttgagagaaggaattaatctttacagaagattaagcaactcttcagacataccagtgttcccagtagacatactaggaatatttcaccagcaggaaatcaccctgccaccactgacagcattactccaaacaggctggaatccaattacattaatttgcattactgattccctctccaaagtccaaaaattacatgaagcaatgcttaagaaaccaactgggaaaacagaagagaaggaaatcatgtgagcttttcagtgtacagggggcaaatactgaatgagctagccaaagaatgtccttcattctacaacagtaactgtaaaactaccccataacattttctataggatacaaggaaaatgacctagtttctaaacttcaatctagctgaaggactataacaaagaactgtcactcctcttctcaaaactctctagcattactcatttcactcagaataaattccaaaccctcagcaattcttatgaggttccatatgacctggacctacatctataacttcagttcctgtcaccttctttcaccttctttgtcacctactattctgtaagggccaagaattatatgaaactgtacacaacatcattacttttcatggaaatataattcaagatcacgagatgccactacacattcacaaaaataattaaaactgtaaggaatgattattcataaggagtcacacaacaaaacaaaacaaaacagactgccattcccaggtgtagtggaggatgctgaataatagcaaatctcacataccgtaggtgcaaatgtaaatttataaaactattttagaaaaacgtttggcaaaagctactaactctaaacagggttatacttgacagtgtagcaattccattcctggatataaacaccaaagaaaggagtgtttgcattcatcaaataacatgtagacaaatgtgcataggggttttattcataatagcctagaactggaaacaaacaaaatatctaccacagtagaacagattaataaattgtggtccattcagacaatgtaatacttcatagccataaaaaaagaatgctatatatgacatggacaaatctcataaacaatactgagtgaaaaatcccagttacaaaagagtacatacaagataattccatttatataaagttcacaaacaggcaaaaataatctacggtgacagaagtagaatatggcaattacctttaattgttggtttgtctttttctaaactagagctactaaacggaaaggagcatgagggagctggaagtattctatatattgatctaggtggttgttacacaagtgtatacacatatataaattcacagagctgtacacttaagatctgtgtacttcacagtattgtaaaaaaaacattttgaaaatataaatacactcaaaaatatatatacaaagtgtaaattaagttagaactcaatatgctgcaccgcccactcctctgggaactttttggttctctcaggccttcatttactttactattatttttacttattcaaggaaaaggaaagaagatactaagtaggtaatttatgctcaaataattgcttacctttaacaaagggcagctgcaaaggtttggaaaggagagtggaaaattaaccccaagaaggaaatccttgttcctcaggtatctctggtggctctccccttctggcgctccccaggagcgtagctgatggagcctgtaggaggctttcagagacaggaaaagagctaaccatctgaaacaaaccacagcagacacgcttattcagtgctccatggaggtttgagggtcgttcatagcagcaaggattgtctctcattaacataactcttttgtaaatctttatcattttagaaacagttctttcctactttcctactttcagatacattatttcgcattacatggtttgctactatgaaaactaaaatcctccgcaaagctcctatcagtatttaaaaaaatttgccaggcgcagtggctcacgcctgtaatttcaacactttgggaggccgaggcaggtggaacatctgaggtcaggagtttgagaccaggctgacctagatggcaaaatacagtctctactaaaactacaaaagggcgtggtgtcaggcacctgtaataccagctacttgggaggctgacgcatgagaatcgcttgaacctgggagatggagattgcagtgagccgagattgccccattgtactccagcctgggcgacagagcgagactctgtctcaaaaaaaaaaaaaaaaaaaaattcaccttggccgggcacagtggctcacacctttaatcccagcactttgggagaatgagacaggcagatcaattgaggccaggagttcgggaacagcctggccaaaatggtgaaacctcacctctacaaaaaaaaaagaatacaaaaaattagccaggcgtggttgtgcacgcctgtaatcccagctacttgggaggctgaggcaggagaataacttgaacccaggaagcggaggttgcagtgagccaaaatcgagccactgcactccaacctaggcgaccgagtgagacttcatctcgggaaaaaaaaaaaattccttcatattaaggagataaccatttctgattacataaatcaaaagtaataaaatcagtgagaaccattataccagagaacagagaattaaacttcccagaacacttgaggcaggctatgctgcaatcactaactaaatgaatcaccagcctccgtttgccctgtagaaacaagtaaacaagacttactagaaattatgggagaaaagcctaaacagtttatatttaaggggtgtgtgtgtgtctgtgtgtgtgtgtgtctgtgtgtgtctctgtgtgcgtatacatacatatatatatatatatatatatatatatatatatatatatatatatatattcttgttctgttgcccgggctggggtacaatggcatgatctaggctcactgcaacctccacctcctgggttccagtgattctcccacctcggcctcctgagtagctgaaacaggcgcgtggcaccatgcctggctaatttttgtgtttttattacagacggggtttcagcatgttggccaggctgctctcaaactcctgacctcaggtgacccacctgcctcggcctcccaaagtgctggattacaggcatgagccactgcgcctggcctatttaagatatattatgaagcatcatacaattactaaatgagcaaaagaaaggtacaattcacttatgaataacaaattacagtctttttgtttgttttgttctgttttgagaccgagtctcattctgttgtccaggtgggagcgcagtggagcgatcttgactcactgcaacctccacctcctgggttcaagcaattctcctgcctcggcctcccgagtagctgggactacagtggtgtaccaccacacccagctaatttttgtatttttggtagaaatggggtttcaccatgttagccaggctggtcttgaactcctgaccttaagtgatccacccaccttggcctcccaaagtgctgggattacaagtgtgagccactgcgcctgggcctggtcaacaaactgtactattttttttttttttcttgagacggagttttgaacttgttgcctcaattgatccaggctggcctcaactgatccaggctggagtgcaatggcatgatctcagctcacggcaacctccacttcccaggttcaagcaattctcctgcctcagcctcccaagtagctggaattacaggcatgcaccaccatgtccggctacttttgtattttttagagatggggtttctccatgttggtcaggctggtcttgaactgccgacctcaggtgatccacccgcctcggcctcccaaagtgttgggattacaggcatgagtcaccgtgcccagcctacaaactttattcttaacaaaagaaaattaatgacaagttctctaagatgatatcatattaaatatttaattccacagtattcaatatctatcccatttattcctaactggcctcttatcaagcaataagcaaacctctcacctggccaaaagtccctgaagcataaggtttgccatttctgctggagatatatcaataaagcgaaggaaagagaaacagctttcttcattaatacctgaaatataaaagacaatttgaaacccaacagcaaaccaagagacgatgctcagttaaagcctgctcaactgctgagttttgacttaagaacaaaaacactattctaaaggttctgatctagccactttggtgcaagttagggtgccacacctttatactacaataacagataagagaggcaggcctatgagatatggcatatatatatggaccagactagagatggctcctacattacctttgggatttttggatgcttgcctaaatgccttctctttgtccaatgctaggaaaaagaaaaggacaggacagaggtgaaaggttctgaaccttggccttaatattttggacaatgagcaaagctgagtagcttcttttccttaggctaagacggaaggaagtctcattaatgagacagtccagcaccgactttgtcaagtttcaagggcaagaaattcttgaaaggcaggtataaaataaagatggaaagtcaataatactattttctactttttcctctcatagctacaaatcacagagcctataaagataactaatttccttaattaaatcttatcaagattttataaataagggcctaccatataggcaaaactaatactcgttctaaatcagtctctcagcaaaacaaagagcatcctggtaaaaccctgacaaacctactttcccaaagatcaaaacacctaccttttctgtgaaagagagaccgttggatatagtctggtgcaaatggagaaagaacccttaaccacctgcaaagtaagtaaataaaataaagccaaacccaaacataaataatggaaagttaactagactagaggttccatagcaagtaaaaccttttagttttgaaactgtttcacttttaagaagtttcttgccatattaccaggcaaaaatcatagcatacatttaaaaaaatacaaaatatttagtgaaagtgtaagaagataatacaaattaaaagtagtctcattttatttcagagaatcacaattctagtgccctaaggtatcatataccatactaaacaaaaggcaatacagctctggcctgttcctcccagctcaagttaaatattaacctggagctacaaataactcatgaagtaaaatccaagaaatgtgtttcaatttcagtttcattaaactaaatattggtgatgagtttctctataaaacagctttctaaatccatggttctcaaatgttgatatgcagaaaaaacctctgggaacttgtttaaaaattcagaagccagggccatactaactcacaggtgtggaatggaccacacatctattttctgaatggaagtcgtctctagtgcattaccttaacaaccacttcaaactttactaaatttatcgttgctgactctgagaaaaaggtaaatttgattaacttacaatacaatcagttcacccacaagtgcaattccaaatgtaaagtaagccaccacaaaccaatttcagcaatggggcatagatatgcatacttgctgcaagtacatatttacaaattggtgcacattcctgattcaaagaagaaccagaagtgactagggcctttaaggccacctagctgaagttttaacagtgctcaaattccttccataagatccctcaacaaatagttgtccaccctttgcttaaatgtctcattgctgggaactcatattctctccactaaatttatctactaagccataaaactgtaaattataaaacactaatagtgaacagatagtaatacttccctacctgtctcgtgaatgattgaagaccctgatctgtccatgacggtagataaactttgaaatgtggtatggctttagggaaatatgaaatggagaccaagtttcttgccgttcaaataactccgggtgattacacacctaaaaggaagggaaatggtaagacaatattaccacatgcagacatcatacgtaatgacaggggatcccaaatcccaaatgtttacctttgggaatggatactttcccattttcatctcattaatagcctttgcttatctggcatcaaggatagactgtttttcttgaaaaaggttaataaagacaacttcaaggccaggcgcagtggctcacccagcactttgggaggccgaggcgggtggatcccttgaggccaagagtttgagagcagcctgaccaacatggggaagcctcatctctactaaaaatacaaaaattagccaggcgtggtggcaggctcctgtagtctcagctccttgggaggctgaggcaggagaattgcctgaacctgggagccagaggttgcagtgagccgaaatcacgccattgcactccagcctgggcaacagagcaagacaattctatctcaaaaaacaaaaaacaaaacttcaagggaactgacgtaagctcttaccttcctaaactgcatgaccagattcatgaggctgctggtggtgttctgtgcttgttgggtagagcccatagaagactgcaataaatcctcaatggaaattttgttctttagtgcctgatatagcagcttctgtcggctggtcagttggcaatacattagaatctcaatctaaaaatcaataagaacatttatatttggaaaagtagtttttaagaaaattcagcatcagcttaaagttgaaaacacacacaaaccatattatgattgagaataaacatatgtgaactcagtatctctataaacctgtgaatgtggacaatcattcagaaaaaaatgtatattccttggccctcttctcttcatcactcattccatttgctttccctgggcaatttcttccatttctaactgtgccaactaacacccatcacagtaacatacaaaagtacattcccaaacataacccaggccagtacctgcaactactaactctaagagtaccactcagtctgcagcaatggcatatgtgatgtgtcagaaaaacagttctcttttccacaatttactaaattggttaacagcattaccattccttcagttgggaaagacaaacttaactcacctctgaatgctctctcacacctcatgttctagtatttcctaaatccttcaattcagcttggaaatctaccaccttttctaaccatacccattgccctactgctggccctcatctgatatagtatagactgataatattttgtggtcttcctgcctccagtttcttccggttgtgatatactttccacatatagcttataaaggaattcaactgctgaaaaatcttcaatgtgcatttttgcctaaagtaaaatgttgaaacttctcatctcagcaaagaaagcctccaataatcaggccggacgcagtggctcacgcctgtaatcccaggactttgggaggccgaggcaggcagatcacaggtcaggagttcaagaccagcctggccaacatagtgaaaccccatctctactaaatacaaaaattagcagggtgtggtaccacgtgcctctaatcccagctactcaggaggctgaggcaggagaatcacttgaacccgggaggcagaagttgcagtgagccgagattgcaccattgcactccagcctgggtgacagaatgagactccatctcaaaaaaaaaaaaaaagaaagttctcccataatcaaacctaccttactgtctgagtttctcatcatcataacctcctcacataccacttagccacaatgatctgaaaattagccaaaacaggctgcatatttcgatgttactctatctttgctcacactgcccttgttgcctagccccccattcccaccatattttcctagtaaatgccaactcatcatttgaaacctagctcacatgtcatctttgctttaatgccttctctaactttccctagcaaaactatagtaagataggaaacgctaaatgatgtttaagaaacacatactatacacagtggttaggaaccatactagatcttcagatcacctctctatgtagcactaaacaacaatcatgaactagctgggtgcactgactcacacctgcaatcccagcactttgggaggccaaggcaggagaatcgcttgagcccaggagttctgagaccagcttgggcaacacagtgagaccctgactctataaaaattaaaaaataaaaaattagggctgggcatagtggctcatgcctataatcccagcactttgggaggccgaggtgggtggatcacgaagtcaagagatcgagaccatcctggccaaccaacatggtgaaacctcatctctactaaaaatacaaaaattagctgggcgttagtggtacacacctgtagtcccagctactagggaggctgaggcaggcgagtcgcttgaatccggcaggcggaggttgcagtgagctgagatcgcgccactgcactccagcctggtcgacagagcaagactcagtctcaaaaaaataaaaaataaataaaaaataaaaaattagccaggcatggtggtgtgcacctatagtaccatctactagggaggctgaggtggggggatcccatgaaccctagagtatgaggctgcagttagccatgatcatgctactgcattccagcctgggtgacagagtaaaaaatccagtctcaaaaaaaaaaaattttaaacaatgaactattgtttacatgaccctttaaatataaatgcattagggattcattttttaaataaaatgttttccttctctcagttgtatctatgtgacattgctatttattagctaaaatcagccaatttcaaaaaactacccatcaagattttgagaaaaaaagactaaataaaggtacagttctactcctctctttgaagaggatatatatacaatccctgattttttaagtccagcacggtggctcatgcttatagtcctagcactctgggaggttgaggtgggaggattgctggagtccaggagttcaagactagtctgggcaacatagcaagatcctgtctctagaaaaaaatgaaaaattagccaggtgtggtggtgtacacctgtagacccagctactagggaagctgaggtgggaggactgcttgagccaaggaggtcaaagctgaagtgagccgtgattgcaccactgcattccaccatgggtgacagagcgagcccttgtcttacaaaaaaaaaaaaaaaaaaaaaaaaatacaaggggaaaaaacggagggagagattaaaagatactaagaggtcgggcacagtggctcacacctgtaatcctagcactttcagaggcccaggcgggtgaatcctttgaactcagtttgagaccagcatggggaacatggcaaaactggtcgctacaaaaaaaaaaaaaaaaaatacaaaaattagccaggtgttgtggcacacacctgtagtcccagctacttgggaggctgacaggggaggatcactggagcccaggtggtcaaggcaacagtaagccaagattgtgtcactgcactccagtgtgggtgaaggagtaagaacctgcctcaaaagaaacaacaaaccagatgctgagagacagaccatccaaatgctatgtatggaccttgcttgtatccttattctgacattttttttttgagacagacattcgctttgtcgcccaggctggagtgcagtggcacaattttggctcactgcaagctccgcctcccagattcatgccattctcctgcctcagcctcccgagtaactgggactacaggcgcctgctgccatgcctggctaattttttgtatttttagtagagacggggtttcactgtgttagccaggatggtctcgatttcctgacctcatgatccgcccacctcagcctcccaaagtgctgggattacaggcatgagccaccgtgcccggctacaaattaattctttgaagaagagagacagacacacaaagacaactggagatatctgaacactgactagatacgtgatgctatcatggaactggtctttttaaataggtgtgataatggcatgtggttaggcagtgtttaaaaaaaccaaatcttttagaaatatacatgaaaatacttcataaacaaatattcatttataaaacatctgggatttgcttttgaataagagagaggtagagttaatgattattgtcacggaacaatgggtcaaggggattcattatactatctttctatttttgtaatgtttcaaattctccagtaaaaagcatttcaaaaaaagaaaaaaagatgttattttcctcaattatttgcctcattttaagtcctctttgatccatgcaagtttaaacgtcttccttcaagcaaacttcaactaaacatatatcaataaatttctccccctggaatcttaagttggtgcctattgaggcttaaacacatgaggtcttctttacttaccttgtcagataattcattttccacatctttcttgattctcctcagcataaatggcttcaaaatcatgtgtaagcgagaaagttgatctgaaatgccgggaggcccccaaataatacattatagtgatttcacaaaaacaacagaaacaaataccacattcacctctcaccaaactcttcaaaactcctttggctcaatgattctctaaaagcagactgaaactttttcccaagtaggaaagcaaggaattttaattttttataccatcttgctatagtcaacaggataaatatactaggctctattttcattagaattcatttttaggttttagggacattttatcactaatagggttgtaagtataagaaaaattatctgagactctcagtgttccccaaaaattaccttccaaaggatgtcagcaaattaacaactcatagtgtaaaatcacataaggatttttctaatagtgagcaagctcatgtctgtgtaataaacacttcagaatgctcttaaaatcagagagatattattcaacaatatcaaaagtattgataaggttaaaaatgctcacaatgaaaacaaattctaatacatagagaaaaataacaaaaatggtccttctaatatttgctgtttttatcacaggaaaaaagctttgacccattagacccatagcatttgacccatttgacccacaaagaattaaatatgaattttcttttgagatggagtctggctctatcacccaggctggagtgcaatgatgcaatctcggctcaccgcaaactccatctcctgggttcaagcgattcacccgcctcagcctcccgtgtagctgggattacaggtacccgccatcatgcccggctaatttttgcgtttttgtagagacagggtttcaccatgttggccaggttggtcttgaactcctgacctaacgtgatccgcccaccttagcctcccaaagtgctgggattacagatgtgagccaccatgcctggccaatatgaatttttcaagatctaaatgggaaatgtgaattctgcaagctaaaatataatactttatgaatcaagcctgatctgccttgattagacaagactacagtagtaatcatctaaattagttcttttttgactgttaaatatgtacaaaaaacaaaattattttataagcaaaaaatgtggttttcttccccgctgatttgtctatgtatactggaagaaaaattattcaaataaaagaaaatatgcaattacgtggttgcctacactgataggtagatagaaagccagctcataacagtactcactctcatcaatagcagatttgttttcggcatggctctcaatgtccttggaaaaccattcattaaattcctcatgtgaatcaaataatgttggcataatgaaatgcagcagagcccaaagctgtaaacaaagacaaaaatgaaatagctatagagcaataaaatgacagcgtgtaaggatgtattagatagagaaaattgcaggtgtattagtgtgtaagtgcctagatgcatgtgtatgtgtgaatgaaagacagaaaatgaatgaattcaactacattcttgcctcatcaaccaaccctaattttattaggtgctgtagcaaaatgtgattctttttcaactaatttcaaactaaaagtttcaaagcgcaagtcatgctcagattttgcaatgggatagttttaacgatcttcttataaaaatctattccataattgaacacaacctaaggtatgataacttgctactaataatcctagattaggggttagaaaaatatggcctgttgggccaagtctggtctaccactattttaaatcaagttttattgaaacatagccatggccattcacttatgtattgcctatggctactttattacacaagcaaagttgagtagctgcaaccatgattgcatggcctccaaactctataaaatatatactatctgtcagtttctataaagttttcttcttttggtttttttttttttttttgagatggagtctcactctgttgcccaggctggcatacggtggcacaatctcggctcattgtaactttgacctcaggattcaagcaatcatcccaactctgcctcctaagtagctaagactacaggcatgcaccactatgcctggctaattttttgattttttttgtagcgtccgggtttcaccacgttgcccaggctggtcttgaactgctgggttcaaggcatcctcccacttcgacctcccaagttgttgggattacaggcatgagcagctgcacgcagcctctataaggatttctgacccttattctagatgatcaattaactccccccaaaaattttagctcccctctgtgttaacaaatattacatttcaactctagcaaaaacacgtctctgcattaaatgtttacattttctaatgtggtcagtattccttaaatacaaaagaatacagtaattcattggccttatgccagagaataagaaaacaggaatgatgcctatgcctaaaagacgacttggggcaagtcttttatgtggggactataatttatacaaagcagtagcactgcaagggaatgggtaaagaattctatgctctgctggaatccttctgttttatgaagatataaacctgtgacctggactagtgcctacctctgccatggtgttctgaattggggtcccggttagcaaaagccgattccgacactggaactgtaagaggatcttccaacgaacactgtttgataaaataagttacaaattcatgttagcaataaattgttctttaattatcctactgagaccccatattgacaaaaatgccttccaaaaaactaacattcagaatcaagtactccatcatgtattcaactgaaaaacattattcaacaaagctgaaaacaggacacttccaagggaaatgagtcctctctactgaaaacacggtatttggatttagaaaaaaatagcctcaaataggcagagttgtatcatttctggctttataaactcttctattatctttagtcatttttgctgacataagtcatttaattagaaagtacatatctgtggtataaagtgtcaaaattattaatctgtgcacttccagtatgagtttggagagagcagttatgaggagtgttggtgagaagaaaatgtaaaatgaatcttcattgctcctggccaaaggcatatgctccttcgaacaactgcagtatgccaagcatggtggctcatgtctgtactcccagcactttgggaggcttgagtgcaggagttcaagaccaacctgtgcagcatggagaaaccccgtgtctactataaatacaaaaaattagcccagcatggtggcacacgcctatagtcccagctctgagactgagatgggaggatcgtttgagacagggaggtcgaggctgcagtgagccccaactgcgccactgcaccactccatcctgggcaacagagcaagaccctatcccctgtctcaaaaaaaaaaaaaaaagattgctgtaggaagtaagacctttctgaggatagaaagttccacagaagggctcacgcctgtaatcccagcactttgggaggcagaggcaggtggataacctgaggtcaggagttcgagacaagcctggccaccatggcaaaaccccatctctactaaaaatacaaaaattagccggacatggtggtgagcacttgtaatcccagctactcgggaggctgaggcaggagaattgcttgaatctgggaggtggaggttgcagtgagccgagactgcgccactgcacaccagcctgggcaacaagagtgaaactacatctcaaaaaaaaaaaaaaaaaaaaaaagaaagaaagaaaagaatagaaaaaacaaagttctacagaaaatatcatctagccagttaacatggacctctaataaatttctaacgactcaccatgagttaataaaaaaaatatcaagcctgaggtttaatatcaccaaataacactttttatttactttgggacctcaaaggtattggaatattttaaacacataacttagaataaaaggattcttggagatctgaaaaccatccagggtctcagataatcaacataaaacaaacagagcatccaatccacataacctaacattctacctcctacttagaactcctatctaaaataataccttaaagcaagggcagagactccttcctctatagaaattttccctgaagagatgacctgtaaaaatgtcaccttcttgaacagggagataaaagttgagaaaagtcttggtattcttggcattaacatttgtgttccatgaaaaaataaaaaaagggaatttttgccttctgatcaggtacacgactgatgcagagatcatgtcacgtcatatttaaaacctctcatatattggacgggtggctcatccctctaatcccaacacctggggaggccgatgcgagaggatcgcttgaagccaggagttcaagactagcctgggcagcaaagcgagaccttgtctctattaaaaaaattaaataaaacttctcatatcttgattttattcatatatacaagtctgtgtgtgtgtgtgtgtgcgtgtgtgtgtgtgtgtgtgtgtgtacttaacccaatgcattgagtttggtttctactactcatgttacctggaactactcttgagcgcctgagcctcatccagtaccatgtattgccacttgacccgctggaaatactttacatcctgcaccaccagctgatagctggtaataaccacatggaagggggcatcctgagtgtagagggtcttctgtaaatataaaaggggaagggtgaaaagagaaacctaataattcataataaggaactgatgtatggactgtttttctagggccaaaatgtttaagacagccctgaagatgtgcttctcccatatggtagggagatgtgcagtgaagtgaaccatactgtggggttttgtctgttgttttgctgttgttgagagggtctcactccgttacccagactagagtccagcagcgtgaacatggctcactgcaaacacaacctcctgggctcacgtgatcctcctgccttagtctcccaaacagctgggactacaggcatataccaccatgcccggctaatttttttattttattttattttatgtagagatggggtctcactatgttacccaggctggtctcgaactcctggactcaagtgatcctcctgcctcggcctcccaaaatgctgggattataggcatgagccaccatgcccggccactataactgtttttaaagcagtcacatttaccacaaactaggctgaaactagtcttcagcttattaaagaaaaaagttctggccaggtgtggtggctcacacctgtaatcccagcactttgggaggccgaggcaggaggatcacttaagcccaggagtttgagaccaccctgggcaacaggttgaaaccacatctctataaaaaatacaaaaattagccgggcatggtgtagcgagcctatagtcccaaaaattagctgggtgtgctgtctcctgcttgtagtttgggtggctgaggtgggaggattgcttgagccaggaggtcaaggctacagtgaaatgtgatcatgccactgcactccagcctgggcaacagagcaagaccttgtctcaaaaaaaaagattcttaattaatcctggaaatcaagtccagctgattgcctacaacaggaaaagtattgtatcagaaaaatggaaacttgatcagtgtccagaaatatataatagataagaagatttttgtctaaaagaaattatccacatcaattagagaaataatgactgcatgtacggtacgtatgtatgcagtttaagtagaatgttacctgactccagaaccttctgatgacttttctatcatgaggatttccccaatatggtagcacctagaaaaagggccaatatatacattactttctatagatgatcttaaaagtattagaacaaatatataattcggaacaatttaaaaagaaactaataaaatgagcataggaattcctctcctgccaatggtggaataaatggtttaaccaaccctgttgtccaaatagaaagacacacacacaattcatttgtctgaaggcataaaacagctactgagacagtgggcaattacagaggcccaaatcagaaaacaacggaagcccagagaggtaagcctagtatgtggtatactttatcactgatggtatcatggcattacaaaagttctagttgagagggtaagaaactgaggacactttttcttaagagatgtaagataggctgggcatggtagctcacgcctgtaatcccagcactttgggaggtcgaggcaggcggatcacctgaggtcaggagttggagaccagcctggccaacatggtgaaacgtctctactgaaaatacaaaaattagccgggtgtggtggcacgcgcctgtaatcccagctactagggaggcagaggttgcagtgagcagagatggcgccactgcactccagcctgggggacaagagcaagactttgtctcaggaaaaaaaaaaaacaaaaagatgtaagacatagagaacaaaaattgtagttcaaggaaaaagactcttgtaaccagccacatccctggctttaagttggaagtcaaaggctacaaggtagtagtaacagtaaatcatacatagacttgcctagacttccctgaataggtaccgactccccgcctcaagacatctgaattccagattaaaaaggctttgaataatttgcatccccaccaacccccaaataattactagtggcaaaaaaacacataaatcctctctagaagaaaacagttgtgagagcccacacttatctctatagcttttcctatacaatgtctggcatagcattaaaaaataaccagacatatagaaagaccgtatcacatgaatgaaagcctacatgaaagaaagataacgtacacagaggagattaaaataataaaaatattaaaaacagacttttggccaggagtagtggctcatgcctgtaatcccagcattttgggagactgaggctggcagatcacctgagcatgggagtttcagaccagcctgggcaacatggtgaaactctctctctacaaaaaatacaaaagttagctaggtgtggtgacacgcgcctgcagtcccaggaactcacgagtctaaggcagaattgcttgagcctgggagaggttgcagtgagccaagattgtgccactgcactccagcctgggcaacagagcaagactttgtttcaaaaaaataaataaataaaagtttaggccgggcacagtggctcacacctggaatcctagcactttgcaaggccaaagcaggtggatcacgagctcaggagatagagaccaccctggccaacatggtgaaacaccgtctctaccaaaaatacaaaaaaaaaaaaaaaaaaaaaaattagccaggagtggtggcacacacctgtagtcgcaactattcgggaggctgaggcaggaaaatcgcttgaacccaggaagcagaagttgcagtgagccgagatcgtgccactgcactccagcctgggcgacagagtgagactgtgtttcaaaaaaataaataaaataaaaaaatttaaaaataaaaatgaaaaatactttaaaaaatgctaatttgttaatgaaaaacaagatagagaatttcaatggtatgctataaattataaaagaatcaaagcgaatttttagaactgaaaaatatagtaactaaaatcaagaaattaatgaatggatctaatgacagattagatgcagctaaagagaaaattagtgaactagatgacaagtcagaagaaaatatccagattaaagcacaaagaaacaacagaatgcaagattcagcactttttctgtgatgttttctagatgtggttttctttctccttatccctgcacctcacagggcttcttgaatctacagaccgctatcttttgttgttctgaaaaatttcagccaaatggaagcagaaatatgcaggaagaaatgaagattaataaaaattgaatatacaatatgaaaaaatctaaacataaaatatataagcaataataaaatgtctcatggggtttaaaatataaaaagtatacaaaacctacagcatataagtcgagacaaaagggatgtagtccaagtataccgaagtctttatattatccagaaagtagtaactcttaatttatattattattattttttaagtcaagaaggcaagtttttcccccagattatctactagagaataaaataggccaagtatggtggctcatgcctgtaatctcagcactctgggaggctgaggcggatggatcacctgaggccaggagttcaagaccagcctggccaacatggcaaaaccctgtctctactaaaaatacaaaaattagctgggcgcagaggttgcagtgagtggagatcacaccactgcactgaagcgtgggtgacagagtgagactctgtctccaaaaaaaaccaaaaagaataaaataaatacatgactagtgctatggtttgaacatctctctcgaggtttatgtgctggaaacttaatctccaatgcaacagtactgagaggtgggagctttcaggggtgagaaggtcatgggggctttgccctcatgaatgaattaatgccattatcacaggagtccccctcaccctgggctcttctgctcctctgccttccaatctggagtgatgcaacaagaaggcccttgtgagatgaggacgcctcactttttgacttctcaggccctctggaactataacaaataaatctcttttctttataaattactcagttttctgtgttttgttatagcagcacaaaacaaactaagacaaataataagctaagagagggagggagagcagtaacatttaatcagtccaaaaggacataagaaaggagagaaccaaaacactgggacacatttctcaggatctcctgagcgctgtcatgggccaaaaaatgtttttaaaatagggtgggcgcagtggctcatgcctgtaatcccagcactttgggaagctaaggtgggcagattacctgaggtcaggagtccaagaccagcctggccaacatggtgaaaccccatctctagtaaaaataccaaaattagttgggtgtggtggtaggtgcctgttattctagctactcaggatgttgaggcaggagaattgcttgaacctgggaggcagaggttgcagtaagctgagatcacatcactgcactccagcctgggccacagagccagactccgtctcaaaaaaaattttaatgtaaaaataaggaaaagagaaaaattaaacaggtgccacaagtagaaaaacaattaggaaggaagacttaaaactcaatatatcagcatttacattaaaagcacaaatattcccaacaagaggcaagaaatacaccttaaggtcgggcacggtggctcacacctataatcccagcactttgggaagctgaggcaggcggatcacttgaggtcaggagttagagaccagcctggctaacatggtgaaaccccgtctgtactaaaaatacaaaaattagccgggcgtggtggcatgcgcctgtaatcccagctactaggaaggctgagacagaattgcttgaaccctggagacggaggttgcagtgagctgagattgcgccactgcactccagcctggcgacagatagactccgtctcaaaaagagaaatgcaccataaatgatgtaaaatgattacaaataaaaggaagaaaaaaagccatgtaaaaattaagcaaagacgccctcacattctgtattcagaaaaaaattaaagaaaaacaatatatatcagaaaatacagacttttagtcaaaaagtctttaaaaggaaaatttcataataataaaaggttcagttcaccaggaagagtataaatcttacagcctcaaaatatataaagcaaaaatggacagaagagaaatggacaaatccataatcatggtatgttttaatataccactctcagtcagtgacagaataggcagacgaatcagtaaagacatgaaagagctgaacaacttaacaaactttgacctaaatcaacatatatgcaacactgcaatgaataagggcagaatacctataattttccaatacacaaaggacatataaacactgacaatatgctgagacataaaaatgagggttcaacaaatttcaaagtattaaagtcataaaaagtttcttttaccaatgtgaatttaaggtatcaattaataacaaacaagacatctagacaatcctccactgtttgaaaattatgaattacactttttattttttaaaagagatagggtctcgccctgttgcctaggctggagtacagtggtgtgatcatagctcactgtagccttgaactccagggctcaagtgatcatcccacctagaaatacacttttaaataaaccatagatcaaaaatgaacttgcaatggaagttagagattatgatgaagtgaaagacaatgtatatatgacacatcaaacctttggatggctaaagtcatgctcagaaagcaatgagtatccttaaatgtacatctattagaagctgaaaatcaatactctaagctccatctcaagacatcagataaagaaaaaagctggctgggcatggtggctaacgtctgtaatccaagcagtttgagaagccaaggtagaaggatcgcttgagctcaggaatttgagaccagcctggccaacgtggggaaactcagcctctactaagaataaagaaattcactgggcatggtggcaggctcctgtagtcccagttacacgggagcttgaggcagaagaactgcttgaacccggaggaggcagaggttgcagtgagccaagatcatgtcactgcactccagcctgggaaacagagcgagacactgtctcaaaaaaaaggtagaaaaagagtgcagtgtggggctgtgttccaatacgtatgactttcaactttgtatgtcacattctatgaaagtttatttttttatcaataattttaaaaagtaaaaactattcttagtttacagccattcaaaaacaggtagcaggccaggctcggtgattcacgcctgtaatcctagcaccttgggaggcagaggagggcagatcacctgaggtcaggagttcaagaccagcctggctaacatggtgaaactccgtctctaccaaaaatacaaaaattagctgggtgtggtggtacacccctgtagtcccagctactcgggaggctgaggcaaaattgcttgaacctgggaggcggaggttgcagcgagccaagatcacgccactgcactccagcctgggcgacagagcaagactctgtgtcataaaacaaaaaacaaaaaacaaaaaaaacaggtggaagattccttaataagtagaattaccatatgacctagcaattctactcataggtacatacccaaaagaagtgaaaacagtaaaagtgttcaaacaaaaacttgcacaggaatgttcatagcagtactactcacaacagccaaaaggtggaaacaacccaaatattcatcaacagatgaatggatgaacaaaatgtgatatatatatacacaatggaatattactcagccatataaaggaataaagcactgacacatgctataatatggatgaagcttgaaaactttatactcagtaaaagaagccagacagaaacagcattcacaaagtgttcagaataagcaaatccagccacagcagtcaaatttgtggttgccagaggctacagcacaaggtgaatagaacgtgattgcttagtgggtaaaggccttctgtttgggctgatgaaaaagttatgaaactagacagcagtgatggttacacaagattgtgaatgcacctaatgctactacattgtactttttttttttttttttttttgagacagagttgtgctcttgttgcccaggcacaatctcggctcaccacaacctctgcctcctgggttcaagcgattctcctgcctcagcctcccgagtagctgggattacaggcatgtgccaccatgcccagctaattttgtatttttagtagagatggggtttctccacattggttaggctggtttagaactcccgacctcaggtgacccccctgcctcagccttccgaagtgctgggattacaggcgtgagccaccgcacccggcccatttttttataagcttggtctgcaggcatgcactaccatatccaactaacttttaaattttttgtagagacaaggtctacgttggcaaggctgttcttgaacttctggactcaagtgatcttcccaccttggcctcccaaagtactgggattacaggcatgacccaccaggcccagcccatttttaaatagttaaaatggtaaatactatgttctatgtattttgtcacaataaaaaatatattggggcactaggaaaaaaaaaatcaagccaactgcagtggctcgtgcctataatcccagcactttaagaggccaaggtgggatgattgtgtgaggccaggagttagagaccagccttggcaacatagcaagacggcaccataaaattaaaaaaaaaaaattagcagggtgtggcgctgcatgccggtagtcctagctacttgggaggctgatgtgggagaatggcttgaggtggagttcagggctgcggtgagctatgatcacgtctcagcactccaccttgggagacagaaggagaaaatgtctctaagaaaaaaaaaaaaagcaaaaaaaaaaaaaaaaatcaaaagaggtggcaacacccacagggtatataatcctaaattaggatatcgaaagaaagttcaacatgcaaatgatagctctgtttcaggcatacttataaagtcaaaggaaaggcatcaatgacattagtaatatcacattgccatctatcagcagtggaagagctactgaaaacttaagtggtttggtgaaaaaattttaagaccttttatttttcttttttctttttgagacggattctcactctgtcgcccaggctggagtgcagtggcatgatctcggctcactgcaaactctgccccccgggttcaagcaattttcctgcctcagcctcccgagtagctgggattacaggcgcccgccataacacctggctgatttttgtatttttagtagagacagggtttcaccatcttggccaggctggtcttaaactcctgaccttgtgatccacccgcctcacctcctaaagtgctgagattacaggcatgagccaccatgcccggccaagatcttttatttttcaagatctgcattgttcaatatatactgaacatcatatgaaaaaaaaagcagaaaaagatggtgatcaccattccacaagacaaacaatttaagagaaaatagtcaacaaactgcattagaatgatctcatcatcatctcagcaagatgaaaatgagtcagtcaaattaaaagctatatatcctaacactccttatacagtttctacatctacaatttagccacaaaatgggaccacagccataaagctgcctcaaagtgggaaatcccagacaatttcctattccatacaaagcataagccagaaaaatacctgcctcacatttctaccctatcccaagctccaactacaggaaacccatcactattacagagacccaaaatcacagagatcatgtcaacatattttgatatataatctccaaaatactatcttaactgtgcaacttcattatcatattcctttagggacagaacacatatttaactcattttcaattcttttaaattgcaaacaataaatcctattcattctttcttaaattcctccaacttttcataactaagcagctgtttaaatctaatcaatgtcttgcccaatggatgccaaatacttccctgatcaccccctacttcaacctgaattcttttcctctgaattaattaaatcgatgttcacattatctaccttagacattataagctggactaagactagagatcagactttagagtattaagaaaatgaactggctgggtttggtggctcgtgcctgtaatcccaggactctgggaggctgacgcagaaggatgactagaggccaggagttcaagaccagcctgggcaacatagtgagacctgcctctactaaaaaagcaaaatgggctggatggagtggctcacacctgtaatctcagcacttcaggaggctgacatgggtggatcacctgaggtcgggagttcgagaccagcctgaccaacatcgtcagtagagaaaccccgtctctactaaaaatacaaaattagccgggcatggtggcacatgcctgtaatcccagctactcgggaggctgaggcagaagaatcacttcaaccctggaggcaaaggttgcggtgagcagagtttgcaccattacactctagcctgggtaacaagagtgaaactctgattaaaaaaaaaaacaacagctgtgtgcggtggctcatgcctgtaatccttgcgttttcggaggcccaggcatgtggatcacctgaggtcaagagtttgagaccagcctggacaacatggtgaaaccctctctctattaaaaatacaaaacaattagctgggcatggtggcagacacctgtaatcccagttactcaggaggctgaggcaggaggattgcttgaacctgggagatggaggttgcagtgagccgagattgtgccactgcactctagcctcggcgacagagtgagactccatctcaaaacaaaaacaaaaacaagacatgtattaaaaaaaagaaatgaattatttacaatagatttaaatgaaaagagaaatgccgtaaatgataggatgtgtactgatggtatgatttgtcaaaaatctatgttaaaccaaataaggtagatgttttctaccgtggcagtttgaccacgagtatccatttatcaggctaaatgcaatatgcactcattgttcccagcagtaagttttatagtgattatatgcaagttattttggaacaatgtatatttttgtttttgtgacggaaggagtcttgctctgtcgccctggatggagtgcagcggcacattctcggcttgctacaacctcccttcactgcaacctcccctcgccccctcacccccctggccctgccccgttcaagcgattctcctgcctcagcctcctgagcagctgggactacagacacatggcaccatgcccggctaattttttttttgtatttttagtagagacggggtttcaccatgttagccaggatgatctcgacttcctgacctcgtgatccacccacctcaacctcccaaagtgctgagattacaagtgtgagcccccaagtccggccaaaatttaaaactgttatgagtaattagtagggcaagaaaaggagagtcaaaaagtttattttaaagagcaatagatgttttggttggactgatatttaccttaaatttaggaacaaatctagtaaactcctggtgccaattgttaagtgtagacgcaggtgaaattattaagaaaggtccccaaatgttctctctctgcaacagaaaaacccagtcagccaactacaggaaaagggaaggtatttaattcaaaattataattaatgacaagaacaatctaagaataggaaacaaataacaagagaaacagtgagtaaatcccaaatctgcacattcaatagtaatatcctatgttaataataagaacataaagacacacctgagaaaaaaatggcaagcaactattccctcttctgacctcttataggtcttatccacaaagcattcatgacacactgacttgtatgtattgttttctactatactagttatccgacaatcttgtagttatttaataggtatagagcttttgcttttttttcagttttacgcatttttaaaatttaattcttataaaattcctataaagtagataacgtctccatagaagaggaagaggaagaggaaactaagcctcagagagttaagttgaaaaagaggctaaattgcccaagtttacactggtaataagagtagagctgaaatgttaggcaaggtgttctgatctaactatatggcccttgccactacactggtggtaattaatgcagagcggaaaggagtgtctcaaaatcacatgctcaaaaattgtcctagccctcttaaaaaccaaaaagttataaaacactgtccccttataaagctctgaggcaagaacccagtcccactatcttggaatgctacacagcttaacatagtgcttttaagtggctgattttcaacagaaattaccctaaattctagagaaatgaagatagaaagattgcatctacccacctcagccagatgggccagaagggcaatgctctgtactgttttaccaaggcccatttcatcagcaagaatgccattaataccctggggaaaaaaaatacatggtcaacacctcatgcatttcatcaaataaagttcaacctgttaccaaaaagaacgaccaagataacaggcttgtttaaagagaagtgaccagagatactcagcctcagcacttttacccactgctatagtaattgcttttgccaatgctacagctacaactatgaaccatgatacatgagacagggcaaggccaatctgttagctaatacaacccagacacaaaagcaattagatttaccaagtccatataagacaaaccataagaaatacacaaatattctccagtaggatctccaggttacaaaaaaacaaaaagacatcagctgggtgcagtggctcatgcccgtcccggcactttgggaggccgaggcaggcatatcgcatgagcccaggagtttgagaccagtctgggcaacatggagacagcccgtttctacaaaaaatacaaaaattagtcaggcgtggtggcatgtgtctgcagtcccagctattctgggggctgaggcaggagggtcacttgagcccaggagtttaaggctacagtgagccataaacgcaccactccacttcagcctgggtgacagagtaagatcctgtctcaaaaagaaagagaaacagagacatccttctgcctcttgtcaaaggatatagctttttattttttaataaatctacattaatttatttttaattatactttaagttctagggtacatgtgcacaacgtgcaggtttgttacatatgtatacatgtgccatgttggtgtgctgcacccattaactcgtcatttacattaggtatttctcctactgctatccctccccaggatacagctttttaaaagggtgaaatctaaaacatgatcttgtactcatttcctttttttttttttttttttttttgagatagagttttgctcttgttgcccaggctacagtgcaatggcgccatcttagctcaccgcaatctccgcctcccagattcaaatgattctcctgcctcagcctcccaagtagctgggatcacaggcatgcaccaccatgccaggctaattttgtattttttttttttagtagagatggggtttcaccatgttggtcaggctggtctcgaactcccaacctcaggtgatccgcctgccttggcctcccaaagtgctggaattgcaggcatgagccaccgcgctcagccagatcttgtactcatttcacaatcacattgaacaaatgactttaggaaaagagataatagaagagaatgacacggttctaaaattcacctgttcatatagattggccaaccaattcatgcctttcagttgataacctttcaatttgccattaaaaattgtgggctgtggaatatcctcaccagcccggatagatgggttagccaggctataactctccccaaacccagtgccagacttgtttgctgcccgtagggcagctgctcgactttcttttgcatcttcatcaaatgaccttgtctggaaagtaaaaaaaaaaaaaattagaaaaaaaaaaaagaggaaaaatattacatgaaaataagactcaagataacaatatatctaccctgtgctaagaaaaataattggaacaaaatttctcataatctgataatataacgtagtatcatatgacatcatttctataaaacatattactaatattatttaatgtaacaattatattagaaattggggaaggtcacattcgtctatctttgacttacactctgtcaatgttaaataggggctcctatgcagtatattaaaaacagcaaattttttacttaattcaacctgattgtagtttctttctgattttgttaaacatcactatatcatacataacaaagagcttgggccaggcgcagtggctcacgcctgtaatcccagcactttgggaggccaaggcgggcggatcacgaggtcaggagatcgagaccatcctggccaacatggtgaaaccccgtctctactaaaataaaaaaaattagctgggtgtggtggtgcgcacctgtagtcccagctactcaggagggtgacaaagcaagactcccgcctcaaaaaaaaaaaaaaaaaaagaataaataaataaataaataacaaagagcaagttattacttaagtgaaagaaggcattaaataacgtagcagttttttgaaaccatgatatggctctcttaacaagccaagagtgtggtctttttctttttttttttgagatgcagtctcaatctgtcgcccaggctggagtgcagtggcacaatctcggctcacagcaagctccgcctaccgggttcacgtcattctcctgcctcagcctcccgagtagctgggactacaagcgccctccgccacccccggctaattttttgtattttagtagagatggggtttcaccgtgttagcctggatggtctcgatctcctgacctcgtgatccacccacctcagcctcccaaagtgctaggattacaggagtgagccaccacgcccggtgagtatggtctttttcattaaacatctatgatacatttcatactgtattgcccatgattactcaagagaaagaaaaaaaaatacaaactgttctaacttgaaattaacacattgctaaagctagaaaactgaatattcgtttttctgcctttcttctagtatccctactaatctaaagtgaaagagacccagctccaccccctacacacagctactcacacacatatacacaagctagtctatgcttttaattgcaaatgtgattaagactaaaggaagaccacctaagtaaaggcttgtggggtatttccagggccaattacagtaaacctttctatctgaagactcacccgagcttggtgaatatggtaagcattttcagcattcttcagggcctgggctttaaaatggttactatctgaaaagcaaaatttatggattatcacactttatcaactgattttgttctaagatacaattaacaccaatgtatgtggatccctgattccctcattctacttatccctgggttcacggagggtgggggaagagaaaggctaaattctcagaggtaagaagctggaaatgcaatggaggtggaggactgccatggtctccagtagccaaagcaagctcacaaaaaacatcacggcactgcctctcagtactggggtttcttctaccaaataataccaagctacaacaatcaagacaatcaggattcaaaattttaatatatttatgataggtgaaactattttaacaggagaaatacagacatatttaaaccccaagatactataaagcagttacaatctctactatttctagctcaacacaatcttaatcagcattctccatgaaattcctctcaaacttcatcccaattcctccctctccttgtgatcacataaagacaactgaacagctgctttcttgtgcttaaataaacaagaatcgtattatgtgagagatgttttcctctgctgaaacacagttcagttctactgaactgtgattacaatacctgttatttctactaacaaatcacaacaaaaatattcccaaacttgcaagatcatataaccacaacgcttcctattcaaattctttaataaatggtcttatacttctgttatagaaacacactttccctactccagtacaataaatctctcttttctggtaaattacctatgaatcaataaaaaattcgcaaaaattaatgtatataacctttagatataaaaaataagaggtagccttcctctaagtcctgactgaggactcaccataatcctcctgtgtgatgttaactaccactcctccacctatatcgatttgtctctgggtagaactgtcttccagtttccttaggatttcttcctggataccatcatgacccatatctcgtttgcgactcatgaaatgggcatacaactctgtctgggtaattaagaagttgagttttcgctgttgcctcttggcctaaagagggaaaaaagtgaaaacagagccaaattatcaatgatatccaagaagtagtccagaattcaccacttatatttgcatacaattcctttaccaactgtttacttttaaaaatgtaaacatcactgataaacaattttaatttagccaagtcagtggcactaaaagcaatgaataaatttcttttcctttttcagacagagtctcagctggtcgcatgggctggagtatagtggcacgatctcggctcactgcgacctccgcctcccgggttcaagctagtctcgtacctcagcctccagagtagctgggattacaagtgagcaccactaaactcggctaatttgtatattactagtaaagacagggtttcaccatgttggccaggctggtctcgaactgaggtgatccactggcttcagcatcccaaagtgctgggattacaggcatgagccaccacacctggcacaatgaataactttcattcataatctgctagtaacaagtgttttgctctcctttatactgtgaatcttttctctattaggcttctgactaaaatgtttctttcttacattacttttctatggtggcacagagacaacaactaaattcaaacagtatattccattttataacctggatggtggatacatgtctatgtagctttattatttttgaaaatgtacacatgtcagaaacttttcttttttttttttttgagacaagtctaactgtgtgggccaggctggagtgcaatggcacaatctgagcctcaccgtaacctctgcctcccaggttcaagtgattctcctgccttgctctcccaagtagctgggactataggcgtccaccacaatgcctggctaatttttctatttttttttggcggcgggggaggcggggggcagagtctccctctgtcgcccaggctggagtgcagtggcgtgatcttggctaactgcaagcactgcctcctgggttcatgccattctcctgtctcagcctcctgagtagctgggactacaggcgcctgccaacatgcccggctaattttttgtatttttagtagagacgcggtttcactgcgttagccaggatggtctcaatctcccgacctcatgatctgcccgtctcagcctcccaaagtgctgggattaaaggtgtgagccaccatgcccagcccgtattgttgtatttttttagtagagacgggtttcaccatattgaccaggctggtctcgaactcctgacctcatgtgatcggcccacattcagcctcacaaagtgctgggattataggtgtgagccactgcacctggccagccaccacaccggccctaaaactcttaccaccaaaagtcaaaatagctgacaaagagctataaattattctgaaagccaatacaataggtatatgaaattaacaagttaatggaagaaagaaaatactccccaaaacaatctacaggaaggaacaaaatactccccaacacaatctgtattttttggccaggcatggtagctcatgcctataatcccggcactttgggagaccaaggctggcagatcacctgaggtcaggagttcgagatcagcctggtcaacatggagaaacctcgtctctgataaaaatacaaaaattagccaggcatggtggcaggcgcctgtaatcccagctacttaggaggctgaagcaggagaatcgcttgaacccaggaggaaaggttgcagtgagccgaggtcacgccactgcacttcagactgggtaacagagcaagactctgtctcaaaacaaaacaaaacaaaacaaaacccaacaacctatatttcatctgtgataataatagctacaaaaaacgaatatagactgaatacacatacatgtgcaaactttcttttttttttttttaatgtcagaaggctaaattaaaagtgcctttcaggtggactgcttgatctcaggagtttgagaccagactgggcaacatggcaaaaccttgtttctacaaaaaataaaaaaatttgccaggcatggtagcatgtacctgcagtcccagctacactggaggctgaggcgggaggactgcttgagcccaagagattgatgctgcactgagccaagattatgccactgcactccagcctgggtgacagagtaagatatcactttttttctaagtgcctctactctaaaataacctaagaaaaataatcattgtgtcgataaataaaatcattcctaagataaacaataaaatgaaaacataatccaaaataccaaattatatggaacacagaacacagtataagtagcatattaaagagtcattattttgttttctttttctttttttgagatggagtctcgctctctcaccctggctggagtgcagtggtgcaatctcggctcactgcaacctccatctccccggttcaagcgattctgctgtctcagcctcccgagtagctaggactacaggtgtatgccaccacacccagctaattttttgtatttttagtaaagacggggtttcaccgtgttagccaggatggtctcgatctcccgatctcttgatccgcccacctcggcctcccaaagtgctgggattacaagcgtgagccaccgcgcccagccttgtttgctttatttttttttttttccaaaaaagagcattattggtccaagagtcattattttgaattatttcataacaaaattcataaaatatacttgatttatccttgatccactctcccaaaagaaaaacaatacaatagggaatacagcaaaaaaaaaaaaaaaaacccaaaaggctgaaagtatattttataaagcagtaacctacgtaaaactatcctgtctctttaaagctttatagcacttgagccagatccaaaatagaagaaaacttgagaaagagagtgagagaaaattaagtttttgtcttcatgaatgttcatgtttcaaacctaaagtgctatcaagaaaatctttgtttttttctgaagagatggtatcttactctgtcacccaggctggaggcagtaacaagaacacagctcactgcagcctcaacatcccaggctcaagcaatactcccacctcagcctccaaagtaactgggactataggcatgtgccactacacctgtctaatttttctactgtttatagatatgaagtatcactatgttgcccacactggtcttgaactcctagattccagcgatcctcccgtctctgcctttctgctaggattatgggcatgagccaatacactcagcctaaggaaaactttctaaagtaaaacaattaagaaaaagaataacatctttttttttttttttgagatggattcttcctctgtcacccaggctggagtgtagtggcacgatctcagctcactgcaacctccacctcccgggttcaagcaattctctgcctcagcctcccaagcagctgagattacaggcggccgccaccatgcccggctaatttttgtatttttagtagagacagggtttcaccatgttggccaagctggtcttgaactcctgaccttgtgatccacccacctcggcctcccaaagtgctgagattacagacgtgagccaccgcgcccggccaagaataatatctttaaccctaaagaagttaactaccatatgattaaatgaacgaagtagattaagaaaacagaaaggatatgtcaaaattttatttcagaagttcaaagaaaaatgcataagtcagcataaccatcagttagctatcaacataactaagaatctaggtctcagaaatctagaatataggccaagttgcctgcaaaacttcaagatctgtggctaactctgaaatgactttaaattctctgagttaagaattcccaaaagcatcaaatgtttactaacttgataattatgattaccttgcatgcaaatatacgaattaaccaggagacttaagagaactgagcaaaatccatcttcattctcgaagtcatgataaaataagggaagatcaagagctcagaaaaggctccaaagctccactttgacatgagttactacatatacctgaaagaaaacatcatccaaaccactaattcccttctttcttcaaatctcaactctccttccattcatctcagctggtttatcaatggcaatacaatgatttgccttcttactctctcctcttgcttccctcagcaatatacacagcctacatcagctggcatcaggtttaccaacagtactggctgcaagttaaaacagtaaagtaggctgggcatggtggctcacgcctgtaatctcagcactttgggaggccgaggcaggcgtatcatctgagctcaggaattcaaaaccagcctggccaacatagtgaaaccctgtctctactaaaaatacaaaaaattagccaggcatggtggtgggtgcctatagtcccagctactcaggaagctgaggcagaattgcttgaatgtgggaggcaaaggttgcagagccgagattacgccactgcactccagcctgggcgacaagagtgaaacttcatctcaaaacaaaaaaataaataaaacagtacagtaggtgaagggtaagtcttagaaaactgggctcattgtccactgtccctatctggccctgaatttggcatctatttcttactgtccaaaaaaagcaaaactgcagtcagcacctacaaacaaaccaagatgaattaaaagctactttctttctcttttgctcattcctttttcttgaggaataagagcccagaatagaggaagacagcttagaagaaaagagaaaaaggcctgaggagggccttaccaaaagactaaaagcagaattggtttactagtctaaaatcaccatcctcaaaattaagtctttaaaaaaatttctgacggtaggagatcaaggcaggcggatcactcgaagctcaggagtttgagaccagcctgggcaatgtggagaaaccgcatctctaccaaaaaaaaaaaaaaaacaaaaaattgacagtgtcattggttagatgtacaattttcaaaatgcaaacgaatctcttcaaatggctgtagtaattagggttttcaaaatgttatgcttttgccctacctcccgcatttcctcatccaacttccgctgctccaaagcttccttctctgctctcttgcggtgctccttctctactttctcatatttcttccagtacagaagcatctccttggtgaggcggcgggcacgaggcaaggtttccttacagttcttctgggcctgcaaggcagctcgacgcacctccttcatgcactggtgagcaagctgaaaacaacaacagcattacagcggaaaggaccccataccagaagctggttcttcctggactctaaaccacatcattcctcaatctgttcagccaaactgtcatccttgaccacatctttctcctgcaacttgattaatgtccttgtacagtactgtgacataggcccagaccctgtggtattatcagggataagaaatctatccaatttctatcaccttagaagatgaaaaattataatgatgaagaaggacctgggatgtgcttggaagttacaaaatgttattgcacacattaataacagctatcactgcttattacatctttagcaccactgaaaaatatattaaaccaatttactcttcacaaaaaccctatgaaattggcattaccatcaccctcatttataaatgaggaaacacagttgaatgactaccccagagaaacacaactaataacatggcctaatctgatcctcacaattcttaaaggaagttgttttagtctcctctaagggaaggtattcacatcattatttcttagacgagactgaagacaggaagattccatgatctgctcaagaaatcagggtgggctatggtcttatccaaaaaggttcaaataccagaaatgtgaggaagaacaattttatttaataaacagattgaggccgggcgcggtggctcatgcctgtaatcctagcactttgggaggctgaggcaggcagatcacctgaggtcaggagttcaagaccagcctggccaacatggtgaaactgtctctactaaaatacaaaaattatagggcatgatggcaggtgcctataatcccagctactcgggaggctgagatgggagaatcgcttgaacctgggagacggtggttgcagtgagccaagatcactgccactgcactccagcctgggtggctgagactctgtctcaaaaaataaaaataaaaaataaacagcttgagaacattcagaaactctcttacgaactattagattcatgatcaacaggttacgacggacaagagcagcaagatggaccccaaagaagaagaatatattccagcaaaacatgaaatggaaaatacaaaactacaattttacctttcggctattggtgagaaacaggttacgagctgaagctttctgcttatttgcctaaaatatttaaaaaacaatatttcatttaggattcatttttgaactaagactatgtagaatgaacagtcttttactcaattcctagagggttagaaaatgtcaagccaagcaagatatattacttctataagtcatccagatgtattgtctcaacgccatacataaaacgattaaagaagcattcaagaagaataagtcagcattgtggatgccttaaatagtcttctgtatacttttgggaagatgttaagttacatgtaaggcttgaagtggactagaaaaatgttacaatacctaaaccttagcactatcctgattaaaaacatgttgcttaccagggccaatctgcaaggctgagagagcagggcatccagatacaggaatcattaggagaaagataaactagtctcctaagtgtgattctagccccacctccagcctaggcaaacctgatgtcactattactcagtttctgccaccacataagcctaatcttctctaaaactaaactccaaggaagacctaacacaaaatgacccagcagcccacaacccagctatttgtgttttccactctagctaaggggaaaaacaaaagtcagtacagaaacctgactccccatgatgtctatttgacatggaagaagatgctgaagaggcagagctgggtggctctttcagtactgaagagtactctccttgatgttaaagaaacaatgggttcaaagtgacaaagaaggtctgaaagccatttctttaatgtttgcacgtaagacagcaaatttaagggaatatatgagccttttataaaaaaaaaactcttactaattaaagagctattgtcactctgaagccaggaacctcaaatattcccactaaaaagtcatttcctggccaggaatggtggttcacgcctgtaatcccagcactttgggaggccgaggcgggtggatcacttgaggtaatgagtttgagaccagactggccaatgtggtgaagccccatttctactaaaaatagaaaacttagccaggcatggtggcacatgcctgtaatcctagctactcgggaggctgaagcaggagaatcacttgaactcaggaggcggaggctgcagtgagccgagatcgtaccactgcactccagcctgggtgacaagagcaaaactccgtctcaaaaaaaaaaaaaaaaaaaaagtcatttcttggccaggcgcagtggcttacacctgcaaccccggcactttgggaggttgaggcaggaggatcacttgagtccaggagttcgagactagcctgggcaagatagtgagacctcgtctctataaaaaataaacagaattgggccgggcgtggtggctcacgcctgtaatcccagcactttgggaggccgaggtggttggatcacctgaggtcaggacttcaacaccagcctggtcaacatggtgaatccccgtctctactaaaaatacaaaaattagctgagtgtggtggcaggcgcctgtaatcccagctacccaggagggagctacctcaggagaattgcttgaacccgggaggtggaggttgcagtgagtcgagatcatgccattgtactccaacctgggtgacaagagcgaaactccgtctcaaaaaacaaaaaaaaattaaataaacagaattagctcagtgtggtggcacacacttatagccccaggtactaaggaggctgaggtgcgaggactgcttgagcctgggagatcaacgctgaagtgaaccaagatgagtccactgcactccagcctgggcaacagaacaagaccctatctcaaaaagaaatgaaaactcatttctttcattgaaaggacaccatctgaggcctcttcatcaggtactaagtcatgggaaagtttcccataactttcccatcaagaatgctcaagcacaggccgggtgcagtggctcacgtctgcaatcccggcactatgggaggccgaggcgcacagatcatgaggtcagaagatcgagaccagcctggctaatagggtgaaaccttgtctctactaaaaatacaaaaaaaaattagccaggtgtcgtggcgggtgcctgtagtcccagctactccggaggctgaaggaggagaatggcgtgaacccgggaggcggagcttgcagtgagccgagatcgcactccagcctgggcgacaaagccagactccgtctcaaaaaaaaaaaaaaaaagaatgctcaagcatcaactatgtctccagaaatacttattaactgctatggaaaaaaaattttaattttacagtagcaaaacaccaccataccaagggatcaaaggtaatatcctcaaaacattaaaacaggttgggcatggtggctcacacctataattccagcactttggaaagctgaggtgagcagctcacttgaggtcgggagttcaagaccagcctgaccaacatggcgaaacctcgtctcttccaaaaatacaaaaattagctgggtgtgacggcgcgcacctgtagtcccagctactcagctacttgggaggcagaagtgggagaatcgctgaaacccaggaggcagaggttgcagtgagccaagatcacacacctgtactccagccagggcaagagacgagactccgtctcaaaaaaaaaaaaaaaaaaaaattaaaacacactataacctccatagtttaaaaagtgtcatactaacctatatgaagtatatgtgtaagatgcagatctagttttatctaaattgctacccagttgtctcggcactactaatttgtaagtccaccagcttattctactcatctatttgcctattcatgtgccagtaccatacttttttaactgtagaggttttgtagcgtgttctaacgtttagtggggatttttccaattcttccccagctactcctacattctgacttcatcacatggactttagtatcaacttttctcaattcataaaatatcccgtttctaaaaaaaatccaatttataatgaaatatcctgttcctatcaggattgcactcaattcatccttaagagtaatatgtaaacaactggtgaatctcacttaagggtaaacagacattccttggactataattgcaacttctttaaaaaaaaaaaaaaaacgctacatatggcatctggtttgcaactattaattttgaaattatatcaaaataacatgttattggctgggcgtggtggcgcacacctgtaatcccaacactttatgaggcggagccaggcagatcacctggggtcaagagttcgagaccagcctggccaacatggtgaaaccccatctctaccaaaatacaaaaattagctgggcatggtggcatctgcctgtagccccaggtacttggaaggctaaggaaggagaattgtttgaacctgggaagcggaggttgcagtgagccgagatgatgacactgcaatccagcccaggcgacagagcaagactccatctcaaaaataataataataaaataaaatgttatcaaaaccaaatgaattaagaggaaaaatgcttatacatgtttaactcgttcacattttattctagtgcctgtgattatccagcaacattcaaacatttgtaaattctctaagaaacatatcaactcctttttattttatttaatttttgagataaaataaataaatatttattatgttacacattctgttacacaagctagagtgcagtggtgcgatctcagctcgctgcagcctcaacctcctgggctctatctatcctgcctcagccacttgcatagggagggctacaaacatgtgccgctacgcccagttcatttttgtagtttttggagagatggggtttcaccatgctgtccagactggtctcaaactcctgggctcaagcgatctacccacctcagcctcccaaagtgctgggattacaggtgtgacctgccatgcctggcctctttttaattttttctaatatcacctataaattggctgtcaagtatctattgctatatttaggaaaactgcattcttttcttgaagaagttgtcctccaattttttgaccacggagcatcacacaataactaattgtcttgtgaattctgaccacattctagaagaaactgttaactgaaagagtactactcagcattttcttgattccaacagattagtttctttgcagaattcctatctgtgaaagtatctagctctcagagttcctctttagtgggtggggagagaaaacattctcctaatttccatctcctggaggcattcacttacctttggtagttcctttttcacaatgctgagccatactttcctgcgacgagcattcagctgctcaatggataagtgctttttcttagtgccagggggaggtgcatcgtgagaaaacttggcaaagactttggtctggtggtgatggcgacgaggggattcttcagaggaaagttcttcatctcttcgtctttttttcttcacttttttcaacttagctgcaaaagaaacagatgcaacaggttgcacttccacaggagatagtcacaaagcaacctcatgacttaaaacatgcaaggttctttccttattccacctgacactgacaacacatatccctttatctactcagacccatgaatattccttgaggaagaaaagtaacagagaagaagaaacatactgattgatacctcactaacctggaaaagaacactggatactcactctgtttatatgaaagtgaaatacagaataaaacccgagaaccaaatttcttttattttttttccgagacggagcctcgccctgtcgcccaggttggagtgcaatggtgcaatctcggctcactgcaacctccacctcccaggttcaagcgattctcccgcttcagcctcccgagtagctgggactacaggcgcgtggcaagaaccaaatttcttttgaacctaataggtaaggatgtgtctgaggtatcacagactcaagtaatagtcaaaggaaggaaacttatttctacttggtggcaatataaggtggctatacatctatgcagtgtggggaaaataagaaaaaagtatacctataaggtggataaagaaaaataaaagagaagaaaaagacatattgatatgtcactaagacttgcaagacaaaaatacatgaaacaaaaccttaattcaggttggagaaagtgtgtggagggtgagaaaacactaataaagataatagagaaagaagggaaggctaaaaggagcctttttgagtacaattcatacctttaagccaggtgcgatggctcacgccggtaatcccagcactttgagaggccaaggcaggcggatcacctgaggtcaggagttcaagaccagcctggccaacatggtgaaaccccatctctactaaaaatacaaaaattagccaggtatagtggcgtgcacctttaatcccaactactcgggaggctgaggcatgagaattgcgtgaactcaggaggtagaggttgcagtgagctgagatcacgccactgcactccagcctgggtgacagagcgagactccatctcaaaaaaaaaaaaaaagaaattaatactttcaggggaataaaatttgcctcacaaagatagtttaaaactttctctttcagtttccttcctgatatccagctgctgagagctcagtaagagaggaaaggacatttcctggcaaacatgcaaacaaacactacagaagatcatcaggaggtgatctattttaaatcacctcggacagcaacaatgataacttattccaaacacttcaggttacttttcttacttctctgtgcataaccaacttcctatcccagaacatttgcaatatttgcagagtgtgtataagaaaaatggaataaactaattttgcctaaacctttagctaggaatctgtctttccaattctagaactaaagactataagccaaatatgaattaaggttaataatatagtctacccttcctatctgtgggttccacatcatagattcaaccgaggatcaaaaatattcaggaaaaaaaaaaaagaatggttgcagcagctgtactgaatatgtacaaactttttttggtcattattctctaaacaatataggataacaagtatttacatagcatttacatcatatgaggtattataagtaatccagagatgacttaaagtatacgagaggatgtgcacagctcatatgcaaatactataccattttacataatgaatttgagcatctctggattttggtacctgccaggggtccagaatccaatcacccatggataccaaagggaaaactgtacttgctactaattagaaaggagagtttttcagataaagcaaatttctaccatatggacttatatataaagtccaaatgcaccagtaggccacatgcaattctgaaactaagaatgaatatacgtggaaggcagttcaacatgctcacctttaagtttcttttcctccttaaatttctttttcttgggtccaagtaggtgccgttgttgctcatagaaagggtcatatgtggagagcaggcctgcactgtagtactgatattgctgcaactgaagcaggcaaagaccatgatgggcctgttttctatagtacagctttcaaattacctttactacagaaaactaagccagaggaaatcatagctcctaaatacagtattcttcccacaaagagatcagtaacatctagtatatctaagggaatcacttacttaacttcaaacaaaatgagttcaactcctatacacgtaacaagtcactgaaaataatttaagaaagcaaaactcttcatgcttctgaatttctacatacttacttaaacctgacatatactaagacatgaaattaattccttgcagaaatgtctccccttggaaattcaccaccaagaaataagccatacttctattaccaacagttcctcagatttactaaggttcctcatgcttgcttttcttttttttttttttttttttttgagacagagtcttgctctgtcgccaggctggagtgcagcggcatgatctgggctcactgcaacctccgccccttggttcaagcgattctcgtgtctcagcctcccaagtagctgggattacaagcacacgccaccacacccagctgatttttgtatttttagtagacacgaggtttcaccacgttggccaggatggtcttgatctcctgacctcgtggtcagcccatctcagtgtcagcccacctcagcctcccaaagtgctgggattaacaagtgtgagccacttcaactggcccttcatgcttgcttttctattagtcatatgtctgcttcaaatagtcaccagtcatcccaattcttgaatctttcaagtctttcctctcttcatctcccactaagacagtctgctattattataaatagtgcctacattgccagaattctaacatatgaataacgtaactctttccatccaggaagtggtaagtaaatgcttccaaatatttcacttactccccaaatctcatattaattttgtttcacatattactaatgcataaatataaattaaaattaggtagcccactattaaatctctttcctggattatagccaaataaattgtctgaggactgaaataagactgaaagattaacatggggaactattacaatgtcctctgttaaaaatcaaaattaaattagcatgcactgagctgtacacttaaagtctgataactttcctatatgtatgttttatctgaatttaaaaaacaagcaggccaggcatggtggctcagctgggcgccatggctcatgcctgtaataccagcactttggaaggccaaggtgggcaaattatttgaggtcaggaagtcgagaccagcctggccaacatgatgaaaccacatctctactaaaaataaaaaaaattagccaggcatggtggcaggcttctgtagtcccagctacttgggagactaagacaggagaactgcctgaacccaggaggcagaggttgcagtgagccaagatcatgccactgcatttcagtctgggtaacagagcctccatctcaaaaaataaaacaaaaataaataaaaaataaacataaaaaacaagcaaatacttggagcgccaagtaccttactgctggagtttaagaaggaaggaactttttacatcaaaagggtcagatactctgttaaccacttctacaggtttataaggttcagaatattattccaatctctctgaactaactttggaccttaactaattgctagaaaattcttaggtcttcaaatatactattgctcattatgtacaacgttccacacttgtagaaatagtcagaaggcggctgggcggggtggctcacccctgtaatcccagcactttgggaggccgaggcgggtggatcacctgagtctgagacaagcctgacgaacattgaaaaaccgtatctctactaaaaatacaaaaatagccaggcgcagtggcgcatgcctgtaatcccagctactcgggagactgaggcaggagtactgcttgaactcagaaggcggaggtggcagtgagccgagatcacgccattgcactcgagcctgggcaacaaaagtgaaactcaatctcaaaaaaaaaaaaaaagaaagaaagagtcagaaggctttggtaacggcattcaaatagttgtcactcaaaactatcatcattttaatgttagtgtatgaagagctttctaagagagaaacactacacccaaagagcaactgcatgaataagcaacactagaatgtaagcattctggcaattcctcaaaaggctaagcaaggtgtttccatatgacccagcaatttcactgttaagtatataatgaagagaaacgaaaacacatcaacacaaaacctgtacacaaatcttcataccatcattattcaaaatagccaaaaagtagaaatatgctaatcatagttcatgaactggacaatgcatatataagataaggtataaatacaacgaatatttgcaataagaagaaatgaaatgctgatacatgctacaacattaatcaatcttgaaaatatgacattaagtgagagaagctggacacaggcacatgttgcatgattgcatttgtatgaaatgtctagaatgggcacatttatagaaacagagcagattgggctggggatggtggctcacgcctgtaatcccagcactttggtaggctaaggcgggaggatcacctgaggtcaggagttcgagaccaacctggccaacatggtgaaaacccgtctttactaaaaacgcaaaaaaaaagccgggcgtggtggcacacgcctgtaatctcagctactcagcaggctgagcaggagaatcgcttgaccctgggaagcagaggctgcagtgagccaagatcgcgccactgcactccagcctgggcaacagagcgagactctgtccaaaaaaaagaaaaaaggaacagagtggattggtggttgtctggactgagggacagaaagaatgaggggcaacagctaagaggcatgcggtttctttatgaggtgatgcaaatgttctggaattaggcagtaatgatagtaacacaactatgaatatattaaaaaaacactgaattgcacactatataaggctgaagttttgttatgtgaattacatctcaataaagctgctccactgctacctaaagttaaaatgatgtatctttttttttttaagaacatatcttttagtctagtacatccgaagtattagtagtttaatttcattgattccagagaattttagaaattctttttttttttttttttgagatgaagtcttgctctgtcacccaggcaagagtgcagtggctcaatctcggctcactgcaacctccacctcccgggttcaagcgattctcctgcctcagcctcctgagtacctgggattacaggcatgcaccaccacgcccagctaattttgtatttttagtagagacacagtttccttatgttggtcaggctggtctcgaactcctgacctcaggtgattcacccgcctgggcctcccaaagtgctgggattacaggcgtgagtcactgcgcccagccaactttttgtatttttagtagagatggagtttcaccaagttggctgggctgggctcgaactcctgacctcaactgatctgcccacttcagcctcccaaagtgctgggattacaggcgtgagccaccgcacccagtcaggaattttctcttttttttaagtaccagggtacatgtgcaagatgtgcaggtttgctacacgggtaaacatgtgccatgtggtttgctgcacctatcaacccatcacctaagtattaagcccagcaagcattagctgtttttcctgatgctctccctcctcctgcacccacctgcccaggcccagtgtgtcttgttccccttcctgtgtccatgtgttctcattgttcagctcccacttacactcactactgaggataatgatttccagctccataaaatgatgtatctctttttttttttttttttttttttgagacagagtctcgctctgtcgccaggctggagtgcagtgctgtgatctcggctcactgcaacctccgcctctgggttcgagcaattctcctgcctcagcctcctgagtagctgggactacaggcgcacgccaccacacccagctaaattttgtatttttagtagacagggggtttcaccatgttggccgggatggtttcaatttcttgacctcatgatccgcccgcctcgtcctcccaaagtgctgggattataggtgtgagccaccacgcccagccaaaatgatgtatctttaatgactataaagcagagggtgaatattcagtttgaagtgtttctcctgaaactcttacctccttgtctttactatacttattttggtgaagtttcttatatttgtgtagtcgaagcatgttgtgaagttcttctctgctgagattgagttcttcttcatcatcgtcttcactctgagaatcagcctcgctggattcatcacttagcagaatgctctgaaaagggtgaaaatagaaatgtatcttttgctgtgaagcaatcccatttataatccaagcattttttcctagatccaaaacaatgacaaaaacagcagaaagatagtcactccagttccccttatgacatgctttataaattcaactgaaaaacattaagaatactaattaaacttagggaatacaaactaaaatgcaataaaacatgggacatgttatcagcaacaaggctaaaaattcctctgaatacttacaaaagtataaataatacataaatatcatatacatacaaactatacatacatgccaaacaggaaggcaaaaaaaacaactacctatagggtataaaaaaatatagaaagcaagctgtaatggcccaaaaggagaaatatcccaaatatccatttattgataaatggataaataaaatgtggaatatccagataatgagatgtaattcagccatgaaaaggaataacacatgagtaggggctacaatatgaagaatcttgaaaatattatgctcaattaaagaagtcaatcataaaaggtcacattatgataggattcaatttatacgaaatgtctaggctgggagtggtggctcacacctgtaatcccaacactttggcaggcccaggcatgaggattgcttgaggccgggagttcgagactagcttgggcaacctaataagatctcttctctacagaaaaagacatgtgcctatagtcccagctacttgggagacagaggaggaaggattgcttgaccccaggagttcaagggtgcagtgagctatggctgcaccactgcactccaacctaggaaacagagcaagagcctgtctcctaaaaagaaaacaaaaacaaaaattccagaagaggcacatcaatacagacaaaaagcagattagtcgctgccaaaggacagaggaaatagaaaatggagagtgactaccggccgggctcagtggctcatgtctgtaatcccagcacttcgggaggctgaggcggggggatcacaaggtcaggagtttgagaacagcctggctaacatggtgaaaccctgtctctactaaaaatacaaaaattagccaggcgtggtggcaagcgcctgtagtttcagctactcaggaggctgagacaggagaatcgcttgaacccaggagggagaggttgcagtgagctgagatcacgccactgcactacagcctgggcgacagagcaagactccgtctcaaaaaaaagaaaaaagaaaatggagagtgactgctaacgggtacggggttcatttcagaatgttaaaaattttctgagattacattgtaatcatgggtatacaactttgtaaatacacgaaaaactactaaattttaacctgtaaaagggtgaatttggccaggcacggtggctcacacctgtaatcccagcactttgagaggctgaggcaggcagattgcttgagctcaggagttcgacaccagcctgggcaacatggtgaaacccccaaaaattagttgaacgtggtggtgcgggcctgtagtcctacttcacaggggtgaggctggaggatcactagaacccaggaggtcgaagctgcactaagctgagattgtgccaccgcactccagccagggtgaaaaagtgagaccctgtctcaaaaataaataaataaaaataaaataaaatgaaaaggtgaattttatgacaatgaattataactcaatttttcaaaatatgacggctaagcataacaatttctgcatttccaacagcctaaagtgcaactgatattaaccaaatcggaccttttacacatgagccttttgaaggacctagtgataataatgaagggttttaattgcttttgagtacttcatagcaaaagtataaaagagaaataattagtttcaataaaagaaatactatccttaattcagtttggccactgacagtaatcttgtaagagtgtaaatgagattaacaacctctctgcttgtaaacactccaacggcttatgcctacgacagtaaaacacgaactccttaacatagacaaagcctgtgtgatcacagtcttgtaacttcatcttccaccatcctcctcattcactgtgctctagccatattagacttctttttccaccaaacatactaagttgtttcttttctcaggacttttgcagttgttccttctgaccgaaatgccgttaccctggatataagatggttctctgtgatcattcagaatcagttgaaatgttacgtctttaaagaagccatgtttatttacttgtttacaggcttactaactgcctgcctcctttagaatgtaagcaccactgggcaggaaacttgcccaaccataatcgtacctggcacatgcacatggatgcactaaatcaacatctgttaaatgaataaactactcaggaacttatggaagttatggaattaatataaattatggaacttatggaattaatattcctgattatgtgacccaatgagtgcaaggacttcatctgataaatttttgtacttcctgtttcccctcagtacgttataacaggttgagcatccctattctaaaaacccaaaatactccaaaatctcaaaggttttgagcaccaataagatgccacaagtggaaaattccacacctgacctcacgcgacaggtcacagtcaaaacacaggtatacaaaacagagtttattcaacatccccaagggaaaaatataattaccttcagactatgtgtataaggtgtatataaaagataaatgaatttggtgtttattaacttgggtcccatctccaagatatctcattttgtattgcaaatattcaaaaaaaaaaaaaaaatctgaggctgggtgcggtggctcacgcctataatcccagcactttgggaggctgaggcaggcagatcacctgaggtcaggagttcgagaccaacctagctaacatggtgaaaccccatttctactaaaaatacaaaaaaattagctgggcgtggtggcgcatgcctgtaatcccagctactcaggaggctgaggcaggagaattgcttgaacctaggaggcggaggttgcagtgagctgagatcatgccattgcactccagcttgggcaacaagagcaaaatgttgtctcaaaaacaaaatctgaaacacgtctggtctcaagcatttcagattagcaatactcaacctgtactcaattcatgtttgctaaatgacttcattgaatcctccagattttctcaataatctcttcaaaaaaaccacatccagtataagagaatcatatttgaaaaactctgtcaatctgccaaaatgagttgataactttcccatctattagtaactttagtagactatctgcactgtaaacaccctgctttatctcttacctttagccactttctgcttttcttcagcttagagaaattatataaattccccttatcacattttgattctgtataaagaaacacaaagaataaaaaaattaaaggatgactgccccaagataacgatagtccaaagggggatgtcacaccacactgacctgactgtagaactccattcagagaatatgtgtttaacattccagaactgcctgctccagaagtttcaccaagcaatgaatttggaggttcttccttaacttgtattaagggatccccagactggggcaataatggattactgtcatccagtccatcttcactgtcatcactataaattgaagaatgagtccacaattacagctgacccaataaaatataatttaaagttagaactggacactttacagaagaaactgttcctctgaaataaattgacttttttatttgaaagaggcaaaagaaaatatcaaacataaaaatcataagatactttaatcctgtaaaatctgtaaggatgatggaaatcaggaatttggtaaaacatattgcaaagatacaataacatacctagaaatattcctattgaagatagctgacgtttgtcgcagaaaatggtccaaccggagggccctctccaagtactgaagatagaggggctttgccagctcagtgcagcctccatcatccctggcacccaactccgaggccatagaacaaatctgtcttcatgcacaaggacctccgactgcacggctgcagaacagagataagaagtgaaagatgaaattactatccattctccctttctcttgcctgcttgttcccaatgtgaagagaaatcagaccttctagaacacaagacactgaaaagacaggagtctgcagaaagatcatgataaagctcttgttagacactgcctcctaaagcaaaggcagaagttaaaaggatataaagaatataaaaatacagcaacacagttacatttcacaatgaaaattcatactatactttttcaaaacagtatcttaaaatgtatacccacttcctttatccctttcaataaaaaattacccaaaactatgaataaacaactatccaaatctacaccccaagctcactgttgtgcacctcagaaaggaaagtactagaggagcactcgttctcagcatcaccttcaaaataggtgctgccctcttcattttgaattcatattcatacatatatgtaaggtatcttatttacaagggaatagatgtattggcagagtattttactatcctttgtaaaaatgccataatgagtaaaatttaaatttagaaaattggagctaaaagagtaaaagtgagggtgagaaacacaggtatagcctaagcattctctttgctaccttacattgttaaagacaacattagggtcagaacatcttcactagagacacaatcacacaatcacacaatcagtataacaacgcttctcccaccactttcttgtttgtttttgttttttgagacggagtctcgctctgtcacccaggctggagttcaagcaattctcctgcctcagcctcctgagtagctgggattacaggcgcccaccaccacgcccagctgatttttgtatttttagtggagacggggtttcaccatgttggtcaggctggtcttgaactcctgacctcaagcaatccacccaccttggcctcccaaagtgctgggattacaggcttgagccaccgcgcccagccttctcccaccactttcaaacagtagcatctgccttatacctggttatctctaaatacttaaagggttacacgaagactaaataatgacataatttagactaataagcccaccaaatgacataaatactcaataaaccataaattattgttatgatttttttcagacggagtttcgctcttgcagtagggtgatctcagctcactgcaacctctgcctcacaggttcaagtgattctcctgcctcaggctcccaagtagctgggattacaggcgtccaccaccacacctagctaatttgttgtatttttagtagagatggggtttcaccatgttggtcaggctggtctggaactcctgacctcaggtgatccaccagtcccaacctcccaaagtgctacgattacaggcatgagccactgtacccagcctaaaatacaaaaatactaaaaatacaaaaattagctgggcatggtggcaggcgtctgtaatcccacctactcaggagactgaggcaggagaatcacttgaacctgggaggcagaagttgcagtgagccgagactgtgccactgcactccaggctgggcaacgagagcaaaaccccatctcaaaaaacaacaacaacaacaacaactaaatgaaatgataagtttttttgtttatttgtggcggtttttttgtatttttagtagagacagggtttcaccgtgttggccagaatggtcttgatctcctgaccttgtgatccgcctgtctcagcctcccaaagtgcagggattacaggcgtgagccaccacgcccggccaactaagtgataagctttaaaggcaatcatacatctttgagttgtcttctcttttttttacaattttctaatataactttcctatctaaaacagtgtaacttctagaaaaaccaggagaaaatcttcatgactgaccataaaaaattctagatatgcaatcaaaagcacaaaagatcaaaaattagcccatgcgaattaaaaatgtttacactttaaaatatatcattaagaaaatgaagacaaactaggcacagtggctcatgcctgtaatcccagcactctgggagactgaagtgggaggatcacttcagcccaggaaaacaagatcaacctgggcaacacagtgagatctcatctcttcaaaagaatttaaaattagctgggcatggtggcacaggcctctggacaaactattcgggaggctgaagtgggaggatcacttacagcccaggaggttgaggctacagtgagccatgatcttgcaactgtactccagcctgggtgacaaaaaaaagaaaaagaaaatgaagacaagccacagactagaagatacttgcaaatcatctatctgataaaggtcttgtatccacatatacaactttttttttacacagttgtttgtcagtgtgtacacataaaacctacaactctataagataaataacccaatttaaaaatgagcaaaagattttgaacattttaccaacaaagatgtatgactagctaatagacacatgaaaaaatgctaaatattaataaattaaaattaaagcaccatactacttcatacccactagaataataaaaaagacaggctagacacagtggctctcacctataatctcaacatttaggaggctgaagtgggtggatcccttgagcccaggagtttgagaccagcctgggcaacatagcaggaccgtgtccctacaaaaaatttaaaaattagccaagtatggtgatgcgtgcctgtagtgccagctactcaagaggctgaggtgagaggattgcttaagcccaggaagtcaaggctgcagtgagctatcattgtgccactgtgctccagcctggagtaagaccctgtctcaaaaaaaaaaaaaaaaaaaaaaaaaaaaaacaaacacacacacacacacacaacaagagagtgagagagagggaaagaaaaagggaaaaaaaaaatgttccaaactcccattgtggcgatagttccacaattctgtaaatctaccaaaaatatattcaaaatatactgaactgtatattttatttaaattatgtgaatttcatagtttgtaaattgtcagtcttggtaatataaagaaaaaagaatgctaaaaaatacttttggccaggagcagtggctgaagcttgtaatcccagcactttgggaggtgaggcaggaggagagcttgagcccaagagttcaagaccagcctgagtaacatggcgagaccttgtctctacaaaaaaatttaaaaattagctgagtgtagtggcatgcacctgtaaacccagccacttgggaggctgaggagggaggatggtttgagcccaggaggttgagacctcagtaagtcatgaacgcaccactgtactccagcctgcataacagagtgagactatccaaaaaaaaaaaaactttaaatttcaccttttcaaaatgagacctaacgtgtacccacccactccagaagatttcaaagaaattggtttttaaaatacaacaaaactcccttaagagaacagcaaataattcatcttgatacatgtataaatgtaaaactactctgcttggctccatcccaagcttttattacagaacaattaatccatgctctagttattttacctgataaggaaaatgacactaattaaggaggtatgactaccaagtaatacggagtgattcgaaatgaatggaatattttcttttcttttttttttgagacaaagtcttgtagccgaggctggaatgctgtggcccaatctcggctcactgcaagctctgcctcccaggttcacgccattctcctgcctcagcctcccgagtagctgggactacaggcgcctgccaccacgccaggctaactttttgtatttttagtacagacggggtttcactgtgttagccaggatggtctcgatctcctgacctcgtgattcgcccgcctcggcctcccaaagtgctgggattacaggtgtgagccactgtgcccggccaatgaatggaatattttcaaaacttattcctcagtacctatgtgagtatgaaatcaaaaacaatttgttgaagaaagatcacagttaacttctagtcttacaatcctcaatatatgctcccttttgacacccagtatacatcagtcctgtcaactgattcatcccagaaatcatctttgcagcatatcaccactgatggctgaaatgacagctgcaatgaattcccttatgtccacaataccaccaaaaaaaggtgctgtaagcacaaaattctccacaagaagtcctatgatgacatctggagaaccaagttatattttttaagtgttcaatttttttctttatggtggcaaaagacataaaacttaccattttaaccatttttaagtgtacacttcagtggcattatatacattcacattgttgtgcaaccattactaccattcacaattttttcttttttttttttttttgagacagaggctccctctgtcgcccaggctggagcacaatggggtgatctccgctcactacaatctccgcctcctgggttcaagtgattctctcacctccagcctcccaagtagctgggactacaggcgcaccccaccacacacagctaatttttgtatttttagtagagatggagttttaccatgttggccaggctggtctcaaacgcctggcatcaagtgatccacccacctcagcctcccaaagtagtgggattataggcatgagccacccacccggctgacaatcatttcttaatcaccttttaagattgctggcctctcaattcagcctagtcttgattagcatgttaaaagctgctgctgcaataaccactttcatctcctcatttgtctcttattccctacaaggaaactgcatggccatcaacctgacccatctgttatcgtccaacttcagcaaaacacttgataattctcaataacccttttacccaccttctaccaattgtttctcattctctaccaagattacttcaaatcttttttccctcttcctcaaaatgctgaagtcattccccgctcatcttggaagagcctgaagagcaaatcattccatcctcttttatttcaccttagctcaatagtttcctcttacttgctgtgatatttgagtcaccaacacaaacagactttatttgtaacttttttttttttttttgagacagagtcttgctctgtcacccaggctggagtgcagtggcgagatctctgctcactgcaagctccgcctcccaggttcaagccattctcctgcctcagcctcccgagtagctgggactgcaggcgcccgccacaacgcctggctaagtttttttgtattttagtagagacggggtttcactgtgttagccaggatgatctcgatctcctgacctcgtgatccacccacctcggcctcccaaagtgctgggattacaggcgtgagccaccgcacccggcctatttgtaactcttagtcaaggtgattctccatactagtacaaaagatatgactatttcttggcgggcatggtggctcatgcctgtaatcccagcactttgggaggctgagacgagcagattacaaggtcaggaattcgagaccaacctggctaacacagtgaaatcccgcctttactaaaaatacaaaaaagtagctgggcttggtggcacgcacctgtagtcccagctactcaggaggctgaggcaggagaatcgcttgaacctgggaggtggaggttgcagtgagccaagactgtgccactgaactccagcctgggcaacaaagcaagactccatctcaaaaaaagaagatacgactatgtcttatgtcacttattatgggttcatgcccatgcatttgcattttaaagtacatactgtgtaagttactttatttatgtttccccaatatattacaattagggcatcatactgctttttaaaattatatattacctatagatttcatttcaggattttaaaaagggcatattaggccaggcgcagtggctcatgcctgtaatcctagcactttgggaggccgaggcgggcaatcacctgagatcaggagttcgagaccagcctgaccaatatggtgaaaccccatctctactaaaaaatacaaaaattagccaggtgtggtggcgggtttgcctgtagtcccagcaacttgggagcctgaggcaggagaatcgcttgaacctgggaggcggaggttacagtgagccagtatcgtgcacactgcactacaccctgggcaacagagcaagactgtctcaaaggaaaaaaaaagggtgtattataaaatatttgtaataaaaaaggagagttgggtctgatacagttgagaaccatgctctctgataaccactgtttatcagaatgaatgaagttgatattgttgagtgactcttgcttttggatactctatttaataatctttgaaaacttggactattccttaactccttgactgaaactttattctaaatgcggagtacaccaaagttctgtcatctattcctacgccttagaaaatctcatcttctaccaggaattcaattaacactgctgtatgactgaccctctggctctcaacttgcacagcatacaatccacatttctagatgcttctagaaaggctttctagatgttttctagcccctacaaacccaaacttctcatatgcctccacagcagctagttcatctgtctttcctatttatataacaattattcagactcaaaatctatgaatcattttttacacccccttctacttctctcctggcatgcagtgagtcccaatgtgtagttaattcttctttgggaataatgtctggaatatgtcagtttcttcctattatcagtgttttcatttagcttcttagcctcacacctagactactgcttcctaattgactttcccacctccaggttcttctcactctaattcatctatgcagatacttccagatcagtattcccaaatcatcgttcttgttttatatttttttgagacagagtctcgctttgtcacccagggtggagtccagtggcgcgatctcagctcactgcaacctccgcctccctggctcaagcaattttcctgcctcagcctcccaggtagctgggattagaggcgcccgccaccacgcccggctaatttttcctattttcagtagagacgggattttatcatgttggccaggctagtctcaaactcctgaactcaagtgatccacctgcctcggcctcccaaagcgctgggattacaggtgtgagccactgtgcccagcccaaattcatcattctgattatgccattagttcctcaatagttttccaaaactcaataaaatctaaattcttcagcctgaaatttaaagacctttatcatctggttttgagttactttttacaatttaatcttttactacttccccacattccaggcaaattaagagttcctttaaaatgtctcttaacttcctatcagacctgtctcacttcgcgcaaagaggctctttaaaattcatctgactgccaggcgcagtggctcacgcctgtaatcccagcaccttgggaggccaaggaaggctgatcacctgaggtcaggagttcgagaccagccatctgaccaacatggagaaacctcgtctctactaaaaatacaacaaagttagtcaggtgtggtggtgcatgcctgtaatcccagctacttgggaggctgaggcagcagcatcacttgaacccaggaggcagaggttgcggtcactgcactccagcctgggcaatgagagcaaaactccatctcaaaaaaaaaaaaaaaaaaaaaaaaagtaataaaataaaataaaattcatctgaccagaggctcatactgtattgctaaggatgaaagaactattcaatatgtttttggaacaattcttcattgaatagcctgttccacaccctgaactctggctcattatcctgaatccgaactctgatcatatttcagctgccctgccaacagcttcatgttaatggtaaatgtatgcttcagaatcatacccacatatatcagacttcctgagctgtgttcatgagtaatcctgggctgattgctttgtactctctagttactgccaggcccttatttcttttcttttcttttttttaaaggggagtcttgctctttctcccaggctggagtgcagtggtccaatcttggctcactgcaacctccgcctcccagattcaagggattctcctgcctcagtcttccgagtagctgggattacaagcatgagccaccacacctggctaattttttttgtattttagtagagacgaggtttcaccatgttggccaggctggtctcaaactcctgacctcaaatgatttgtctgccttggcctcccaaagtgctggaattacaggtgtgagccaccacacccggccaacttatcagtatttatattgtacagaattatgtattctgtacaaaattcacttttatatttaattttactatactaaaagtcagttttcattatgggagtggatacacttaaccagtgtgggtagtaacagacaagttatgtagaactgtgctcctcaaagaagtctgaaaatcaaagttcaggtaattcatcccaaagacaaaccatctgcaaataagcatgagttgaactgtacactaactggatcctgcttttcaaactgtagatatttaagtcagtcatatctgtgataattacataaagagcaaatgtaactactttcactctattaactatgtggtctaacaatcaacaaggagatatgtttacatcaaaccaggtggttgataaacacttctttaaatgttaaacattatcctttatgcaaaaagcttgggggttgggggggcacctccattataaagaattccaagtggggatccaaatgtccctattttctcaaatacttagtaaggaggctacatgctcacccattctactgagatttatatgccaaatgtttcatatgtgtttgcattttcatttaaaccttatatgatgcagatactattacaaccaccattttacatacaaagaaactgagcttaactaactcgcccaagatcatacaaacagaagtgcgccaagattggaatccaagaagtgtgacttcaaagccccacaagattaagtactccaagcatgaagtacttccagcaaattagaggctcctacgacataaaactatgccactggagtacttcaaggagaattttaatttattcaatcatttgtttatatcaatataaaactttattttatactatgggtcataatccaattctgctttaattttgctactcaaattgttccagctttggccactggaaactttcagttggttcctttgctccttcgacataacccattaacgtgaaatgttgttgtttttagagcacttccttattttttggcacaacaagatactcaaggttcatcttatgtatatttcctgccccaatcacagaatcaaccatttctccaaggagcactagtttcttttattggagaataatattagaaactaagatccggggccaggtgtgttggctcacacctgtaatcccaacactttgggaggctgaggcaggaggactgcttgagcccaggagttcaacaccagcctgggtaacatagggagacccacctctctataaaaatagaaaactttggccaaccgcagtgactcatgcctgtaatgccagcactttgggaagctaatcacttgagctctggagtttgagaccagcctgggcaacatagcgaaatcctgtctgcatgaaaaatacaaaaattagccacacgtggtggcgagcacctatagtcccagctacctgggaggctggggtgtgaggatggcttaagcccaagagacagaggttgctgcgggctgagatcatgccaccacactccagcctgggtgacagggccagaccctgtctcaaaaaaaaaaaaaaaaaagagaaagaaagaaaaaaattagattagctgtgcatagtggcacacagttaaactctgtaaactcatacagtgagcatacagtaaactcatatagtggcatacctgtagtcccagccccagctatttgggaggctgaggtgggaggatagcttgagtctggaaggtcatggctgcagtgagcatgccattgcactccagcctgggtgacagggcaagacccctgtctcaacaaaaaaaaagaaaccaagatctgggcactaggtgcactcctaggtgttgtttctttcaactctcagctgacaatgaatggaaatatatttgtgtatattaactcaagtatgtacatatatctataaatatttctacatataaacatggaactattttgtactggtatctccaacctgaatccattaccacaaagattattctagcctcctgcctcgcttatctgtaaattccactccaacagtgaaaagcctgcctcctgccatccatttacttaactgttcaattgtagttacctatgtaatcagtactgattcctttaaaccagtatcagaattgttaacctctgccccttcggaatgtaactttatcaattaaagtataacgcttatgtacagtcccttttgtcttacagattccactcatttccaaagttacttaaatcagcaccttcctcccgtttagcaaggttgtttcacacatttgtgatacagttagtttctcctgtcaagatttgcatgcctgaaaggccttgacctctaaaaaaattttttttaatttgcatacattaaagtttactcttaggcccagaacagcagatcacacccagaacttcaggaggccaaggcaggcgatcatttgaggccaggagttcaagaccaggagttcgagaccagcctggtcaacaaggtgaaaccccatctctactaaaaatacaaaaattagccaggcattgtggcacacacctgcaatcccggctacttcggaggctgaggcaggagaattgcttgaacccaggagatgaaggttgcagtgagccatgatggtgccactgcactccagcccaggtgacagaacaagactctgtcattaaaaaataactaactaggccaggtgtgatggctcatgcctataatcccagcactttgggaggccaaggagggtggatcatttgaggtcaggagttcgaggccagcctggccaacatggtgaaaccctgtctctactaaaaatataaaaattagctgggtgtcctggtgggcacctgtaatcccagctactcaggaggctaagacaggagaattgcttgagcctgggaaacagaggtggcagtgagctgagaccatgccactgcacttcagcctgggcaacagagcgagactatgtctcaataaataaataaataaataggccgggcatggtggctcacgcctgtaatgccagcactttgggaggccaaggagggtggatcacgaggtcagaagtttgagaccagcctgaccaacacagtgaaaccccatctctactaaaaatacaaaaattagccgggcatggtggtgcatgcctgtaatcccagctactagggagactgaggcaggagaatcgcttgaactcgggaggcagaggttgtggtgggccgagatcacaccactgcactccagccttggcaacagagcaatactatgtctcaaaaaataaacaaactttactcttcgtgctgtaaagttctatgggttttgacatgtcatgtgtccaccattacagtatcaaacagaatacttttatcaagcagtaactttaactgaattaaatgatacaactttcagtggaaacagcatggtaagaaagaagatgaagtcaagagctgtgagctgaatccattgaaaagccacagataggccgggcgtggtggctcacacctgtaatcccagcactttgggaggccgaggcaggcggatcacaaggtcaggagatctagaccattctggctaacaccagtagaaaccctgtctctactaaaaaatacaaaaaattagccgggcgtggtggtgggcgcttgtagtcccagctacttgggaggctgaggcaggagaatggcatgaactcgggaggcggagcttgcagtgagccgagatctcgccactgcattccagcctgggggacacagcgagactccgtctcaaaaaaaaaaaaaaaaaaaggaaaaaaagaaaagccacaaatagactaggacaggcagctactcactctgggtctcactagttccactgtaaaatgggggttcaattcgactaatcatatatagcatttattaaacattatgtatcaggaatggtactaagtacgtcacatggattgcctcatttatatctaacaacactataaagtagacactgatagagcaggacgtccatcctcagaaccggaacctttgtacaaaacagataattaaataagggtgatgttgaaaaacaagaatatgtgtgctcagaagcacgcccagtgccacatcatggaagagggaggccagcaaaagactgggccaaatctccacggtctctttggaaagaagacaggtcaggctgttggattcacttacacagacgccaataagaaaaaaagcattgcctggggagaggatacactgatacagtatttggagaatcccaagaagtctattcctggaacaaaaattatctttgccagcattaataaggtagaaagggcagatttgatagcttacctcaaaaaagctactaatggctaggcacagtggctcatgcctgtaatcccagcactttgggaggctgaggcaggcggatcacttgaggtcaagagctcgagaccagcctggccaacatggtgaaaccccatctctactaaaaatacaaaaattagccaggcatggtggcgggcacctgtaattccagctactggggaggctgaggcagaactgcctgaacccgggaggcggaggttgcactgagctgagattgccccactgcactacagcctgggcgacagagtaaggcacttcaaaaaaagtactaatgagtaattggccactgccgtatttattacaaaatagaaatgtctggccaggcacagtggctcatggctgtaaccccggcactttgggaggttgggaggctgaggcgggtggatcacctgaggtcaggagttcgagatcagcctggctaacatggtgaaaccctatcttactaaaaatacaaaaattatgccaggtgcggtggctcacacctgtaatcccagcactttgggaggccgaggcagatggatcacctgaggtcaggagtttgagaccagcctggtcaacatggtgaaaccccatctctactaaaaatatgaaaattagccaggcatggtggcacacacctgtagtcctagctactcaggaggctgaggcaggagaatcacttgaacctgggagatggaggttgcagtgaaccgagatagtaccactgcactccagcctggacgacagagcgagactccacctcaaaaaaaaaaaaaactgtccaggcgtggtgatgggtggctgtaatcccagctgctggggaggctgaggcaggagaattgcttgagcccgggaggcagaggttgcagtgagctgagatcgtgctactgcacaccaacctgggcaacaagcgaaactccgtctcaaaaaaaaaaaaagaaaactggctgtggttaaatgaatatatttggctttctggattttatttttattttgagatggagttcccctctgtcgccaggctggagtgcagtggcatgatctcggctcactgcaacctctacctccagggttcaagctattctactgcctcagcctcccaagtagctgggactacaggcacgtgccagcacactcacccaatttttgtgtttttagtagagacggggtttcaccatgttggtcaggatggtctcgatctcttgacgtcatgatccacccgcctcagcctcccaaagtgctgggattacagatttaagaagccacagcacccggcctcttttattttttagacagggtctcgcttgtcacccaggctggagtgcagtggcaggatcacagcgcactatagccttgacctgctgagctcaggtgatcctcccatttcggcctccagagtagctgggactacaggcatgcaccaccacacccggctaattttttgtagagatggggttttggcatattgcccaggctggtctcaaactcctagactcaagtgatttgcctgccttggtctcccaaagtgctgagattacaggtgtgagctaccatgaaggtcttggttttttattttaacagtaattccaattaagtaaatgatatcactgttttccccttctaaaaacatgattgaacttcattagtaatgttcaacttttcatcaagatggtgaatgccatcttaaaatctactggagattgattttatatttagatttatataactggttatgtgagcatatttaaatactggcaaaattccttcattgtctcagaaccaagcataattcacctgtgttttgtgtttatttgcctcttaaaggcaagggctgaagataaggcagcaatgtctacatttttggccttaactatgccaagctaattagaattccttgtaactaaaatggttccttttacttactgaaaagcactttagggtgtggtttatgtgtaatatcaaataaagaatagttaacgcttaaaaaataaaataggccagccgtggtggttcacgcctataatcctagcactttgggaggtagaggcaggcaaatcacctgaggtcaggagttccagatcagcctggtcaacatggtgaaaccccatctctactaaagatacaaaaattagctgggtgtggtggcacatgcctgtagtcccggttactcaggaggctgaggcaggagaattgcttgaacccaggaggcagaggttgcagtgagccaagatggcgccactgcactccagcctggcgagagagcgagactccgtctcaaaaaaaagaattttttttttaatggtctggtctgttcttaagccttaaccatcttattcactaagaagtttcaaaaacaggccacacagtggctcacacctgtaatcccagcactttgggaggctaaggtgggcggatcatgaggtcaggagtttgaaaccagcctagctaacatggtgaaatcctgtctctaccaaaaatacaaaaattagccgggcgtggtggtgcacgcctgtaatcctagctactcgggaggctgaggcaggagaatcacttgaactcgggaggcggaggttgcagtgagctgagatcacgccactgtactccagcctgggctacaagagcaaaactctgtctcaagaaaaaaaaaaacgtttttgcggggaggaggaaaaaaaaaacctcttacccaacagaataggtgtcttcagactacaaagccgtccaagatacattaaaaaatgttaagaaccttgctctggagggaatagctctgttgcccaggctggagtgcagtggcacaatcagggttcactgtagcctcaaccttccaggctcaaccaaacctcccatctcagctttccaagtagctgaactataggcacacgccaccctagtccaaaaattttattttctgtagagatgaggtctccctatattgaccaggctggtctcaagctcctcaagctcacgtgatcctccctcctctgcctcccaaagtgctgggattacaggtggaaaccactacgcctggccaaaaatactcttcaaaatatttttggggaaggcagaaggactataacaaaaatagaatagtggttctgtcatttactggctatatgatttaacttggtttcaattttctcatctgtaaaatgagaattactaccaagaagtttcaagaaaattaaaatgataatatataaagtatctaccatactcactgactcacaagagttgtctgatattagtgcctatgcccttctcattctctatatgctatagcctatcatatcaagattttgatacgttagatccaactttaaaacttttcaactgttagctggacacagtggctcacgcctgtaatcccagcactttgggatgccaaggcaggcagatcacaaggtcaagagatcgagaccatcctggccaaacatggtgaaaccccatctctactaaaaatacaaaaattagccaggcgtggtggcatgcgcctgtagtcccagctacttgggagaatgaagcaggagaatttcttgaacccgggaggcagagggtgcagtgagcctagatcgtgccactgcattccagcctggcgacagggcaagactccatctcaaaaaaaaaaaaaaaaaaaaaaaaaaacttttcaactgttttcctacaaaaacttagtctcctattaaccccaacccactttgtccactctaaaatccactgcatcctagcgtttatatttcatgtgtattttgttgttgttgttgttgagccagctcgggctctgtcgcccaggctggagtgcagtggctcgatctcggctcactgcaatctctgcctcctgggctcaagccatcctctcacctcagcatcccaagtagctgggactacaggtgcacatcaccatgcttagctaatttttgtattttctgtagagacagggttttgccatgttgcccatgctgatttcaaactcctgagctcaaacgatccgcctgctcagcctcccaaagtgccgggattacaggtgtgagccaccaagcctaacctatttaatgtgaatttgtatgttggcatataaaatcccctagccagttttgttttgttttgtttttttgagacagagttttgctcttgttgcactccactggagtgcagtggctcaatctcggctcactgcaacctccgcctcccgggttcaagcgattctcctgcctcagcctcctgagtagctgggattacaggtgcgcgccaccacgcccagctaattttttgtatttttggtagagtcagagtttaaccatgttggccaggctggtttcgaactcctgacctcaggtgatccacctgcctcagtctcccaaagtgcagggattacaggcgtgagccaccgcacccggccaacaaactttcattaagtgaacctctaacaccacagcttataattagttttgttttgtttttagagacagggtctcgctctccacccaggcttgagtgcgctggcacaatcatagctcactagggactcaagtgatcctcttgcctcctgagtaactgggactacaggcttgagacaccatgcccagcagaatagctctcgatttgttgctttggcttaatcacatttccaccttgatgtactcaaaatgtttttattagtcataaacttttctaatcacatttgtgctcactacaattatttcctatcacaatttacagactttcaaaaattgatttggtttctactgaaataaaacgtagaggaaaagaacacagtaagctaaaatgatggaattcaatcccttaaaaacaaaattcagccgggcacggtggctcacgcctgtaatctcagcactttgggaggccaaggtaggtggatcacgaggtcaggggctcgagaccagcctgaccaacatggtgaaaccccgtctctactaaaaatacaaaaattagctgggtgtggtggcgggcgcctgtaataccagctactcaggaggctgaggcaggagaattgcttgaacccgggaggcggaagctgcagtgagccgagatcacgccactatactccagcctgggcgacagagccagactccgtctcaaaaaacaaaaaaaaaaaaacattcattttaaagtctagaaggtatgcaacttttaccacacataatgatctcaaattgttttataggaggaggagcttggaaatttcaaacataaaatgcaactagaacagaatattatttggcattaaaagcaaatgaggccatgtgcggtggctcatgcctataatcccagcactctgggaggccaaggcaggcggatcacttgaggtcaggagttcgagaccggcctagccaacatggtgaaaccccgtttctactaaaaatacaaaaattagccgggtgtggtggcagccgcctgtaatcccagctactggggaggctgaggcacgagaagtgcttgaacctgggaggcggaggtcgcagtgagtcgggaccccgccactgcactccagcctggacgacagagcgagactcagtctcaaaaaaaaaaaaaaaaaggaattaagtactgatacctgctacaacacggatgaaccttgaaaacaccatgttaagtgaaacaaactaggcaaagaaagatacatatgtttcttttttaggtaaatttaggcaaaaaatatattaatagttacctaagactggagggagggggaatggggagtgactgctaaatggcttctagagattctcttttagggtgatgaattaaatagtggttgatggctacagaatttaataaatatagtttcagaaaattacttaattatacgctttagaaagcggaattttttggtatttgaatcatatttcaataaagctattatttaatttaagttgccactgaaaagccacaataattttgttgtggaggaaataatgaaagtcactgactggaaaagtaacctgtgacgttagccaggtcaacctccaaattccttcccccatttctaacaagtacatcaaactagagacagtgtgtgaatcaaagaattccaggcacagttggctgttaactagaatagtaagtggctgcctaggttctgtcattcctaaactgtagggggcttctagcctcggagattacggaagtagtactttccattagcgagctcaagaaggaatgtcaaaataggatgacactttcctagtcgctatgtaaaaacctaaaaaaccagaagaggtgtcatctagacactcccaagtctatgcaggtgtcagcctgcccccacccaacaccagccagcagcgtgcaccattcaaccgtatctcaacttgccccttacaaaatgacacactaacaagcccttagatctcatttgtttaaaatgacagatacacaaccttcacggggttcccactcaaggccttccagcctccgccctgcccctgcccacccccaaacctacacacgtgttagcccgacaccgccccaccgggtcccacgtgcacctggtctaacacactccccacgtgtgggcgccccacgggcttcctcaggtggctgaggtcaccgcatgaccccgggtctccagagatatgaaacgggaaggacaaggccctagtccctgaggtcccaaccctgcggggagtgtccacacccatcctccatactaaccccaacaaatccaagggccgggggcgacggcccctttaagacgcggcccagttgtcgcccgcagagaggggcgcaacaagacctacacaacccccactccgttcgcccgcccacgtctagttgcctcacctcgggccgcctggccccgccgccgcgacggcggcggagggggggcggggtgcgggcggggtccggaggggggggtcgccccgccgacggtggagccgcggttcgctctctgaggccgtgggacggtgactgcgttgggcgtggacgctcctagctcgctccctccgcgg

SEQ ID NO: 2537 - DNA, 148009 bp, Homo sapiens
  misc_feature 78707..98706: note = Unsure
  source 1..148009: mol_type = genomic DNA
aaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtgagtacaacctgctccctccccgggcacagatatgacagaggggcttagagggggcccagctttgagatgggttgttcttatgtcacaggacagagtgatctgacatgcacacttccccgccaccctgtcatggaccttgtccttggagttcagagagctggtctcatggcaggttttgcagccttggagctgtcagaaccactctgaggcctgatgttacaccccagcttcccatgagctgtatggaccttgtggcttccttggagtctggggaccgagagaagggagtttgggcttttggagccaggaggaagctcagggctctgtggaggtgggtgtgttagagatcagctcaaagatgcccagctcagaaaccctgagaagagcaaaggtggcaagggggacccttcctggagcacccaggcttcgggcccctggaggaagctgttgtttggcgagccaagaatatggggtgagtttaatcaagaaaggactttccattcagtcagaagctgctttcaggggcctgagagcagaggaagtcaccattaccaccagcgagcagcctcttctctctcctgagcacttggctgtgaccgctgcccaccccccaccccctcaatttgggtctctgtcaccatcaactcctcccactgcccggttggggatgttactgaatgtaccagctgtgctaacaatggaggaaccagccacttgctgaaggttcctttctaaaacccccttcctgtccagcgtctgaaggaggcccttgccctgcagctctcggtctaatcataggggggccttgccctgcagctcttggtctaatcattttgccggggcctcaggcagtgccggagtgtagtcagggaaatgtgtgtccacctgaacatctcaagtagcatccctgggctggcagaaatgttcccccgagcagccagggccttgtgcttctccaggcaggaggggaattgggtgatgaacccagacctgttttgaatactgactcacagctgggacctgtcgtgctaagcatttgttagcccatttcatcctcaccacaacctaaagtgaaggtcctgttaaaagccccactttgcagatgagaaatctgaggccctggcaggttaagtgagtgacaacagtcaaagccacggccatctgcccccagaggctgcagctgagaccagcagcctgtggcccaacctctcctgctcccagtccagcggggcaggcatgtagccttgcagggctggagaaagaagcaaggggagccacagtgtttacagggtcagctggggcactggaaaccaagccaggctcgcagctggtcgctggcctgtgctgacagtctgcagccccacctccaaagactggtttcctgtgtcccctctctcatgcctcaggggaaggaacgcaggcccaggctgcctggacttccccagtggggacctgctgctgccggggccttagaaggagcaggaagattctcttaggcctctcacaagcccagtctgactccacctggcccatgtgggttacttggatttctctcctggcccagtgggatcttgtcctggctgtttggtgttggctgagccgagggcttccagggccccatctcattaaccttcaacacagccctttgaccagggcttgctttgtggttgctcaggttacagacatggggcgtgggtctctctgactccgagccgtgagcatcttaacgtctaggattagcctgagccagagtcagagctggagaggccttggagaagctctggtgcaacagccctggcttttcaggaggtagacagagggcagagagcctgaggcctttgtccaccatgctggctggggtcaaaactgctgggatccaggccagttctcgtattccttcctctacctcttctctctgaacccttgtctgcactgagttctctcagagtcatgatgggtgtgcagtgtctgctccttagagagggacctgtggtgcctacagatgtccactatcctctcagccgaagcctcgtcagcctcctatcctgaggctgctgggctgcaaacaccaggagtcccaccccttggccagacaaaccctgggctcagtgtttccctttctcctctgctcagggtgggaagcttcccttcctgcagggtcaggctccactgtaggccgtgggttgctatggacctgcagactttccatacatctgcaggcttcatatggctgccaccctggattttgccaattacggagattttaaaactaaaaactaattaaatgaatgataacaaactgtcatcttccaacacctcatttcttgaaagaaagcagcctttgacaccaaaagaggcaggaagggcattaaaaaaaaaaaagccagtcatttaaagcaaagagattgaacttcttgaaaaacaaaccctaccacccttagttttctgtgttccctgcagagtcgccgtggcctgacggagacggcagaggcagacagtcccaggctgaggggtgtgcagggcagccgggttttctgcggctgcagaagtagcaggctttgcccccctagccctggaagcctggagccaccctgctctagaagtgactgcagaaggaagccacacactcaccctcctgccctagcaaagtccatgggaaaagtatacctgccccatggcccctcagatcacccaggtgccctgacctcatcctgcctgggccccagcagcactccctcccaggccccctctggtgggcaaggggacaacggccggagtctccacctgatggtttgggcaagtgtgcctggagtctcaggaactgagagcagcctcaccagggaggggcctttgtgctcaggaaagagaacaggatttgactatgtaaatggacttgagcgggggttggacatcaaaagacagggctacagttcagtgccacccatgtgacttaggagtgcacattctgcgcacacccagcaaaccctgcatttcctcgagagaggtcagccccgtcacctaccactgggcaggaaagctttgatctcacctcagcagcttggaaagccctgcttgacagggagcctgggctccatctcggggcacagacagttgcagtgggaagactccagcaggtggctgcctggtttgggtccaactctgccgtctttcagccaggggctcttctaagtagagcctatgttgtccccacctggtccccactcaaatcccccggcagagttggccctgctccggggggagtctgtgggtgcctccaggggacgttgggtacatcgtgggtgggagacattaagagctgtcaggctcatgccctctcctgccacgcaggggccagcacacctggcagggccttatgctgcaaagaagagatgccttgggaatggggtcagtcaatgcaagggtccatgggttggccgagccggcatccccttgtgcaatctgcacaggcaaagctgatcaaaggcccaatgtcagtatataggctgccctctctgcaggagcagctggggcccgggatcaggcctagagtggccggctcagctgtctgccatccagcctggagttgcgcaggagggcggcgttcccagccaaccactccagagagagggggcttccctcatgggggaggcgaaggcacgtggctgcctttggctcagaacccagtgcctggtctggccacagctgacagtgtggttttggtttccctccacatgtggccttccacaggccacccaggcaccatggcagggtcttgcttaccccttcccaggggcagtgtagacagtgcaccggacagacctggcttcaccagcagaaggttgttaccaacctgctccgcctaataacagcaggcaacttccaaagagctctgtgccaggcaccattctaggcttatattgactcatttgatgtccacgaagaccttcaaaggaggtcttattatctccactttacagatggggaaaccgaggtgcagagcggtttatggaacaggcctagtttacaggactaacaaataaaagggccaggattgcatgcatgatcttcctggaagcgagaaacagagaccataaggtggcctgtgtggggcggggcagagcctggagagggaacttctcgtgatggagccgcagagaagggacttgggagggcgaaactcctaatctcagagagtccaacagagttggaaagctgtggtgtgagcgggtggctaagtctccctttcgaagcttcagtaaaatagacactgttaattgtttttgtgcaaatgcaataaggcactatttttcatatctgatattgacagtcagtgggaaaaaatgctggcccaggtcgtagccagagctactgacatctggctcacaccagaaagccggccaaggggctttatccaaggctgactgtgccgggttttctctctgcatgcaagaccaggaaggggtatgtgccctggaaggcctatgtatttcactcactaactgtatcttccatgtgaagtgacgcagagcaagcatgttaaaatggagtctccaggttttctgtgcctacgctcagcccccgtgaaaagtcctttcgggtccagagattaggctccagctttgatgctttgcatgtttgtctacctggtaggttaaattcataaattcatgaacacaatcagcacttcttgggttttttttttttttttttttgacagagtcttgctctgtcgccaaggctggagtgcagtggtgcaatcttggttcactgcaacctccgcctcccaggattaagcaattctcctacttcagccctccaagcagctgggattacaggtgcctgccaccacaccgggctaattttttttttgtgttatcctcaggtgatctggcctctttagcctcccaaagtgctgagattacaggcatgaaccactgcacccagcctttttctttctttctttccttctttctttctttctttctttctttctttctttctttctttctttctttctttctttctttctttctttctttttttttttttgagacagagtctcgctctgtcgcccaggctaaagtgccatagcatgatcttggctcactgcaacctccacctccaggattcaagcaattcttctgcctcagcctcctgagtagctgggattacaggtacccaccaccatacctggctaatttttgtatttttagtagcgatggggtttcaccatgttggctaggctggtctcaaactcctgacctcgtgatccacctgcctcggcctcccaaagtgctgggattacaggtgtgagccaccgcacctggcctttttttaaaattattattattttattttttatttttgagacacggtctttcgctgttgcccaggttggagtgcagtggcacaatcacagctcactgcagccttgcttgatcaagcgatcctcctgcctcagtttcccgagtagctggtattccaggtgcaagtcaccaagcctggctaatcttttttatgtagagacagggttttgctatgttgcccaggctggcccccaactcctggagtcaggtggttctcccaccttggcctcccgaagtgctggcattacaagtgtgagccgctgcacgcagcctcacatcagcacctctcaatcaattggtgccatctccctgcacatgaacccttgcgtcatgatgacatgtggtcctcacagccaggcatttctccccaccccagacatagagtgagaggagctctgctcttccctcaataattcgtgccatgctgtgcactcctgaggagcaaggctctgtggtctgctggctctgctgggctgcatttgcaaaatgctaaccttcctgtgtcaacccagcatcttcacaggtggaatgaggatgacaaggccaaagcccactcgttgggttattttttcaaattgaggtataattcatattccatacagtcaccctttctatggtgtacaattcttaattttctttttttccaagacagtcttgctctgttgcccaggctggagtgcagtggcatgatctcggcgcactgcaacctctgtctcccgggttgaagtgattctcctgcctcaggctcctgagtagctgggattacaggcgcatgccaccatgcccggctaatttttttttttctttttgagacagagtctcatctcacccctgttgcccaggctggaatgcaatggtgtgttcttggctcactgtaacctccgcttcctgaattcaagcaatcctctgcctcagcttcccaaatagctgggattacaggtgcctcccatcacacccagctaatttttgtatttttagtagagacgaggtttcaccatgttggctaggctggtcccgaactcctgacctcaggtgatctgcccgcctaggcctcccaaagtgctgggattacaggcgtgagccactgcacctggccctggtatacaattctttatcgtgcttttagtgcattcacaatgttgtgaaaccaacaccactgtctgattccaggacattctcaatacctcgaaaagaaaagaaaccctgtacccacagcagtcactccctattccctctccacccaaaccctggcagcaactaaatgactttttgtctatggatttatcttttccggatgtttcataactggaaacatacaacatgtggactttggggccagcttctttcactgagcacaatgctgtcaagcttcatctgtgttgtggcatgaatcactcctctccagggctgactaatgagccactgtattgaaagaaccacattttgtttatccattcatcagttgacaggcatttgggttgtttccacttttgggctataatgaataatgctgtgatgaacattcatatacaaggttttgtgcaaacatatattttcaatattcttgggtctatatctaggagcagaattgctgggtcatttaagtctaacactttgaggaacagctaaactgttttccttggtggatccaccattttgcattcctactagcaacatctgagggttccaatgtctccacttccctaccagcacttgttattatcttttttattatagccatcctagtgggtgtgaagtgatgtcttattgtggttttaatttgcatttctctaatggctaatgatgccaaacgtcttttctcatggttaatggccatttgtatttggagaaaagtcaattcagatcctttgtacatttagaaaacagggttgtttgtcttttccttgtttccttgggttatcaagaggacaaaatggaaagatgtgagtgacatttacagcccaagtccaggcatgtggtaagcacccaccgaatgctttgcacacataaaaatcatgctggtgctgggcaaggtggctcatgcctgtaatcccagcactttgggaggccgaggtgggtggatcacctgaggtcgggagttcaagaccagcatgaccaacatggagaaaccccatctttactaaaaatacaaaattagcctgcgatggtggcatatgcctgtaatcccagctactcgagaggctgaggcagcagaattgcttgaacttgggaggcagaggttgtggtgagccgagatggcacccttgcactccagcctgggcaacaagagtgaaactctgtctcaaaaaaaaaaaaaaaaatcatgctggtgatcaggtgtggtggctcacacctgtaatcccagtactttgggaggctgaggcaagaggatcatgaggtcaggagtttgagaccagcctggccaacacagtgaaaccctgtctctactaaaaatacgaaaaatttagctgggcatggtggcgggtgcctgtaatcccagctacttgggaggctgaggcaggagaattgcttgaacccaggaggtggaggttgcagtgagccgagatcgtgccattgcactccagcctgggcgacagagctagaatccgtctaaaaaaaaaaatcgtgctggcaattagtctttatgagctaaaagtgactagtgacatctcagaagcagaggagtacaggacccatctgtgaagaacattccatacagaggagagaagagaatgggggcagaggattgcttaggaaacttcctggaggcctctgggggatgctgagttgtcacttgaggcctccttggaggaagcactcagagagatggaagcaggaagaggactgagtgatgcccctgtgacggaggctgctggggacagggctgggagcctggaagccagcaggaggaagggatgggggcacagaggcacacagagtgaaaccaggggcaatgaacatgacatcaggaagaaaggcaggcatctgaagaccactgggctccaattgagggggtgggtgcagagggtactgaagtcctggggctgaggacgatggaaggagcacagcatgttccatgacgggggtactcaggcttgacaggtgcggcagcacgtggggaccagattctctcccctgctcacttcaggctcctgttgtcccctttcattaggaaaacacgatattaacaagtgcaggcccctaacagtttgggttcaatacttactgtaaacaaccccacggagggctgtccccgagagatcatttgggacctccccggagcagagaggcttgctggaccacacagctgtcagtggcaatggagaaacaaatagatctgataaacagcaatgtcctgttctttagagtcactttaaaaaatggtatttatacaaagcacagaaagtacaaagcaaaaagcagaaaagtaaccaccccatcactgagacactagaataaccattgttaattcactggtgtatcttcttcttctctctacctccctgtatgtatgtaatttccattttgtatatacatgtattacatgtatatgtataattttagtctgagatttctagcagcattagcattttcccatttagttagaatttcttcctaaatatcatattttaattttagtctgagatttctagcagcattagcattttcccatttagttaggttttcttcctaatgatcatatttaatggatgtacaggattctattacatgatgtgcgacacttcatgaaatgattcttctattatcagatatttaagttatcaacagcattttgttgttataaatatgactgatgaaggtcttttgcagaaatgttataaacatgtctggttatagattccgaggagtggaattactagatcgagggacaggaatgtttttaaggctcttgatacagaatgatacattgctttccagaaatttttttccatatatgcaccagtaagctgtacaagagagtgcccgcctcattctaaccttcctattctgaatattttcatttcaaaacacaatacattgcaaggtgaaggtggtgaatgttcattttgatttgcatttgattgtggtcacgttgagcttatttgatagagttattgaccctcataatccctctttcgtgaatggtctgttcaattctctttgccatttttctatcgaagctatagtttttctgttatctacttgcacaagtttatatcacacttgttgcaaatattttcattgtgattttcctttaagttttatgatttttttttgacattcagggactgtaaatttttatatagtgaagtctctcagtcttttccttttttctcccttcgcttttcaatgcagagaatccctctgcacacagaaattcacttgtttcttcttgtacaaggcaggtgggttatgacagagactttggagctaatagacttgggctaaggattcagcaggtttttttttttttttcgagatggtgtctctgtctgtcacccaggctggagtgcaatggtgtgatcttggctcactgcaaacttctgcctccccagttcaagtgattcttctgcctcagtctcccgagtagctgggattacaggctcccgccaccatgcccagctaatttttgtattttttagtagagacggggtctcaccatattggccaggctgctttcaaactcctgaccttgtggtccgctcgcctcggcctcccaaagtgctgggattacaggcgtgagccaccgcgcccggccaggatccagcagtttatttaattccactgggccctggttcccctttcgaaaaccagtgctaagaatacctatgtggtaatgttgtggggcagattggatggaaaatatgtatcatgtttttagcacagtacttggtaaaaacaaatgaagcagttatgggttttttacttttgtttttgtttgtttgttttacattgaaccatttaatctctctggaattaatttaacaaatgatgcaggatacagatttaggctgggcacagtggctcacacctgtaattgcagcactttgggaggccgaggcggccggatcaccagaggtcaggagatcaagaccatcctggctaacatagtgaaatcctgtctctactaaagatacaaaaaaaataaaaataaaaattagcttgccgtggtggtgtgtgcctatagttccagctacctgggaggctgaggtgggagaattgttagaacccaggaggcagaggttgcagtgagccaagattgtgcctctctacactccagcttgggccacagagtgagtctctgcctcaaaaaaaggaaaaaaaaaaagatttatgtgtatttttctcagctaatcatctttcccaaaacctcttactgaataacattcctttaccctttggggttcctcttttatcatattttaagtcatatatctttctttgtgtttgtactctgttccatgtatatctgcttttctttccccaatatcataacaattataccacctaattttataaaatattttattttaggtgattttcatatctattcttccaggtgaaccagctaataatattgccaagttggagaaaactactattgggactttgattggaattgtacaaaatccataatatagctggtataaattgacattttggtaatattcagtcttaacaaatatggttgtccctgttattttaaattttgtaattttcttcatatagatcctgcatatttattgttataatttcttctgattatcttatactcttattactattgtgaatacattttcccctacatttcattataactgataacatacagggaagttttagattttataaatccatcttttattctgtcactttactcactcctcattatttcaaattgttttttggttgcttctctgggattttcttgtttgactctcatgtttgactctcgtgtcatctacaaattaccattgttttgtggtgtactttccaaatacttatgacacttattcagatttcataacttattgcatgggccagtatttctaaaacactacagtggggaatattggaaaaagaaaacatccacctcaaggagacatactgtgagaatcgctatggaccacctgggaagggcatgggatagcctctgtcacctagttaccacttgataaaaggtaattgttgctgtttgtcatgtccaagaagaagcagtcttcttctagttttagaaagagttctgaaggactgagtatttaatttttatcaaatgcctttttaatatctattgtgatgattatattataccccttatttcatttactggtaaaataattttatatatttatatttggtttatatatgtgaaaccattttgcatgattacaatgaactattcttgatacaatacttttttattgtactctgaaacttatttagggtttttatatatgtattcatagttgaggttgatttacctgattttggttatgttatggttttaagtcatgtatattttacaaaatattctggaggcatttatgtagcataattattatctgatttttgaaatacttaaaaaaagttggtaaagccacttcttctcaatgccatttatacagataattctttaatatttacttcaatttattctttagtgttgaattggtcttgttttctatttcctcccatgtcacttctgttaagttatacgtaattttcagagaacaatctatttgttgagattttcaaaatttctggcaaacaatcatgcatagttttgtataactgtaagttttctcttttattgtggctgtcttcattttctcatttctaactgtttgtggtgcccagggtcctggcaggaaatagatggcatgttcaacaggagtgataaagacaggaatggcaaggcagccagtggctggcaccctcaggatccattcccacccctgaactgaagaggcagtggccagagctgtgtcaccagaacctggcagggctgcagctaggagactccagaggtggagttctgtccctgcaaatctgcagcaggcagggtggggtcagtggaacaaatcagcccatccccccttcactcaccctgctggtgcctcgcttcagccaaacctgggtaaagcagcccccggagatttgctggctgcacagggcaggtggaaaagggtagagagtgggtctcgctgggggaggggaggcagggagaggctgtccagctcactcgcatttgtttctttccttgattctgtttgtcacaggtttgtccatttaatctcctacttttcaagtgacaggctcttaggttggttaatctcttctgctttttgtttttatattctaaaaaatgatctctggaccggacacagtggctcacgcctgtaatcccagcactttgggaggctgaagcaggcggatcacctgaggtcaggagttcaagaccagcctggccaacatggtgaaaccccatctctactaaaagtacaaacattagccgaacatggtggcgggtgcctgtaatcccagctactccggaggctgagacaggagaacagcttgaacctgggaggcagaggttgcagtgagccgagatcgagccattgcactccagcctgggcgacaagagcgaaactcaatctcaaaaaaaaaaaaaaaaaaaaaaaaaatctctgtcttttcaggaagccctgttgcatctgtaggactgagatcagcttctgtatttctcttcttccctctcttttttaaatctttgtcttttcctctagtaccactttcttgagtgtgtctttttcctcgttcactttctccaatccatagctgctatttcctgcctctgtcgtgtgttaaattctgactctaaacgtcccggctgtccctaatggtcagtttcctttatctcagtttgctcatttttcacaatcaatccctccaatttctgatatgcagtggtctctcgaatcttcctgagttcacaaatcagacttgtccagaatttatttttatcagtgattctatttaagatggaagtaactccctggagtccttaggaaaatgcccttttctggatggtgacatgttttcataggtcaggtgatttttcttttctgacaaagaactgtcgagaacaattggatcagatttgttcagagatgggagtgggttaaaacgactggcactggatgggagatgacaattcaagatccagccggtggtggggccagagatgagggtgtggtgagacacacagaggatgggctccctccaagggttgagagggggcgcctcatacctgggtcttgtctttgagtagctgtcagacgaggaatagcccgctggaccctcaagctgttgtgggggtgctcagccagctcccaataatactcggccagcctcacctccatctctcacctcctggccagctgagccacctgttaatgctttctcccttctggaggggtccatgttagcaagaaatggcctcttttcattcatcaactttagctttctctctggctgtgattcttcaaggtttggagtggcgaatggtgaacagtttgtttcccaaggttgccacacattttcttgtccttctacattggtgcaaatagttttttttgtgttttttttttgaacgcagggtttccagcccccgttctcctaccccatcttgtccagaaatctgcagaaacacaagtcttaagaaaatgcaaaaacacagacaaaaacattagaaattagaaatgatacgtaacaagagtcacaaaaggatttaaaagcaattacaggagcagatcagcaaagcaagataggaacacaaagaggttcttgaattttatagttggattctctgtctctctgtgggtctgtccatggtgaagatgttcctgggtctggctgtcagtgttcatttggctaggaatggccacacagaaatgctaagatttatctgaaagaatcaaacacgatgatgtttcttcctacttccacgggcttgtcctcccatattagagtagaacttctcgtactacatcagggttgacctggtccagaaatgctcttctactgagaagcaccttcctgcctcttctttgcctccacactcagcacagggtgggcacctgtcatcacccagcacctgtgggagtcacatgggaaatttgctgtaagccccccttcatttgggaatggaacaaatctcatttgttagcagaaggaagtactgttgggcccagtgctatcctaacccagatctccaatgggaataatcctgatctgattactctgaaaggtcatccagtcactgggaggagtctcagctgagagccagtgttagcgtaacaaggtgttaccaaatcaccacaaagagctggggaagggctgggcgggacccactgcccctaaagagcagtgagcatgttttccaggttatgttccagggcagcaattgccaaacactatttagttgtagaatctttgctttaaacattttgcatgcaagatattgtgtgtgtgtgtgtgcatgtgtacatacacacatgcatgcatgcatgttacatgtatacacatgtatgcatatgttgtgtgtgcacatgtatatgtgtgtgtgtgtgtgtgtatataggaccagagtgaagtacaaactgctggtggggtggcaggccaagtgagcaccttcctccaccgcttggcagagcctccacacccgtggaatacagtttggtactactgctcacccaacgacttgtgtgtggcggggctgatggggtgtgtgtggggtggtgctgtatgttttcccttgaaggttgaaactgattcagccctgggggtcagaatgtccagccctgtgcattggctatgcagggtcattaacatctgctgagatgttactgtctaagggggaagtatcttcttcctgttatactagcttttgaattctgatctgttttggtaacatggagctgtttctttgtttcagtgtttctagaacatctttgaaaaagccataaaggtttgtctgccacacttgattgaaccaaaaagcctttcctgttctgtgcgcctgcctctgactctcccttcgtgattatgttctttctctctgtctacaggctgatgtttgggctggctggagctcttccacaagtcagctgccctcagccaaataagaggctgttctcacccctcacctcatttgcatacctacaggaggaagtgccaagggaagagagcattgaaaaataagagcacagcagagttgagctatctccacatttgtctggcaggctctgcaaaggggattgaggccagtggttctctgtgtcccagaggtgtccctgggagatgtagtgtcactggactagagattcatccttgctatctctgatgcaagacgattgtatcaattcaggctctggaggtaggacagggagcagaaggatggggactaaagccatggaagaaagacagaaaaatcaccttttctatgtgaagtgaagagacatgtggaagtgaaattactcaaaattctttttaagtacccatgatgcaaaagccataaaataaaatattgtaaaattagccacataaaattgtaaaacatctacacagctttaaaaacaacctgttaaaaataactccaaaatatattgtagcatatatcagagtcttattcataactaagcaaaaaatgataccaaaataagcgagtcaaagacacaaaagggaattcacagaaaaagaaatacagataactaaacatgggaacatgctgaaggacttttctcataaagaaaggcaaattaaagcaagttatcattctcacctctcagatttgcaaagattaaaaggtctgataacagccagttggcagggtgtggggaaatagacacattcatatccggttagtaggagaaaaaaaaggccacaacttcattggaagacagttggtacagttggtagtctctatcaaaatagcaaatctccaggtcatttagccagctgtcaccttctagtgatttacctacaatcactaataaacgtcaacacgtgtacagcacatggtgaaacatgatgaaaatagtaataaaccatctctcacttggcttgagaagacctctatgatcttttttggtgaaaaaaacaaatttcagaaaacggtatacatagtatgatattattggcatctaaaaagatatgcatatataatcttgtgggtatgtttaaaatttctgaacttacttacaaacaggaataggaaatctaagaagaggggctcatgggagtggggaaggagatgtttattttttattttatatctttctgtatggatttcattttttaaagttagtatatattttaaaaaatctagttaaacagggtcaagtgcagtggctcatgcctgtaatcccagcactttgggaggccgaggtgggtggatcacctgaggtcaggagtcgagaccagcctgaccaatatggagaaaccccatctctactaaaaatacaaaattagctgggtgtggtggcacatgcctgtaatcccagctacttgagaggctgaggcaggataattgcttgaacctgggaggcagagtttgcggtgagccaagattgcgtgccattgcactccagcctgggcaacaagagcaaaactctgtctcaaaaaaaaaaaaaaaaaaaaaaaaactctctctactaaaaatacaaaaattagccaagtgtgatggcaggagcttgtaatcccagttacttgagaggctgaggcaggagaattgcttgaacctgggaggcagaggttgcagtgagccgagatcgtgccactgcactccagcctgagtgacagagtgagactccgtctcaaaaaaaaaaaaaaaaaatctagttaaacaaaacataccaataacatatgtaaatgctcagtggagtgcctgtacctgagggggtgagtgtgtggagcttctacactgaggcactggcttcattacagaggctggtcctgtctacagggctctacgggccaggtgagccttccgggctcaggagaatcttaagtagcaaaatggggcaagattatggtgggtgagaacagaccagcagctttaagtaagagcctaagatccaaatagctttccctcgatctcctgacagccttctggcctcagcagccgatggattccatgggtgttagctgctgccagggtttcagcaggctgagggccaccgcagtgtgcccctctcccaaggtgctagcacttgacagcccccttttcctctcacaggttttaggaaagtgaaaagtaccttctcctcctcacattagagatgactgtgccaaaggaaggtagagcttctagaaagagaagagaatctgggattcctaggaccttcttgttagaaacaaccccaagacttgctctccagctgctggggcaaatccaggtctcggcaaggctggtggccaacccctgggagataatccacggggcatagtgtccaagaggatgaagccatttgggggtggcagggagctcagcgggaacgaggtgctgagtgatccctgcccctgacaggtggcccctctgtggctgggcctggctttccattcaccatgggccgctctgcttgggcccactggagtcgtgtttcttcttcaaacaccccctcttttttgttgtttttttgttttgttttgttttgttttgagacggagtctcactctgtcgccaggctggagtgaagtggcacattctcggctcactgcaacctccgcctcctgggttcaagtgattcttttgcctcagcctcccaagtagctgggactacaggtgtgcgccaccacgcccagctaatttttgtatttttagtagagatgggatttcaccatgttggccaggatggtctcaatctcttgaccttgtgatccacccatctcagcctcccaaagtgctgggattacaggcgtgagccaccgtgcctggcctgcaagcacccactcttgctctatcttcttggcagccgagaggttaagaaagcccctccatgtggcagactcctttagatcagatcctttagctgccgggtccccacctaaatgaccccccccaaccttttcctggtgctccctgagtgcagaagcagtgggggaataagagtgcctcagcccacgattgctggacgtcaggactcacctccatcttaagagaacggtcagctccgaaattcggagactttgtgtccagattcctcaagctgtgtcaggaagtcttgtcttttcagttaagaggaaaccgggtcttcctgcatgggttctaataaagtctttgatctatttcaggtatcggaattgcgtttacacttacagaattctgcccaatgaagatgataaattcactgttcaggtgagtcctttataaacctagaaatctgaacctgacttcagccgatactggcagagaaagggtgtaaacgatgaggaaggaagtgcacgcgcaggtagccggacgtgaaggcctggctgagcctggcttcctcccaggtgtccatggggtggcttagctggtaaactggggccctccaagtgaccctgctctgtgacatgacggagttgcatgccacaggctatttgtggtccataggtgtgaagaggaaacgaaggtgaagcagactgtccagagatgaagggaaaggaggggctgtggcttggccgactgttgtcttcagtctctcaaaggagagagaggaagtggctcaggagggagagaagggaggtgaacttacaggagaacagaccgtgttttctgaggggctgcgagactagcacaaaacagtgcctttccatttgtagaactctgttctgtccgaggctggtgctcactgcatctgatttcaccaagcaaagtcaaaatgtgcaaaacttgcagttcattttttaatattttttatttttgagacagagtttcactcttgtcacccaggctggagtgcagtggcgccatgtcggctccctgcaacctccacctcccaggttcaagtgattcccctgcctcagtctccctagtagctgggattataggtgcccgccaccatgcccggctgatttttgtatttttggtacagatggggtttctccatgttggccaggctggtcttaaactcctgacagcgaatgatctgcccacctcggcctcccaaagttctgggattataggcatgagccaccccgccaggctgcagttaaatttaaaaacaaaaatcagctgcacccgtccaagcccgggaaggccaccctaagcacggtttactaaagcctttgtttcgccacaaaatgtgacaactgagtgtgtggaagccaggaaagctattgttatctggctacatgaagagcacatggaggtggcaagaaggaaggagacaaagtttccacatcccgggtgtgtgtgtgtgtgtgtgtgtgtgcacgtgacagagagagagagagagagatgctcagttctcagggactagagtaagaggcacagcagtgcatccacgtcccaagcagagtagccggggtcgacaaaggtttggatatcatgtcatggaagagcaatgacggcgttggaggagtttgtttgaaaagaaagtggaagtgggaggggagaggcagggtacactcttcagtttcaaagcttgaagggaatgattcattttgtgctaactaggatgcagtagtagacagggagctggactcaaggtgtggggagaccacaggcaagtccctggaggcaaaaatcctccagaagttgtcaagagggagagcgtggtgagcagaacgcccctcaggaagacagcttatgaggatggaaggaattgcttcgaggagcgatgtgattgagagaggcccaaggggcatgtgtgatgcagcccggtccaggggcatttgctgcgaggcctccttaggagatgcgagtttaggctcaagcagaaccactccctgcgtagttaggctggcattgctgccggctgcctcatcctcctgcccctgagtccactgcagcctctaaggcacatctgctgaaggctttccactggcctagggcgcccgcaggtttggcctggttcttagcagtcaccaggagcagatgttggcacacctagtacgagaaggtcctttccagcgcttggcagctatttgccatgggaatgtctgtctctgacaggggctcttcaccatgtgtgggatgtgagcagcggaggggagccctgtctggggcaggcagttggcctcaatgacctctaccatttttttcaagtctaggagggcatgagcttttctggcagagttggcatctgtgataggtggtttgctgagaggagtcggcaaactctcttaagttaaaagttggtcgatgcttttgatcttttttccctttgtggtttcttctcttccttcaaagtgaagaaaactttaagtatgactggaaaagacatgactctgtggcttctagtagagtcggcacccgccgcctgtaaatgtgtagactgcgtctccggtttgcccctctctgtcaccatcatactcttgctactgtgacatcttgtgaccctgggaactgctgatgaaatccggggcctcatcaggctactgggcagggggtggtggtggtgcagggaacagaaactcgccttggctgactctgtaaggggtaaggggtgggcagcctttgtggagatgtgcagagccaggaaggagaaggccgccctagggccttggaaccagaagagcatggggtctgcacgcagcttctcccatggatcagctcttctctgtggggccgctcttcccagccagcagcctcccttctcagtccccagtcctaagaaggagtctgatggctcagcctccacggctttctccgcatgagccactcaggggctgccagtctgtgtatgaatcggctgtcttggagcaggtacccccctctgcctctcagagatggggacagagtcgtgggggcagcgtgcctccttaaggtctccgcttagccaggacagtgggcgggcagctttcagagaagatgggcggctctgctggacttctctgctcctgaccccggcactagatctgtgacctccgcagtagctgacatggtacagggagctgtggacctaggtggtctgaagaggttttccttcaaggtgaattaaaggggaattctcataggattctcccaggtggactcaccttcgaaaatctacctccaagagtaaatgacagcagacgtccactgaggaccaagtgcacactcatgcccaattaagcagactcagagcccttcggggaagctttagcagttattgatctctgcctattttaactcaagttcctcttttcatgttgaggcaaaacctcacagtcttttctgagcttagccacagtttctaaataactcattcctgacacctgagcctgttcagtgccaccagaatacgaggctccccaaaataagaatctggcctgaaattttgccaagtgaagcaccgaaaggctttcattgtttcttagtttagtaactttagctcttttcctggggacttctgttctcttgtcaacaccaaagatctcatctttgttctttgcagaccaacttcatggagttggcccacgtgtcatagcccatgacagccctgtatcaatcagggagaggagctgcctcacctgggggactcttttctctcactccatctttcacagacttaaaaaaaatccgagatgggagggcaggatgcaaactgtaacttcatccaaccccctcgttctaaatatgagtgttgctgagaactgcggaagttggaactcacagccaggcctcccggcctccccggctaagctttcttccttccaatccagaaggtgtttccaagcctgtctggagtcccctggggaaggatgagcccaggactctgcccagagggacagggagacagggcaatgtggcctctcagagagcttggcctcttgcccttcacatggttatagataatatttgatcccaggtggcatctgtcccttgtggtaaatcagtgaggtgcccctagaatgaaagcagactccattcccggctgggatctgggttcaagtccaatttggtcagcgatgtggccttgggcaaggactgccaagaaactgctggaaagtagagatcacacacatacctcccagcacaaggaagctgctggggaggagggtggagacagcagggagctggaggtgctttagagcattctaggcagtgctgggagtggtggggaaggaggggtaaattttggaactccatctccctcagctctgctctttgggctatgggcttcatgtcttcagggacctgagtacgctctggaactgttaagcagttgttcaacagctgctgtgccactcaaaccctgagaaccttctggactcagcttgcactgcttttcctggttgggggagggttggggcagtgctctgagccctgtgtgaggccagacgaaggcagaacggctcagccccgcaggcctgactgtcccacaccaagagagtgggtttcttgtaaagccaaaactcctttcttgacttggaaagggaagtgactctcccctaagagaagcggtgcctatcttgagctgctcgctgcagactgagctgggaggctgctgctgcctttgaaatggcccctctttgggaaagtaaggaagagtctgaggtcctgcaagccgccctcatgggccagctccagggtggccagggaggcctggagtggcctcagacgtgtcgcataaatggctgtctcaaacctagggccacagttgaagcaaaagaggcccttcggctccaccctacaaccttttggcccttgcgtcctttctaacatccttcccaccgagaggaataaagcagaaaattagaactacccataatcccctatcacatcaatgttctctgtgaacttcctgtcttttcttgaggttgagattgtatctaggatattgattgtttcagtcaagatgggagcacccccaggtgtttttctgttttgttttgttttgtttttgagacagggtcttgttctgtagaccaggctggagtgcagtggcgcgacctcggctcactgcaacctctgctcccaggctcaagcaattctcccacctcagtctcctgagtagctgagattacaggtgtgcaccactatgcccagctaaattttgtatttttctgtagagatagggtttcactatgttgcccaggctggtctcaaacgcctgggctcaagtgatccacccgcctcagcctcccaaagtgttgggattacaggcgtgagccaccatgcccagccacactcccaggttttcatgcaagtttagatgaagagttagaaaatatctatctcatagaccctttcattattctttcccgatttggaagaaaaaatccagtggtctgagccattccggtgagttctaaagaagagacacttgtgactcaagtccctggtccctgacggtggctgtcacgtatctccgggcgacatggcttttggagagggaaaacaaaacaactttctaaaagctgttccgtcacaagcatccgggaggtgaacggttgagccattgttattaagctcaggaagcgagtggcagctgttattgttctgagtggtcactgagtgaagtaaagattccgtctgagccgccgggcaaaggatgtggctctaacacacttcctgaagttgcacaacaaggggcacagaaaaggttcagggcatagaagcctagcacggccagggctgccctgtgtgggctccacagccatgccaaggacaatgggccccaagggggtccgtgctggtggaggggttcctttatgctctgacactcaccttctagaagcctgcattttgaattggtttttctgtctactgcagaatatggacagatctattttccaagcctctgaatatctcaaaacatctttagttgtctacacattcaagagtaatttgatagatataaaattcttggaaccaactgttcgctcaaaatcctgtaaaaggtacagcactaccttcaagaatgtagtgttacaggctgggtgcagtggctcactcctgtaatcccagcactttgggaggctgaggcaggtggatcacctgaggtcaggagtttgggactagcctgggcaacatggtgaaaccccgtctctactaaaaatgcaaaacttagtcgggtgtggtggtgcatgcccgtagtcacagctactccggaggctgaggtgggaggatcgcttgaacctgagaggcagaggctgcagcgagctgaggtctcaccactgcactccagctgggtgacagagcaagactgtctcaaagaaaaaaaaaaaaaagaatgtagcgttatgaatagttccgagtacaaaatccaaggccaaacttgtgctggttcctatagaggcgacccatttttttctttttttctactttgaagccggtgggaattcttttccagtgttgtcattttcctttcattgatagtacctgcaatgtgttcggcttgttcactttgcaaactctgttctttgacacaaaagacctttcttctgttaggtctttgagtaagtttttattccagctcttctggcatctttcttctaatcccctgagaaagccaagcctccccccgttttctagccccctggggtacacatgcctttgtgactgagcagcccctccctcttgtgtggctgcaagatccctaatcccttccccagtctgtcagagaattctggaaagagtatccatgccatttgtcatctctacctccaaatgactgtctttattttctccccatccccactagccattttgtccttgtttctccatgttccagagccttctggttcaccttgccccagatcatgggcctgtttcctgtctttgttacccaaagcggtctagaactaacatcaacatgcaccatgtagccgataagtttagactggggaatgggatgcaagtgtaaccaatgagatgtgaagagaagggctttgtgggcttctagtaaaggtctgtttgtcttaaaaacagacatagggataagatagcctctttctttctttctttctttctttctttctttctttctttctttctttctttctttctttctttctttcctttttgagacagagtttcgctcttgttgcccagggtggagggcaatggcatgatctcggctcaccacaacctccgcctcctgggttcaagtgattctcctgcctcagcctcccaagtagctgggattacaggcacctgccaccatgccgggctaatttttgtatttttagaagagatgggacttcactatgttggtcaggctggtctcgaactcctgacctcaggtaatctgctcgccttggcctcccaaagtgctgggattacaggtgtgagccaccgcacccagccaagatagcctctttcctacctttggaagctgccataggatgtgatagctgggtctctgctgctgccttgtaaccatgaggagaggtagctggcgagtgaggccaacacacggaaaggagaagtgaacctgggtcctggatgatgcccttgaatttgctgaacagaatgaagcaacctgggatctgccctcctctagattttctgttttgtgagttaattaatttctttttgctcaagttagttgagttagggttttctaacagctaaaagtgtcctaacttacaaaggtttaaactatcccaggggaatttcaaagcagaaaagtgaaaatttcaaattgaatatcgagtttcactgcaccaaatgcccatgagccacggtctgacaacacagtctctgggtcttccttctccttagcctgtgtcgtgtttctgggacctgctccagccctgtcccagacattcctaatgacttatgttcctgtcagacatccttgggctcaacatctctttctctaaccctgaccagaaaaagcacaaaaatcaatcagtattttaacaatgtctgtgcactggggaggcatgatttcttgcttattgcaggatggtttcgcttctcatcttgactttgcccttcgagatcagcttccgggtctaattgtgtctgtcagatttgcaagaggccacttcgggtttgccaaatagaagaaagtctttctgagaggcctcacttgatcaccccagaaaaatagtcaccccacccttcacctgttgctctttaaccccttaccctcctttcttttctttgtggcacttgtgactacctgattttatattatatttatttatttatttatttttttgagacggagtctcactctgtcaccaggctggagtgcagtggcacaatctcggctcagctcactgcaacccctgcctcccgggttgaagtgattctcctgcctcagcctcccgagtagctgggactacaggcacatgccaccacacccagctaatttttgtgtttttagtagagacagggtttcaccatgttgcccaggatggtctcgacctcttgaccttgtgatctgcccgcctcagcctcccaaagtgctgggattacaggtgtgagccaccatgcccagccctgaggtatttgaaaatatacatttttatattgacttatttatcatctatactagaactattcctagcatgtagtgagtgcttgataaatacttattgaatgaattaactcttctgccaccattaagaagatagaaagtgctacaggtttcacttaaaattatgatttatctcacccttgctgtagtcatcaatcttaaatttgtcctccacaggatccgccgttatctattgacttgcttttcatgccttggtcaacttcctctgcattcgagacgggttctcttttctggactcagttctgctgtagctccctccaaagtggatcctcatttcagcattgaattgagctcctcattttttttttcttgagacagtgtctcgctctagcccccatgctggagtgcaatggcaagatctcggctcactgcaaactctgcctcctggattcaagcgattctcctgcctcagccttccaagtagctgggattacagccatgcaccaccacccccgactaattttttgtatttttagtagagacggagtttcatcatgttggccaggctggtctcaaacttctgaccttgtgatctgcccgcctcagcctcccaaagtgctgggattacaggcatgagccaccagccccgccaaggttctcattttgttgcaagcctgccttgcctggctgatcttcatgtttcactggccctgttgtctgttcatctttctcctcttcctgggattttcactcctgggtcataaaggccttgccttttgacgtccacgtgaggctgccgatgcttcccgagatgtcccgagacaagttccagcagccacatttccagagaaggctcttcctcgggtcttcagggtggtgtaatgtcctagttccctcggggaagcagtttcttctctcaagcttctgtttcctcctcagaaacagtgggaggccagcagtacttctctcctgtggagattttgaggactaaaagagatggtttatgtaaacatgcagctcatgtctgacacgtgactccatggatgactgttttaaaatggcgaggacgcacagaggccagtcagctcgctgacaccaacatggggtcaccgggcagaggccccggcccatgactggccaagagctggggacaccaggcacaggggaaggagaaagggctgagactttgggacacaaaaaactcaggtgtcctgggattgacagcaaggccatccaaaggggccttggagaggaggacaagtgcctggaaatcctgactgcccgatcggggcccaggcgcgagggtcatggaggacagaggcaccaagtagggaccctagaccctgtctgccttgggatcctctgagaactgagaactgtaacagcattacagccgtatgtcccgactatattccttaagggtcaggggttgtcctgtgcctgctcactgggcatacgtcactgctgctttggataactgaggaagacagaggcggggtgagggcgagggtggatgcctggggtcccaaccaggtgacaagagagagccttgaggacacgggagggaccagcgggaggccccacaactcccacctggggcctatcttgtcatccctttctggcctggttgccttttgttgagcccctgtcaggagctaggcacttcatccgtgttctttaatcctggggaagggtttactactattgttgctatgatcactattcccatttttaaattcaaggaaacaaaggctcagatgagataacactgtttgcctgtttcataaaacttgtgacagaagagggatgtcattggagccatgctgtggctctgtgccctgcagcctggggcgctgggctggagggtgagcttcacacaaaggctactggcctttgtttctccaaccactggaggttccccagctatgtatggaaccagctaagggctttgcagtatttgagtcatgatccttcctgaatgagacccaagatgactctacttttaagccaagtccagtgagcgttatagccgtatgtcctgactatattccttgagggtcagaatgacagcttagagattcccggcagctcattcatttattcagtgaatattaattgggaactgaacaacagccaccctcaaagtccctccttcataggatgttcggtctagagaccaatgacaagcaattttcaagattagactctgaaccccagatttttacatcttgagggagaagcgtctcaggaaacttctacagtgcaaggagctcccctcaagtgggaggaaatgaatggcccagccatgccttccaaagaaccctctgagaggcgcccagtccctcttctgtgcttccaaacaatccccccgcccagcgtccacatcctcgcattgtggggtggtaggcgacccggtgtctgtctcccccagtgagctgtggaggccttgagaacaagggtctcagtcgcccgagtgtctgcccttgggcacaggacagaggatgcgtcgccatcccctgaatgaaaggcccagctggacctggcttgagaagaggcttctattgaccactcagtgcccacaaaacctttgaggttaactttagtctgccctgttcttagcagactgtatttcattttgagcaaccccaggagaggaaaatccaaatttctctctcaaatattgaattaatccatacatgagcagttagtgatttttataaagagattcgccatggaagagtacttctttcatttctgctcttcctggcttgtctgagtcaagagaccctgccaggctggtggccatcaggatgcccaacccatctcccccccatatttatgcccttcatgactggcaggaaaaaggatctgaaatcttgaaatggagaaatgtgttttccaaaatccaaacatctcacaaatatatgctatgaagaccctaaaaagagttctcagcgccctcacacagacacaaggacagaacatgagaacatagtcccagcctttaaagagagaaaacggacattccaacaagcagattcaaagtcacttggggtcgggcacggtggctcatgcctgtaatcccagcactttgggaggccaaggcaggtggatcacctgaggtcaggagttcgagaccagcctggccaacatggcaaaaccccatctctactaaaaatacaaaaatagccgggtgtgatggtgcacacctgtaatcccagctacccaggaggctgagggaagaagaattgctgtaacctgggaggcagaggctgtagtgagctgagatcgcgccacaacactctggcctgggtgacaagagcaaaattccgtctcaaagaaaaaaaaaaaaaaaagaagtaacttggaagtctacaagaaagataccactggctgcttgggaaaccagacaatagaactgctttctcccctgacgaaggtgctggggagatacttactcttatgacactaaactccttcctgccccagggtcttggcacctgccctgccttgtgcttgggactccgtccctcaggtcactatgtggctgactggccaacaggattcctccaaggccttttcccaggtcttcccatctaatatcatgccctgtcccatagccgctccttatagcactcctgttttttcttcatagcccttatcgctgtctgcaaggggatttgtctccattgccactataacaaatttcagcaaacagaggggtttaaaacaacacaatttattatcttgcagttgtgcaggccagaagtccagaagctctcactgggctcaggtcaaggtgttggcagagctgagctccttccagaggcttcaggggaaaatccctgttcttgccttttctggtttctaggggtcacctgcattccttggctcatggcccattcctctgtcttcagaaccagtaatggcccatcaagtctttctcataatgccgtttctagggctctgactctctgcctccctcttccccttatgaggactcttgaacgtagattgggaacagctgaataattcaggatcctctcccaacctcgaggccagcacatgagcaaccttatctccctcaggccatggtacataacagccacaggttccagggataaggagggcttgggaggcggaggccgttattttttctaccgcagcaactatcttgattctgtattgactcactcatttattatctgtctccaccacgaggatgtaagactcacgagagccaagaccttgtccatcttgctctccactgtctctgtagcaccagaaggatgcctggcacagagtaggtgctcagtaaacatttgctgcatgattgaatgaaggagtaaatttgcaatacaaacaaagtgggaaaggccaaggagggaaggagagtggagacccccaaagctttcctgttccgaaattatctgattcattctacaagattagcaaagcctcccaagatgtaggcgttcagggccaatgtttcataatcagctctgcgaggttggcgctgggtctgggatgaggcaggcgggcggccggagtgactgggggcccgagctgccaggcttatcagggagccgtcccaggctctgccccctcaggcagcttctctccaggctgctcccagggctggggactctgggctggtctgccagctgtcacttctgtcttccccagagtacctcaagagttttacgaaaagaaaagaagcaagctggaaagaagagcgtctcagggatatgtaattaaggataaaaatatccctcataggctctgggcaatggggaaaatggagattgcttgccttcctgggcccagtggaaccatgagggcttttgaaacataatgattagggcaggtttttagcattgatgagcctgtgcaatgatgaatgccatctatacgggtgtgaggtaccaaaagatgtgtggttaaattctcgaaggggaggagtttaaatggagctgcatgtaaatacaggacctttgcttggggtgagaaggaaaggggaaatggaaatagcaaggggatgagcttccttaattgcatgtggcagaaggaaacggcaatttcaaaggcaaacattgaacgtgggaggtggaggaggccttggatgctcccaacagcatccctttatccctcaatctcccgtcccttcttccatcttgagacaggccaaggagccccaggcccatcactgtcagtggctcccacgtagccaggggtgctcccaccccagcccccagcacccctacagccatcttcattcctcagccccacctgacacgttgcccctgacagggcttagtagatttccgctggatgaaaaaggcatgggtgaaagaatcttgactctaagataaaaatggttacccaggaagaaacagaaagagaaattaaagaatgtgtcttgagagaaatggaacaataagcagacttcaacctgagggctttgtgaagtcagggtctccttcacgtggtctgatgggccactgcattcctctcttgtctaatctttcttttctttttttggacagagaaggattacggcagattaatattgataatttctgctttttctcttagggcagtagtgagggtgaggaagttcaaattgaaaatacaaaacagaagtaaaatcccctgacatggaaataagccttccttcttgggaaactatcagtgtagatatgtttctctaaaatgtaactttagagtctggaatatatttgacatcttaaaaatggtcttcaagactttatggtaaggccaggtgcagtggctcatgcctgtaatttcagcactttgggaggctgaggcaggcagatcatttgaggtcaggagttcaagaccagcctggccaacatggtgaaactctgtctctgtctaattcaaaaattagccaggcatggtggcgagttgcctataatcccagctactcaggaggctaaggcatgagaatcgcttgaacttgggaggctgaggttgcagtgagctgagatcacgtcactgcacactccagtctgggcgacagagtgagacactgtctccaaaaaaaaaaaaaaaagactttatgttaagctcatcaagtgttcaatgaggcatttgttagagatggtagagatggacagtcttcaattttggggtgaaaagatttgcaaaaatttgtcaataataatgtgatgacgtccagagctggtcccaccactggctctctcctgccacctgcccagtggtggcttcaggccacactcccttggcagaagaacacgctatgcatgcctcctgagcacccttcttctgcctcctggcccgttttccctgtgcttctccctggagtctgagaaacagatgttgccgtggtcccctgcctggtagagcccaagagattctctacagctgtgctggccagtgctgcagccacaggccacatggggtcacagagcacttagaatacaccccctccccccccaaaaaagagaatgtcctatatctcatgataattttattgcacattgaaatcttaatattttggatatattgggttaaataaaatacattcatcaaattgattttatcccgatgtttaaaaactcccaggctgggtatggtggctcatgcttgtaatcccagcactttgggaggccaaggcaggcagatcacttgaggtcaggagttcgagaccagactgaccaacatggtgaaaccccgtctctactaaaattacaaaaattagccgggcttagtggtgcatgcctgtagtcccagctactccggagggtgaggcaggagaaatgcttgatcccggcaggtagaggttgcagtgagctgagattgccccactgcactccagcttgggcaatagagcaagactccatcccaaaaaaaaaaaaaaaaaaaaaaaaaaaaaattctaaaatctggctgctggaaaatttaaaattgtatataaggctcacattacattttcactgggcatcattgctctagaaccttgctgctcagagtctggtccacaggccagcagatcagcatcacctggaagcttgttagaaatgtggacaatcaggtcccagacccgggaattcagaatcagcgtttgaacaagatccccaggtgatcctgatgcacattagggtttgaagaccatgtgtgggttgggggaatggcagtcagtctcactcaccacgggagggagtgcaaatgccgacaaatgctctggagggcaaattgccaatgtctatcaacatccgtaatgtctgggtgcagtgaggaatgttctcccacccctaatttgtccaacaagtcacatggacaaagatatatatacgaggacacccactgcagcattatttcaaataggggtcaaagaagaatcctaacaaacaacctcatgttgcctaggttagcattcaacctaaccatgatgaagagggaactgcttaaatacactgtggtccagccaatggaagactatgcagctgcttaaaaaattaaagtagagctgtgtgtaatgagttggaaagatttcaaacattaataaaaaagttgcagggtgatattgttgtaggatagtttttggtttttgtttaagggatagattatatacacaagattgcacatacataagagtgttgagatagaacttgtattttagagataggatctcactgtgttgcccaggctgttcttaaacttctgggcttggccaggcgcagtggcccacgcctgtaatcccagcactttgggagaccgaggcgggtggatcacctgagctcaggagttcgagaccagcctggccaacgtggtaaaaccccatctctactaaaaatacaaaaattagctggagggggtggtggtgggcacctgtaatcccagctacttgggaggctgaggcaggagaatcgcctgaacctgggaggcagaggtcgcagtgaaccgagccactggactccagcctaggcaacaagattgaaactgtctcaaaaaaaaaaaaaaaaaaaaaaaaaaaacaactcctgggctcaagcaatcctcccaccttggcttcccaaaatggagatagaacttttaaaataattttttttttacatttaaaagttatatctcagcttggtcaaaaaaaaattaaaacagtaccaaaggaaatacataggaaatagagatccccttctcctattggtaaccctaatgtcctgcaaatcccccaccctagtcccactgttgacagtttctcagatactgttttcaaatgttttatatatttatatttgtttttgtaaataggataataccgtatacactgttctgcgatttgctttcttcccttagcaatctgtccgtgagatggatccaagttcattcatgcatcttttgtgctttttaacagttgaacgataatggatggatacatagatgattttcttttttgttgttctcactacaaaagacagatgctacaataagcaaggcttgcttgtgactgtgcatacaagctttctccaagaaaaactattactgggttgaaggaatgcgtatatgattgtaaaatactgccaaactgctttgcccggggctcttccgagtgaccttctcacccagtgtctcttggtcctcatgatgctcacacatctcaattctggacattaccagtgcctgtaattttcagcagacaatgagtgaaatatgtgatcgcaatattttattttgcatttctctcattagaaatgacactaatgacccaggcgtggtggttcatgcctataatcccagcactttggaaggcagagctgggcggatcaccagaggtcagaagttcgagaccagcctggccaacatggtgaaatgccaactctactaaaaatacaaaaattagccaggcgtggtggcgcatgcctgtaaccccagctactcaggaggctgaggcaggagaatcacttgaacctgggaggcggaggttgcagcgagccgagatcacaccactgcactccagcctgggtgacagagcgagatcccatctcaaaagaaatgacactgagcctattttcatatatgcattcaccatttgtgtttcttttcctgtcaattgcctatttatattctttttccattttttcctttttaaaaatatttccgattttaaaaaccctttatatgttttgtatattaattttgggggtaagttatatgaaaatattttctccagcctgcaatgtttttaaacattgtttatggtgcgttttgtcatgtggaagtttaaaaccattaggtagtcaaatgttttcatttacggattctgagttttgtgaatcacccatcccaatattatttatttagggaaaatgctattttcttctaacaatttttaatgtgtttttatgtttagctctttatttatttttatgtttggtataaaatagggactataacttcaccgtccaaatggatagccaacaccgtattaaatagcccatccttttcccattgattcacaatgccattatatcatgtgctaatttcccccatagtcctaatctgatttgaaacgcctcctcctgttccattgatagattaatctactcttgacccagctgcataggtttaatcgaggtggctttcttgtgtgtttccttatctggcagactaagttcccatttattattctcattagtccttgcttgccatgcattttcttttccaggtgatttttaaaatcagcttgtcaagttctctgaaaaaatcccagttagaattttgtgcaattacatgtaattaataggttaatttataaataacttatgttcttataacatcaagtccttcaatttgagatcatggtttctctctccatttattcagcttttcttttatatcttttttctgctttctccatatagttcttaaacctgctctgttactgagtgtgatgtagctttaattacctttgcaaacagaatcttccttttccatcatgacattttctggttaggttttgtgggtatctaggaaagtgatagtttcggtagggtactcttaaatatctgtctgaattctcttattcattttaatagtttctgaatttattcttttggcttccctaggtaaatgatcttgttttgtgcaaataatggcagacagtctgttccttccaatgcaactcatttagggacaggggagttgttctgatctgttttgtgctggctgggacccgccgtgcaatgctgcagatcagtggcatggtgcttttggttgtctcatttctttttttttttttgagacagagtctcactctgtcgcctaggctggagtgcagtggcgcgatctcggtcactgcaacctgcacctcccaggttcgagcaattctcccacctcagcctcctgagtagctgggatgacaggcatgcgccaccatgcctggctaaattttgtattttaagtagatttaaaatacagggtttcaccatgttggccaggctgatttcgaactcgtgaccttaagtgatccacctgcctcagcctcccaaagtgctgggatcacagggatgagccactgcacccggccttggttgtctcacttccgatttccaaggatgtttctgctccaggaggaggatgcaagtcaaagacaaggagtgcaacaggagtgctgggagatgggcactcaccgaatggtgcccaaatgggaccagcaccgtggataggagctggaaaacttagccagtggtgagccacagggtcttctgagccagctcaacccactgcgaggctcctctttggtgagacgtggtgctggaggcgtggtcagggccagacaccaggaaactctcaggccacaacctgtatatctctagatagttctggtcttctttaacgtgttccttgaatagagcagaaatcggcctcctataaaatccactcctggatcccggttctcccctcaggagatacatggaagcctcaactgtttgaaaaaccaggcaggtctctcttgaggtttcttcaggccaaaccctctgggttacttcagccattccgcacgcccctcttaaccccaggccatcccagatccacctcccatgacacactcaacctggtgcctgtccttcctaatgggggtctcagaacccaaggcctgcagagtggactgaccctcccaccgggcgcccctccacgagtgcagtctcacagacagtggcaccagggggcgcccattcagcgatccagcttcacaatgtatttgccatcgactaaaatgccatcgtctttttcacatgtgctcctgctaagctagatttggaactttatttttatttatttatttatttatttatttatttttgagacagagtctcactctgtcgtccaggctggagggcagtggtgcgatcttggctcactgcaacgtccgcctccttgttcaagcaattcttctgcctcagcctccggagtagttgggattataagtgtgcgtcaccatgtctggctaatttttgtatttatagtagaggcgaggttttgctatgttggccaggctggtctcgaactcctgacctcaggtgattcacccaccttggcctcccaaagtgctgggatcacacgtgtgagccaccgtgcccagccgagacttggaactttagattgttttgtcctaaacttcccatggctacaccagcccgttactccagaccattgaggtcagcttcatcctggctctagcacctggcatgtgtgccatcctcctagctggatggcagccccacattggaaggcctgcctcctggatccttatctgaattgctgatgtgaatgaaaggaggaaccaacagcacagacgcctatgtctggactgacactggtgtggcctcagccaggcccatctctctccctgtgctcttcaacaacaacaaaatcacaaatgaaccccataaaatgctttatggaaacctatagatatcagattaaagatcacaatctggtggcccctatgttggatttagtgttctgttcacccaacccatatttttaaaaattatgaaccagttacaagcatttttaaaaattcagagatttctacataataatctggattttcagctttccttgaaaaatctgaagatctgatacccttgattattccacagtgatgtagctggggtggggcgtgtattagtctgttttcacgcagctgataaagacatacctaagactgggcaacttacaaaagaaagaggtttaatggactcacagttccacgtggctggggaggccttacaatcatggcggaaggtgaagggcacatctcatgtggcagacaagagaagaatgagcttgtgcagtcaaactcccatttctaaagccatcagatctcatgagacccattcactatcacgagaacagagccgccataattcaatcacctcccaccgggttcctcccacgacacgtgggaattgtgggagttacaattcaagatgagatttgggtggggacacagtcaaaccatatcagagtggaagcattccctttcaatggggcagttctctttgatgtgtcaccatccccacctcgccctgtcgcctcactcgcagcctgttccactcatttacatcacccgcctgactgctgtaggccactgagctatgatattcatcagacgcaactaattacccaacttgtgaggccagcaaccacacactggtaaacaggtttagttgacttggtgtgttcccagtgacctcctgctggttcccaggcccagcacctgctttgcctctcctcacagatcatgctgttagtaatctcatctagcctcttgcctggggtggacgtcaagctcactacactgtaaactccaaaacagcccacgttactcccggtgacaatcagaattccccctggcctgccctcaggtgtcctggctctctcctctcagcatcccccatggactcatgggcacccccggttgagctcgctcacccagagctctctctcttccctgggatgaggcttggttctacggaagctggggtcgtcacagcctgttttctgccttggggtttggtcccagttcctcagagcagtgactttcagttcctttgcaggtgtgacctgtctgctcctgttagagcctcctttccccagagggcagggtgggccccactggggagctggagggctcacttttgtcactgcacttgccacccagaacactgttactgtccctttctggcatttcttggtttcagacaatctcacctacccctcaaagaaggcggaagcttcctgtcgtggtctggccctttgccatctttcagtgttcctcactgaacggtaatcccctccgtgtgcccccaacgagtcattcaccatcttgtgctaactgcatttcttcctgatccaaacttgctttctggagatgggggccatgcagaagggaaggcgggtgtatcaggaggtctggtctctggggactgaagggatgattttgccaaaagggtcaatgtcactggaccacatgccatggtaaaccttggacaaccagttctccagggaagaaaacaagcccgtgatttgtagtgtttgcctatttctaccgtggagacactctaaccacagctcccaccagagtggctgcattcacaaccagctcttggggttcctggaaaactgggatttgagcctgtaggagccagtgccagcaccccatgggcatgtgtgttatcagctcacatctgccaagtcctggcgaggtctgcctgcctctaggactgtagacgtctttattagagactcctgtcacacctgttaggagtcagacagattaataatcacttctttttatttagagctcttttaatccccaaactcttatttataagttattttataaattaataatgatatatcatatattatattataattaataatgacatatatgtcatataacattattaaaatcaattaattattaaataattataatatataattatatattatattattattaaatatataacatataatagatattatatattacatattatataagtagtaattgcatattatataaataatatatattatatataatataaatatatttatttattataaattatatttatttatattatatttataattacattatattatattaacttatttataagttaatcagttttacctcttccttgtgatcaggtttgggaaggatgttttttctacctgcctggtctgcttccttgactgtgtgatcagggtcaaactgcccattcttctgagcttcagtttatttatctgagaaatgggagttgctggtccattagcacagttagcagagcaggtgctgcatgatgaccgtggctctcactgactgggagccacgccccgggctctgttagttcgttaaaccacttgggcaagtaggtcttgaaatcttcattcacggccaaggaaactggtttggtctcagagagttagatactgtactctagatcgcacaaccagttggtcgtggagctaagattgacattcgtagctgacatggtgttttaaaacttagtcacaaacattaaaaaatcggagatttcatctaggaatctggacttttaccttctgaaaaatttaaaattctagcacccaaggcctgtgttaccccatgatgctgtaactggagctaactggaagctgctgcctttgaaggggtgtttcccccatgggccccagtccccgcctctccctagtgtcccacacctcgcctgcttcactcacaccaagtttcacatttcgtgattttccccatgggccagaatgagaggaagaaactgaggcacagaatgttttggcaattaattcagctcaaatcagagaagccacagcagagctaagaaccggtctttcatagtcaggctatgtgatcaaaaccacagcgcctcggtggctcacgcctgtaatcccagcactttgagaggccgaggcgggcagatcacaaggtcaggagatcgagaccatcctggctaacacagtgaaaccccgtctctactaaaaatgcaaaaaaaattagctggacgtggtggcgggcgcctgtagtcccagctactcgggaggctgaggcaggagaatggcatgaacccgggaagcggagcttgcagtgagcccagatcacgccactgcactccagcctgggcgacagagcaagactccgtctcaaaaaaaaaaaaaaacaaccaaaaaaccacagcgccttctcactacaaagccatgactttacaaactgttttaatcccttctgtccccatattgcactttgtataacactccccttcctaggaaaccatttgaatgggtgtctttttatttgaatatgttcttacaaaacactattgttgtcttgggtgcatgcattttaaattgactgaagtcatatcatagctttcattctgtgttcccccttttcaccaaaggatcttccatgctgctgcgtgcacagcaagctcttgcttctggctgctgcaaaacaccccatgtatgccttgaccacactacttgtccactgtcccagtgatgggcatccaggttccctgcaaatctctgctgcacaaagaatgacaacccatataggtgggttgtcaaagtgagccctggggtatatgcccaggagtgaagttgctgggtcatagcatatgctcatatttaatttgcctaaattgtacctgattattctccacaatggctgtcctggtctatgttcctgggtttctctatccagcacagatgttgagagagacgggagggctttgcaccagtaactaggcccttggaatggagctcaaggcaggcttgcctcatgtcaaaggcaccagaacacacaggcagagagattggagaacggcaatctttcagagtccaggagcgtagaacttagaggaaggaacctgagatctgggttcaagtcctgcctctgccacttccagggcaagtcacttggcccttctgtatcctggctgcctgccgagggggtgatctgcccagtgctagggtgttctctcagaaaagtagttctttttttttttttttttttttggagacagagacttgctgtgttgcccaggctggagtgtggtggcatgatctcggctcactgcaacctctacctcccaggttcaagcaattctcctgcctcagcctcccgagtagctgggattacaggcatgtaccaccatgcctggcttatttttgtgtttttagtagagatggggtttcaccatgttggccaggctggtctcgaactcctgacctcaaatgatccacctgcctccgcctcccaaagtgctgggattactggtgtgagccactgtgccctgccttttttttttttttttttttttgagacatagtcttgctctgtcgcccaggctggagtgtagtggtgtaatcttggctcactgcaacctctgcctcccaggttcaagtgattctcctgcctcagcctctcaagtagctgggattacaggtgcgcaccaccacacctggctaatttttgtatttttagtagagatgggatttcaccatgttggccaggctggtcttgaactcttaacctcaagtgatctgcctgccttgccccatttctttatctgtaaaataggaagactaacagaaacttaagtgaagctgtttgagtactcaaaaaatattcatccttttcttcattcatttccaacactgaggtaaatgcacaatgcatttcatcttcaatgctgaggcttctttgcatgctcggtcacacttagggcaccctggtatcccctctagctggttcagggactcacgggacagaggccctgctaaagagcaggatttgggactgatcagggcaaacagaaggtgaggtcggaagtgtgctgaagccatggggggtaggctcagggagggatggtcgtggtcctcatgggccatggttggggaggaagaggaagaggaagctaaggttttcatgtctgatcagctcttctataaagttggggggtccaaattctttcccagtgctgagaggcttgagttgaggacttgacggtgaatcgtttggtcagctgttgaggacaggcttgagatggacaagtgcaaggattgattttgagagctgaccgccataggtcaggttcttccagaagcagatcctaggccttggtaccagtaattcatgaaagaagggctcccaggagaaaccagtaagggagtgggggacaaaggacagggaagagggggaaaccaggtgtggtttcaggtgaagtctcacctctggcctgatctcacaggagctgtggagtataaattgcacctccaaatttgtcccacagggaggcaagaaactgggcttttgcacatgtactccaggcccccattggctgtcttgggtagggatagggaatgtggacctcccgggtttctcctggatttccccataggtgaggtggttccagtgcccaagggcagtcgtctgaggcaccaggcttaggtctttggcagcaaagcaacagagcccccagaagtggggatgggagcaggggggcggtcagtgggtcccagggaactgggtaggacagcagctgcgctctctgtaagaacctggctatggttggaaaccgtcatttctatctacacctgtgctttgccagtgccgctcccttcgcccgccagggtgctccctgtctctttgccccaccacctcctattcacctgaagtaggagcatctcagctgcagagtagcttctttggtgaatccttccctgatccaccaggctgagtctcccggagcaccctcccaagctactgtcctctcttcacaagcctctgcacctggtcatattttcttagttgtttatggttctgtgtcttgctcctttgctggactgtgggcagggcctgggtctgtgttggtccctgatgccgggggctgagccggggggaagagagccagaggggaagggaagggtaagagggtagtgaccgcaagcgggccgcctgctggctgctgcaccaccagctctgctttccttcagccctgcccagggcagcaggtgatcgtggggcggatcttgacgagtagcttcgaggacaggggccacaggaggacaggctgccagcaagtggagggtgccagggagagagtggctctggggggccacagtggggttctggcttgttggagagatggtggggtccaaagaggcccgaaggcctgcacaggggatgagatgaagggacagtggccactgggaggtcagagagcagtcgctatgggaatgagcatgtggaacttgacgatttgtccctattggcagatactgatgataaaacaagttgtgtgacattggacaagttgccttatctctcgcagcctcagcttccccatgggttaatgaagataagtatgtcatgaagtttcaataagaggaagaccccgggggaaagtttatttttcccaccacacttgtatctgtcagtgtttgctgcataacaaacagcctcaaatctcaatacttaatgacagcaaacattgactttccactcctgggtctgcaggtctgctgtggttggctaatctagttgggctgtcttggactcagctgaaccaggctggactccaggtttctaatcatgtccaggtctgtgcctaacatcctcattcctgggccaggctgaagggctggagttttcctggccatcctttcttatggcagattgcaggggcccaggagggcgagtagaaactcaatgtgcccttaaagccctcagctcagaactggtgcttttgcccacattgcactggcttggccagagtcatgtggccaagcccaacatcagtggggcagagacacagattcatcacgctctagtgcaaggtgctacaaggacgtggctgcaaagccctgcagcagggaagggcccttctgccacagcacccctcctcctcctctgggcttctccagtgcacctaagctcttggagaaagtgcagaaacctttcccatagtgaactgaaaagctcactgtgatgccaggtatgaggcacagtttctagctgtcagctgtgactctagtgatcaaggacgcatcctgtcctggattcttaattgtggacctgagtttcccagatgagggttccaccatccaaatacccagagcacctgctgatggagagcattgtcatccttgtccccttgctctgatcctggtgacattaacagagacttcagagctgtcatttcagtatcagccaaagctgtcaattttccagccctccatcctgagctcctttgatgtgaggggttcaaagcactttctaagctgcttgaatcttcaaggaaagcatgggcctgactcccatggcacagatactagggagtgaatggcagagatttggggacctgatgatctcaacatcccagtgggaatcccagctcatgggggataaggcctaagtggatgcccatgtctgagagttgacctggcatgacggtttccccagcagagggtgcggtaggcagggctgctggtgggtaggcagggggtaggcagggacccagcctggggaggatggcctgattccacaaggagctgtggagtgtaaattacacctccaagtttgtcctgcagggaggcaagaaactgggcttttacatgtgtactccaggcccccattggctatcttgggtgggcacagggaatgtagacctcccaggtttctcctagatctccccatgggcaaggtggctccagtgctcaaaggcagttgtctgaggcaacaggctcaggtctttcacagcaaagagggtgttggctatgaactcagagaaaggggtgatttagaagggagtgcagagactgctggggagtggggcaaagcccatgccaggtgattctgggaagtctgcccaaaacaaggcgagaggaatgtcgaagaacctagcttcaggaagttggggctggttggaatgaagtagttgggagaagatagaacccagctccactagtgccagggccccccagccctggacagcaagggcctgggggaggggttacaacctggtgcttgccggggagctgggaagaaccgggtgtctggggtgggagtcatgatgtccctgctggccccagctggcgggtggttggagacagggtgggtgcttgggctcagtcttcgctttccttcccttaagcttgggcctcttccccagcgctgccacggcactcccttctgcacactgagattctgaccgagactggcattggcttttacccttttcaagtctccagacatgtggtttgggaccatgcctgggagaggccagtggcggctggaccttgcccagagatagccagtgccagtttcccccctcccacctctcagtccaccatagccccagggggcggacctcctgtcctccaggaggtagacgccccaaatgccaggtttcacaccaccctacccacccactgagcccgagtggcttgcgtctgccacagcgtctctgactgccttctctgccctgggctggcagccccctggctctgtgcctgtcctcctccgggatctcactatcatccagctagagagtccggggatcccccacccaccacctccaacccctttctcatctctctcatctggaaatgtcccctgggatgctgctcttctgacagcatctctgaccgctcaggcaagctgctcaacctctctaagactcagtttccccatctgtaagctgaagatatcaaacccacctgcactattagataaaatataaattgcatcacatatgtgggcgcatctggcccactttcttccacatctgatgatcagtcaacatccattctttcttttttatttaaacgagatgaggtcttgcgatgttgcctcctttctctccccccaagtgcaggtcagagccttccaagccccaggaacccacaaaatcaggccatctttgtgagatgtgccagctcaaattccctgcagcctgactaccagaaatttgcccccttgaaagttcccacaagtatttctgagatgccctcaaagagcccctccctgctccctcccagggcagcacggggcaccgttccttcctcctttgccaggtcctaatgtgcaggtgtctgacaggcacttaccccggtaccgcaagaacaccagggtcactgtcccagcctagggctctgtgccaggcactaaagctacccatccacagtcttgcagcttctgcatggcagagaggggacaaccccctgcccagtgctaggctttggtttgtacccagagacccacaaaagagtgcacaccatcagtctctgtctgatgctcagtcattccagaagctaaatcaagccatgggttgtggcagaaaacagaagctatgtcctatctactcccattcctctgcccagccagagtacctccctctcctggtcacaaaatgagacctgccttgctcttctgtggatggaaacttgcaggagcctagctttgccatgccaatgcacagtgcccatccacctccatcctgcagccccagctgagacacttgtgctgctgaagagaatgcagcccctcccctctggccagtcccacagcacacgcttcagctgagacagccaagaagagcaaggggactgcctgcactcaccacagtgcttgtcctgggctgctgcagtcacctcaccctcgtctatgcgcgttgctgtgtgactctggttctctgtaattgacctttttattattggcgtgggcattgttgcaactatttgggcatcgtaggtgtttccatggtatttgtagcttttgtacagaaaccttcagaagtatatagactgggaatgtttttgtatgataaaaatagacacttttaggcaagatggtttttttctttcttttttatttttttgttgttgttgagatggaatctcgccctgttacccaggctggagtacaatggcgcgatctcggctcactgcaacctctgcctcccaggttcaagcaattctcctgcctcagcctcccgagtagctgggattacaggcgcctgccaccacgcccagctatttttttttttttttgtatctttagtagagatggggtttcaccatgttggccaggctggtctcgaactcctgacctcatgaaccacccgcctcagcctccctaagtgctgggattacaggcagaagccacagcgcccaccagtctttatcttttttttgagacagggtctcattctgttgcccaggctggagtgtaggagcacaatcttggttcactgcagtctgcatttctcaggctcaagggattctcccatttcagcctcccaagtagctgagactataggcatgtgccaccatgctcagctaattttttttttttttttttgagatagagtctcactctgtcacccagactggagtgcagtggcatgatctctgctcactgcagcctctgcctcccaggttcaagcgattctcatgcctcagcctcctgagtagctgggattacaggtacacaccaccatgcctgactaattttttttgtatttgtagtagagacaggttttcagcatgttgaccaggctggtcttgaactcctggcctcaaatgattcactggcctcggcctcccaaagtgctgggattacgggtgtgagccactgtgcctggcctaattttttatttttatttttttttaatagagacgagttctcattatgttgcccaggctggtctctaactcctgggctcgagcgatcttcccacctcagtgtcccaaagggctgagattgtaggcatgagccaccgcgcccagcaacaagatgctctctaacctccccctgctttgtgtgtgtgtgcatgcacgtgtgcacactcgtaccaattacatgagctaggttacataggctgattttcaacaaactattacagtgtttagctcaaaaagtggttatttaggccgggtgcagtggctgacgcctgtaatcccatcactttgggaagctgaggcaggtggatcacctgaggtcaggagttcgagaccagcctggccaacatgtagtgaaactgcatctctactaaaaaatacaaaaattagctgggtgtggtggcacatgcctgtagtcccggctacttgggaagctgaggtaggagaattgcttgaactcgggaggcggaggttgcagtgagccaagatcacaccactgcactccagcctgggcgacacagcgagactccgtctcttaaaaaaaaaacaacaaaaaaaaaaaactgttgcttcgacagttattttaaaaaaagataatttgacttatagaacattttcaagaacggtacaaagaattcctgtataccctctgctttacccaattaatgttttagcatactgtttatcatcatttcagtcatattactattatcatttttctgaattattgacaagtaagttgctgacaatgccccactgtccctaaatatatcagtgtgtttttcctaagtgataaagactctcctttgtaaccacattcaaccgtcaaaatcaggaaattaacatggatgaaacaccaccatctaattcttagatccttcgttcaaatgtttttagtagtctcaataacaatatatacatctattatttacatatttatggaagttatatataacttttatacacacacacacacgcacacacacacatataatttcccccttctgggctgaggctcaatccaggatgatgtgttacatgtaattgtcacatcccttcagtgtcctttaattgggcacagttccttgccttttcttgtctttcatgaccttggcatttttcaatagaataggctaataattttgtagactgtccctgtccctcaattttgggttttcaggtgtctccacatgacatggcccggattctgcgttttctgcaggagtgcatagcagcaatgctgtgtcctctgtgcacccatctcagggggtacaatggcgctctgctgttactgcagaacttaacactggacacttggttaagctggtggctgccaggttacaataaggattgtaaagttactagtttttgcttttaataacaatttaaggccaggcgcagtggctcacgcctgtgatcctagcactttgggagaccgagacgggcaaatcatctgagtccaggagttttagaccagcctgggcaacatggcaaaattccgcctctacaaaaaatacaaaaaatttagccaaacgtggtgatgcatgcctatagtcccaggtacttgggggggctgaggtgtgaggatcgctggagcctgtgaggttgaggctgccatgagctgtgatcatgccactgcgctccagcctggacaacagagtgagactctgtcttgaaaaaaaaaaaaaaaaagaacaatgtaataacatttttcctcaaactctcacccactttgtttagcatgtattgacgattcttgcctgaatcagtcattactatgatgattgccaaatggtgactgtttttgttgtcgcttcgacggttattaattggcattccactgtggggaggagccgtcccttctcctttatttatgtcagtacagactcatgaatttctattttattcgatggattataattatttttattattcattttgatgtttgaattgtgctggatgcacctttcaactgttccttcagttggctcctggctcctgtatctgtttgacaaatcgccattattttagcattttcttgctttctggggcaacaggtgttgcaggtacttgttagatcttcttggcctcgattcaaaggctgctagaatcagccatttctcaaggagcactggctatctttcatggaggatgacatttagcagccaagatctgagcagcaggtgttctcattgctgttggagtgttgtgggctctcgcagcagacagagtgaggaaatagtgtgtgcacatacactcattcatgcacctgtatttatctatatatcttttttttaaaaaataccgcatctcactctgttgcctaggctggagtgcagtggtacgatctcagctcactgcaacctctgcctcctgggttccagcaattctcctgcttcagcctcccaagtagctgaaattacaggcctggctcatttttgtatttttagtagagacagggtttcaccatgttggccaggctggtctcgaacttgggacctcaggtgatccactcacctcggtttcccaaagtgctgggaatacaggtgtgagccactgcacctgaccggtatttacctgtatatcttaaaagcccgagttggcacagacacttcccattccaatccaatgccccacagccatgggacctttctcctttctgtgtttgcagctcctttctctgagagtgagaagcctggctcctgcttcttccccatgtattatccccaagaagggtaatccccttcttggattacatgcttattcccctgtgtataccctgcttctggctctgctgctcccctgacatcaccacctccttggttctggctgtgcagacttctaaggccctcgtcatgtccttatcccagctgctccctcgtccccactggctctgcagcctcctgcaacctgaccacctccctggccccaggtccaaggtctgctggccctggacacttcaaaggaagggaaaggaaaggaaccaataaaatgtttttaaaaaaagagaagggagggaagaggaagagctgattgttttgtttttgttttgtttgtattttttttttctattaacaaaagccacattcaattattgttctttttaagaacaaacattttggagtccattcaaagccatgtggctgaagagagattcctgggactgaaggaggcctcaaaagctcttcccaaatctgtcccccagccccaccacactgcccacctttcctatctcattaaatatcaccaacatcaaccaagttactgcagccagagatctagggccactctcgctggctctcgcttgtcgaccgtgccctgttcgatgggctaatctggttccagctccatccttgcctctctcctgctgctgcatctccctaattcaagcactagagtggggttgcttggacgcccagcgtccacaccgtagccgaggtgatagttctaaaatgtaaatctgatcacatcacacacacaccagcttttaattgcctttagtgcctccaaaccactcttttttttttttttttttgagacggagtctcgctctgtcgcccaggctggatggagtgcagtggcgccatctcagctcactgcaagctccgcctcccgggttcacgccattctcctgcttcagcctcccaagtagctgggactacaggcgccaccaacacgcccagctaatttttgtatttttagtagagatggggtttcactgtgttagccaggatggtctcgatctcctgaccttgtgatctgcccgcctcggcctcccaaagggctgggattacaggtgtgagccaccgcacccagccagctccaaaccactcttaagacaaaactcaaattctgccaggccccaagggcccaagacacccatgctctgacctttctttctcccccacttcttcacccacgtggggccctatgattcttaaatttgggggagaggaggtggttaaaggttgagaccatcctgagggcaggagagaagtacaggaaagcatttcaggggttgcagagcggggagaggccaggccgggaggaggtggcccccatccctagtaagagctggacaggaggctgcttccagcctttccctcagatgagctggctcagagcagggcaaacgcggcaggaggtctccttccagaactcaaaggctcggcctgcaccgtcagactccacactgatcctcactcagccttgggacgtgtggatgcctgggtcagtgggctccgagacctggagccctctgtggctttcagaaacttcccagcctccacaggcggggagtctccccactgggaaatggaagtaataaaaacagcagccaccccgcaaacccacaccattctctccaccacagccgagtggtgttttcaccgtcctctctagtggctttctcatctaacttgaaacaaatgctttggtgtggggagcaactgaagcagggtatttggtttggtttgtttccacttttttttttttttagacagagtttcgctcttgtcacccaggctggactgcaatggcacaatctcggctcaccacaacctctgcctcccaggttcaagcaattctcctgcctcagcctcccaagtatctgggattacaggcatgtgccaccgcgcctatctaattttgtattttcagtagagatgaggtttcaccatgttggccaggctggtttcgagctcctgacctcaggtgatccgcccgcctcagcctcccaaagtgctgggattgcaagcgtgagccatcgcgcctggcctgtttcccagttcttaatactgtcccgccactggtaaaatctccacaatcattctatatgctcttccatttaaaacgaagcctggaagagccttgtggggggttcctagcaccccggggctcctgctctgcctgcatggccttcctctgtgcctagtcctgtttcacgcctcatttagagacagcaaacagtgctaaagttaaaattacccactgggaaacttgagcctgtgcaatgactttcctggatggtgtgactttcctggatggtgttggaaagtcagagcccaggaactgtttctggaaatgcagcacttctcagcatgtgcagccctgagcctccagcagtctggacaacggctgttctttgttttaaagacccgggtgcccttctcgtcctgaaccccagggccacaggcagcccctctccccttgccctgtaccttccccaggagtattgctacctgagtgagctcaggtgccaagccgtcagacaaaggtgcctctccctgcaagtcccagcttggcaatccacgtctctggttccctcaacacctttcttcaatggagaggtccattttctgcaatgcacatgcccctcaacacagtggtgggggctgccattatgtcattatgtttgcaaccaaacttctctgcaaggagacttgggggactacgaggctgagccaagcagggttcctttccttcaaccacttatgagcttgtggggaaggcaggcacagcaactatgacatgacgcagagtgagctgctgattctaagctgggcttggtggggagctgtctgcagagactctgtaaaaatgatcctgctggaagtcacccagaactttccacagacctagaaattataatgggaggcaagagaagagtattttgtttcacaatctgaactaactcctaccatgttttgtttgtttgttttttctgcttgactcttggctgtgagcacaaattcatgcccattctgctgatcctaaaagctctgaagggagggctactctgagcctgagatgtcagatatatatgtagatatatatgtagatagatagatagatagatagatagatatagatatagatatagatatagatatagatatatagatatatagatactttttgagacagggtcttgctctgttgcccaggctggagtgcagtggtgtgattgtggctcactgcaacctccacctcctgggttcaagcaatcctcccacctcagcctcccaagtagctgggactacagggtgcaccactacgtttggctaatatttgtattttttgtagagacaggtttcatcatgttgcccaagctggtctccacctcctgggcttaagcaatctgcccacctcggcctctcaaagtgctgggattacaggcgtgtgccaccatgtctgaccaagacctcataatttttttttttctttgagacagagtctcactctgtcgcccaggctggagtgcagtggctccatcttggctcactgaaaccactgctgcttgggttcaagcgattctcccgcctcagcctcctgagtagctgggattacaggcgcctgccactgcacctggctaatttttgtatttttagtagagatggggtttcaccatgttggccaagctagtcttgaactgctgacctcgtgatccacccacctcggcctcccaaattgctgggattacaggcgtgagccaccctacctggtcaagatgtcataatttaacaagtctacttaaataaggcaatgctgctcttggttttgttcaaaatcaggcttcctgtgttgtgctctagttacctacctgctaacgggcggaggcgttcactccagggaaaagggagagttgccacggcagaaatccacgtgtccgagggcatcacttgggggccgccggtaaccattgcggggatcatgtcccggctgacttgggccttcatggtttccttctctgtttcaaaatgacttaacaactcttttcaggaaggcggctgctgtggaatggggaacgaagtgtggcagcctgggccattaggaaccaagggcagtcccctccttggtcagaagtgtggctggtgctaacctcccgattcgaacctggacgcttcatcgggggacgcaggcatttgttttccctctgtctccttgggcgccttttcaccatggccttcacgtgctgagcatcttccatttgctccccagttcattcgcttccctgccccctgctttctcattgggtttggccaatgggagccgcagccagatgagaggaaagttttttggcgggggaggggatctactgccctgctcgcatcctgtaaggtctccatggtagctccacgggaggccacagcgcctgctgggcggccccctctgggttccagcacctgcttcttgcctgtgatcttcccagggtggtaactactatgagttcgggggggctgtactgcctgttattggtatccctatgccctgtccctacatgttctccccaagttcccccgtttaatgagacatctgcctcctgccgggactctggatcgtgcacatgaaaaacgcacatgacaccttgttcacattttgccttttacagttgctgaaaaggcaccacctttagcaacgtgctgggggatgtgagtgagggcagctcccctgcttgccactgtttctctgcatccccagtcccagatgcatggaagaccctccctgaccatccctcctcctggctccaactcttgtctgtcatcctgacccaaggcggcaaatccatggaaccactaaatgctgctccaattgccaggccctgctgcacagtctggggatggcacagccatgagcagacctgtcctgactgtgggcacacagctgggtggatatggacctggcctgctgtgggtgggaacccccaggcctgtcccagcaggacccacctactcctgctggcctgtggatgtcaatacactgtccacctggaagcccctcctggctttgactgggtggggattgttaggtcacacccaggcacggttgcccttcaaacagactcctccccctaccggccactctgccctgtcccctcggccatcgtaccctgatgcaggacctttctgggcccaggttcagaatgcaacaccatgtgtgggctgctcctctctgcactgcacacactgaggccagaccatgctcctcaccacccacccgtctagaccacgctccccacccctccgctgtctgggccggctctgtagcttctatgatccccttcttgggctctgactctttctcttcctgttctagaatgtgctttgaacgtaagttctctgttttccttgtcaaagcttagggccaagagcaaagccttatgaagacaccttcctggacattttctccggggacacctgcctttgcctggttggtgccccgcctttgccatctcctgtctgcactgcctgcaggcacagggtgcttcctgcgggcccactgcacacagcaggttttccctcaggtggggtctgtccctgtggatctgcttcctgtagacctgctgtgttcttcctgggtgctttcccctcggagggggagaggtggaggaaggctccctcctcagcacacttgtcagcggccattatcagcttgccacctgtctgccatccatgaggcttggcttctaccctgcattctctcccttcctgggaacccgggcagccggcagccttggtttgccagaccctggctccctggcctctgggagcgggccaggcacacgcggtggcctcaccgggtccacagggactcctttaaattgctctgttcctagtacacagcatatgtcatcaagtctaagatgtttacctttcagatttcacatctctggagtcacataagtctataatcaatgtgtaacatagtctgtggttcagcttcttagcagtgcataaaataacgtgtcttacttggttttagcattggtgcgtcttaaattcccaaatctcacatgctcactcaaacacgcgttcttcagataccctccagccgagaatccttttctggattcacacatgaggcgttcaacttcagctttctttggtattttcatattccttttccatgctcttaatggcttgtcatctattagctgtacattttttgacagtctgacacttttcacgactgctttaactgaattgagttcatagatcttgtatcatgtcaaattatttttgttattctgctcactttggtttttgaacctactcatgttactttttagaggcctggctgctgctgctcagatatttctggttcaataatgtttgaaagagattgcttaacacggggctttgtgaaaacaagtgaatttattgaaaagaatttagaacacccttttgcttaactctctataaatttactaactaagacacacacacacacacacatacgcccaggcatagacttacatatgtgtgcaatgcacacaaaaaaacacacttggaaagagaaagacagagacagagccagagcccagatggacagccctgaatcacaggtcactgaaagaggcgtatgtgtcctcactaggacttggagttagccacccaggcacaagggctcgggaacaggtctgagtcctaaccctgctccctgatgtctgaatctgtcccagtctgggtcatcctgcctcatctctcctgattccacttacctgtaatcccgaagaccttcaggcaccctcccacctgcccacgtcaatcccaatcccagtagatatctgacttggaggcggaaaggccaacgcttggcccagccacgctcaggccagatgccacctgctcaccaaccagggtgggcttttcaacctccattctacttgcctgtgggtcttgtttcctacaggcgatgggtcccattccctccagaaagaaggtagctggcagcccccagaggagcagtgagatccttgacttctaactccaaggatggcgccttctcaactaattttaaaatgacctgaaagttgctgggtgtggtggcttacacctgtaatcccagcagtttgggaggctgaggtgggtggatcacctgaggtcaggatttcgagaccagcttggccaacatggtgaaaccccgtctctactaaaattacaaaaattagctgggtgtggtggcgggcacctgtaatcccagctacttgggaggctgaggccagaaaattgcttgaacccaggaggtggaggctgcagtgagccgagactgtgccactgcactccagcctgggcaacagagtgagactccatctcaaataaaataaaataaacaatctgaaagtcactgacatggtggctgttatgaggacagggtgaatcacaggcacttagcagttgccaggggcgctatgctcctccaggccagggaggccccacccagaaggggtgcctctttggggctcattcctgtacctaccaacagcctgaccccttgctcctgttcagctgcccctgagggcagggcctggcaagaaggtaaagggtgaggtaggggtggggctggctgctcagggaccacctggaactaccggctagagccacagggcttacaggaaggggatctgccccagggcatttgaatagccagcacaattacccccaaggtcctctgctatcagcaacagatacaaaccagatagatcatttactgagttttgacaaaaacaactataacaaatgaaaaaaataaaataaaaataaaagcaaaacaattgctggaattgattttttcctgtgttttttttaaaaaaagttcttcgtgcaggaaaaaataaaagtaacttccccaccaaacacactcacaaattctagaaaaacacattctaaactggaaaataggtatcttggggttgtgggattacaggtgatttctttctttctttctttctttcttttttttttttctttttttttttttttgagacagggtctcactctgtcgcccaggctggagtgcagtggtgtgatcttggttcactgcaacctccgcctcccaggttcaagcaattctcttgcctcgccctcccaagtagctgaaattacaggtgcgcaccaccacgcttggctaatttttgtgtttttagtagagactgggtttgagtttcatcatgttggccagactggtctcgaactcctgacttcaagtgatgtgcccacctcagcctcccaaagtgctgggattaccggcacaagccactgcacccagacaaatttcttatttaaaaaaatccatatttctaattttgccataatataaatgtactatttgtataaaaatacttttattttattttattttattttattttatttcgagactgagttgcccaggctggagtgcagcggcgcaatctcggctcactgcaacctctgcctcccaggttcaagtgattctcctgtctcagcctcctgagtagctgggattacaggcacctgccaccacgcccggctaatttttgtattctttttttttgttagcagagatggggtttcatcgtgttggccaggctggtctcaaactcctgacctcaggtgatccacctgcctcagcctcccaaagtgctgggattacaggtgtgagccaccgtgcctggcccaaaaacacttttaaaaataaaagttttttaaaaacggaaagaaaaacagatcttaggaacgatcctctgtgtgccttttgcagaagggcccttggcagctgctggttgcaggatgtgaggtgtgggcatgagggtcacacaccctgcgtaggagcccaaggcttttcctggatcgcagtcactccctccgcctcgctggtctctgctgcagttggcctttgtggttggctgacattctagttggttaacatgtgcgtttgtttggatgttctgtcctcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacaggtagggagggagggacaggacggcaggaggtacttttgggaacttgccctgcacccaccttgagtgcttgtagactaggtgagtcctattatcagagggagattgttggcgtgggggttaaggacaagttaggaacacaggctctctggtcaggcagacatgggttaaaattcctcctccccagcttattagccaggtgaccttggggaaattacctgacctctctgaatcacagacttctctttaaagagacagtaaaataaggctgggcttgctggctcacgcctgtaaccccagaactttgggaggccgaggtgggaggatcgcttgaggccaggagtttgagacccttctgggcaacataggcaatcctgtgtctacaaaaagctttttaaaaaatttattcaggcatggtggctcaggcctgtagtcctagctactcgggaggccgaggcaggaggatcccttgagtccaggagttcaaggttgcagtgagccatgattgcaccactgcactctagcctgggtgacagaaagagaccttgtctaagaaaaaaaaagagagagagagaaagagacagtaaagactgaacttcctctgcttcacttgactagcctttaaaaagacagagagagagaataacgatagtacctgcctctcatggtatctcaaggatcaaatgagttgagaaatgtagcacccagagcctggtacatattcatagtaagcactccataaatgcagctacggtcattagcatgattacaatctgctgaatttcactgagaggagagtgaaggaggagacccttgcacctaactggaaggatgaggaaggtgtttctttatgtcatcattaaaagggggagggggaaatacaacccctaaaaatatgttgaaaaaaatgtacagtcccagccaggtgcagtggctcacgcctgtaatcccaacactttgggaaacagaggcgggcagatcacgaggtcaggagatcgagaccatcctggccaacatggcgaaaccttatctctactaaaaatacaaaaattagccaggtgtggtggtacgcgcctgtagttccagctacttgggaggctgaggcagaagaatcgcttgaacccaggaggtggaggttgcagtgagccaagatcgcaccactgaactccagcctggcaacagagggagactccgtctcaaaaaaaaaaaaaaaaattatacagtccctaaaaagtgtgtgagactaagggtgccctttacagcatagggacaaagaccaatagagcaacagtcagatggagaaagtcttgcagagaaggagcttacctggggatgccccacttttcccctcaaggatttactgagaatatacctaagggaatagaaatcattttgttacaaagacacatatgtgtatgttcattgcagcactatttgcaatagcaaagacatggaatcagcctaaatgcccatcagtgatgactggataaagaaaatgttgtatatatacaccatggaatactatgcagccagtaaaaagaacgagatcatgtcctttgcaggaacatggatggagctggaggtcattatccttagcaaactaacacaagaacagaaaaccaaataccacgtgttctcacttaagtgggagataaatgatgaaaacacatggacacaaagaggggaacagcacacactggagcctacctgagggggtgggaggagggacaggatcagaaataactattgggtactaggcttaataccaggatgatgaaataatctgtacaacaaaccccatgacataagtttacttatgtaacaaacctgcacaggtacccctgaacttaaaatacaagtttttttttttttttaaaggcttatttcctaaaagaaaaccatgagatacctaaccgggcccctcagttggccagggctcttcctgaattccagcaggtggagactaccaggtcccccaggctctccccgaagagaggagagatttgtccacagacgctgagacccttgcctggctcctgcctgttctgggggcttgctgcaggcatcctttttctccctcacctgtgggctggcttgtgggccaccagggccccctgctccctcccaccctcatggaaacacacttttcatggttgtgcagctgttcgtttccaaaaggaccgcagctccatggaggctgaaagggtcccaggcaggccctgtcccttttggcctccctggtctgagtgagcactgccctctggaatcaggaaggtcaggctgtggaagaactagggctgacctgtcccattgtgagcccaaggtcactcaccagcaccgcgccctggctgcacctgaacagctgcccccaggcgcccagggccatgctgagaagctgttctgcagaaacgccctccacactaaacaccctcactcccctcgggctgcccatcccagctagttgggcccctctgggcatggctgtctggaggaagatcccgacaagtttctgtgagggctgaaaaaagaacctcagtctcatgactgctggcttcacttccgcaaacgaggtcgcccagttgtcggctcgaaccagagcaatgcgacatgaggcccgcgcagtccaagaggtctgtttgggcccagggcctcttgaggcaccgccagaccgtggagctcgaagcagactcctagttgtcttcagaaccccagacagaggaagtgaagggcctgttctctaaagaggaggtcccccggggcccactgtggttgggccagaggcagccgctctgtgtgggaagaggctcagacagagctctggaccctccattcgtgtacgtacagaatgaaccttctcctaaaggcgatgggtgggctcccacctcccaggccaagttcaagtcatttgttgaatgtctctgagtgaagggaaccccctcgctttcttttatgtgtttctgagagtctgggggaggagagaaggaaggacagaggctggagagaggggaccagggagagagggagaggggcagtgtggctaggcctgcctgtctccttacccctggtccccttccatggttttggcctattctgggaactgggcctctgcctagcccagggctcagccatcatgagacaggtgtctcagcccctgaaagtctgagagccagactcatcctgctcacctgcctgctgctgtgggcttagtccatccaaggtcagcagccctgcaggccttccagaccctccatggagcaaggccttttggccctggcaggtgtttgctgatggccacagtggggcagacactgcactagccagggccctgtggcaggaggctctccctccaggagggagtcagcgagggacacggggacgcagatggagatcaataacgtgggtgtcgtggcctggaccccatggggctgcggtgaaggccgggttgtgcgcacagtgtcctcaccaatggccttcctgctgttctctccagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggtgagtccccactcaagtccagctgggccttcatctgcagtgagcccagccagggcagggctggatggcttgggtttcgatcctagttatgggcctggtgaccagagggagatggggaggtctccagagaagagtgcttgtcatcttgcaccccagaggcctttgcaccattggcttcaagaaggccaggggcatgggccttaacaggaaaagtgctccacgggggtgggggagcactccgtctccaggcacggcccggcatagtgtgggcactcactggatatgtgctacattaattaataagttagtacctggtaatctccatgccttagtaaatataactttttgtttctttgtgagaaacgctccattgccccccaaagaaatcctaatgacagggctgaagccgcatttccaacttgaaggatccatctgaggctgccagggctgccctcctcctactctctcacttggcaaaatatgaagtagatgccgatgggacacatacgccaccgggttgctatgatacttggcgtgttcctatttccacctggacatacccattggttcttccctgggctctccagcctgaattctgtgcacgctccttgatttatttgtgctatttatcaaatagccgaatatccagtgttgctactatgttgattgtctctatatatgtgtctaaataacagatgctttgaaagtattccacataggccagacgcggtggctcattcctgtaatctcagcactttgggaggcccaggcgggcagatcacctgaatccaggagctcaagaccagactaaccaacatggcaaaaccccttctccactaaaaatacaaaaattagctgggcatggtggcgggcgcctataatcccagctattcgggaggctgagggaggagaatagcttgaacctgggaagcagaggttgcagtgaaccaaaattgcgccactgcactccagcctgggcaacaagagaaaaactgcgtctaaaaaaaaaaaaaattccacatcgagcccattgtttagttccccagggtttccatttcttcccaggtttggatgctgagtgcagtaaactggatggggaagagtcggggaggccccatggttccacctgctgacctctcctactaaggctcgtacacctcccgccaactccatctcctcctcatcagcccctccatcctggttatggggttctgcctcagtgggaccagcaggggcgtgaagccgagcttccaggcagctttccaggaggggttagggtcggggcatgggctgagggttcatgggcagagagccctgctttttctatctttgcttatcatgtcagtggaaccttcctaaaacttctgttcggagatgggaatgagtgaagggggcatgtgcagagaccaaggaaagcggcgacacagagccgccctccattctcagggtcaaggaaaactgggaatccacattgtgttttaaaatcagtctatttcgcttgtcaagctgctttgcacatagaggactgccttttgattatttttctttaaatgacaacttgcacagtctttcctgcaagttaatcagatctcatcagttaggtcttagtaggttaattatcacatttctaagtaaaattagccttctcaaataaacatagtttacatctttatgtcaacacttttctacaacaaacttttatttttgagacggagttttgctcttgttgcccaggctggagtgcaaaggcacgatctcagctcactgcaacctccccctcccgggttcaagtgattctcctgcttcagcctcccaagtagctgggattacagccatgcgccaccacaaccagctaattttgtatttttagtagagacggggtttctccatgttggttaggctagtctcgaactcccaacctgaggtgatctgcccgcctcgacctcccaaagtgctgggattataggcatgagccactgtgcccagcctaccacaaacattttaacaaatagaactgcctgtaatacagactcacggtatcaaagtcacaaggcaatagtaattagacctgttaagatacatattttaatacaggggtccccaacctgtggactattaggaactgggtggcagcaggaggtgagcggagggcaagcgagcattaccacctgagctctgcctcctgtcagatcagcggtggcattagattctcatgagtgtgaacccggttgtgaactgtgcacttgagggatctaggctgcacgcctcttaggagaatctaactaacgcctgatgatctgagatggagcagtttcctcccacaaccatccccccaccacccatccgtggaataattgtcttccacaaaaccggtcccttgtgccaaaaaggttggggaccactgtttttaatactatagaagagatgtttgtcccttttagtaaacagactcaggcagaaactggatttttatgatgtcaagacccagaataaatatagaagaacttaaatgtaaatgttctcttctcaatctaacaagtcaaatgggtaagccagtcctgttcagtattttttttgagatggagtctcgctctgtcacccaagctggaacacagtggcgcgatctcggctcactgcaacctctacctcctgggttcaagcaatcctcccgcctcagcctcctgagtagctgggactacaaacgcacgccaccacgcccagctaatttttgtatttttagtagagacagggtttcaccatgttggccaggctggccttgaactcctgacctcaggtgatctgcccacctctgcctcccaaagtgctgggattataggcgtgacccaccatgcctggcaattcctgtccaatcttaagagcaacggcttttcattctttcacagattccacaggaaaagccttgtggcctttagtttcaatttgattacatatcaagcctggaataaaaatctttaaggcggctgggcagggtggttcacacctgttatcccagcactttgggagcctgaggcagtggatcacctgaggtcagcctggccaacatggtaaaactccacctctactaaaaatacaaacattagctaggtctggtggcatgtgcctgtggtgtcagctacccaggaggctgaggcaggagaatcacttgaacttgggggttggaggttgcagtgagccgagatcttgccattgcactccagcccaggtgacagggtgagaccctgtctcaaaaaaataaataaataaataaataaatgaaggcttgtaataattttttccacacagctaattaacatggttaagcctcagttctctgatttgtaaaacaggaataattagtaataatatctgagtcataaaattgatttgtgggttaatggagaaaatgagcatgaagtgcttagcatagtgtctggtatgctgtgctcaggaaatacttgctgtaattacaatttccatcattatgggaacaaacactcaagcgttacccagaacaaaaggtgctggaagatagaatgcagacagctgatccgactttagggggcgcccctcgtgggactggcctgggctctctgcctgtgcctctgccaccagggttgatctgcacagtgaacaaatcctgccttcagccccattcactctgtacactgaaggggttggagcagattccacacggcaaagtcggccacttgcactacctcattccatatccccagccccatcgctaatcactcagactccccccacagagcctgagatgaatccagactctctgaacacagtgccctgggtagcctttggccgtgaaattgcaaagtgcatgggagctaaagccatttgttatctctagatcccatcatccttccagccctcagatcctatctttataagtagataaggtaggaaaacaattccacttacactttccaaagcttttggcctccttttgtgtgtgtgtgtgtgtgtgtgtgtgtgtgtgtgagagacagtgtctcactctgtcactcaggctggagtgcaatggcacgatctgttttcactgcaacctctgccttccgggttcaaatgattctcctgtctcagcctcccaagtagctgagattgcaggcacccaccaccacacccggctaatttttgtatttttagtagaggcggggtttccccccaggctgttcttgaactcctaacctcaggtgatccgcccacctgggcctcccaaagtgctgggattacagttgtgagccaccatgcccagccttggtctcctttttaaagtataaccatttcccagacccccagccaaaaccacttcctcccagcagcacccaaaggagctcattgagaggcaccttttcctgctgggccacttcttcttgctctgacctgctaatctaccccatcagtgagaccacgggaaccttcgtccaggtttgcaaacattcttctgaaggacggtgtccccttggaggctctgaggatgaggatttgttattgtggttgctgttcccattggtgatggtggctaaaagaaacaggcaagcatagtttgtttcttttttcttttctttaggcttccagaagagcatcttaaggccatccaagattatttaagcactcagctcgcccaggactctgaatttgtgaagacagggtccagcagtcttcctcacctgaagaaactgaccacactgctctgcaaggagctctatgggtaatggctggcccacgggggcgggcaggtgggggcggccaccaggtgagagaaacagctcatgagagcgacctctgcctctgcctggctgaacaaatgcctctgccgcactcacaataattgagtggtgagcacagcttggaaatctctgtggttgtttggaggtcttgttatcatggaatttgaacagtagcttgtgtgtgctgcagctttttacaactaaagttaattggaggccagttgctctgggaagcggatggggtgggaggacatggccagccctttctcacttgcacaggatccagctcttaagatttttgctgctgctcttgctgtttgctgcagccattacacctgacaagcacagaaaggcatcaaaaggaaataaattaaagttagtctattttctgcgtgggtggttatggcccaagatttccagtgatgtcaatttttcaaagggagatgattcaccaaaactttaattttctgatgtccgatccattgaatgaccaactggtaaaggttctgatttcttttagattcttttggttttacattttaaaatttaattgatgaaagttaatttcaagttaattacattttaattgttaaaagtgcaaaagtaaggctaatatgccatccaaagaattggcaaagaatattttaaatgccaaaagcttggaagagaaaaaaaacaaaaaaaattccagagcatctgaacaaagccacagggagccaaaacaatcccatcacaaatgaaaggtcaggccgggtgtggtggctcacgcctgtaataccaacactttgggaggccgaggcaggtggatcacctgaggtcagcagtttgagaccagcctggccaacatggtgaaatcctgtctctactaaaaaaaaaaaaaaaattagctggatgtggtggcacacacctgtgatcccagctactctggaggctgaggcaggagaatcacttgaacctgggaggctgaggttgtggtgagccgagatctcgccactgcactccagcctgggtaacagagcaagactccgtctcaaataaacaaacaaacaaaggaaagaaaggtcaacattttgattggaaaaatgggatttcatactggcaacggttttgtagtctgtgctgttttgtgttttattacacatacagccgtttcaagattcctttgttgatttttctggggctgtttcaatcttagcttagttaatatgcagaaaacactcttttatcatcagtaatcaaattcgactttccttttaaaggcttttaaaagcacgatcagtacattcggtaaatttaacaaataatttctttgacaaatcaagcactcaccaaattggccagttgggcttaatttcaatgaattggctttcaactaatgcagctgtagctaattggacctggagctatcatttttatagattcccatggagggattttgttccatttgatgctgttgttatgaatcactttatcactaggggaaaacacatacagcactttctttttataaaacaccatttcacaatggctgataacaagctcttagttctgcttcagtggagattctgttcttccctgcttccttgtggagaaagaaatgtattttaagtctctccacgaggcttccctcagtcttccccagacacttctgcacattgttagatttccctaacacctcaacactacctggacttcccaggagccaagtcacctcatcactatggcggtgccagcttccccaacttgtcttcttctcgggtatgtagtgccgatggagagagcttccttcagcttctagctgctccatgactctatttagaattaaagacaccgtcatgctctaaatttcccttgcacactcgtctttgctttcatcagtaaggcgacagccaggcttggagacttgatcagccttggcattttaggaaattgtagaaaggaacaaaatgatgcttcccatttctcctgccagaatccctgcagattctcatccctcaaattgtaaacccataattttcaaactgctttgattagaataggtcttcattcattcgttcatcgaacaaacatgtattggaggcctcctctgagccctgttctgggtgctgggatgtagcaacagacacaatgcacaagcctcttgctcttttaggcctttttggatctaacatctcagtgaggcacacaacagtagactaaggatccagatgaacaagaatttttttttttttttttttttgagacaggatctcgctctgtcacccaggctggagtgccgtggtgagatctcagctcactgcagcctcaacctcctgggctcaagtgagcctcccacctctcagcccctatccttgagtccccccactcacttgcttcccccgagtccaatggagaagctgggactacaggtatgtgccaccatacccagctaattgttatattttttgtagagatggggttttgccttgttgcccaggctggtctccaattcctaggctcaagcaatctgccttcctcggccccccaaagtgctgcaattacagcatgagccaccatgcccagttcaaacagtaattttagtaaatgtcatggtaagataaaacacgatgatgtgaggaagagacattgggtgggagagtgccagcttcctttggaggtgaaggaggtgacagaactggggtcttgccacacagtgatttggcagagggacattaagtacaaagtacaaaggtcctgaggcaggaatgaagacagcctgctcaaggaacaggaagtctgtgtggcaagtgagtgttaggaacagaggttggggagaggctggtgtaacatgtaaaagctggtcaacaagtaaaagcacaggctgcccagagaggtggaattttaggtgaacagcaacttctttagtataagtatataccatgtaatattgggatatactcatgctaatagattattcattgtttatctgaaattcaaatttcactgggtgtcctgtgttttacctggtcactgtaggcaggagccacatcacgcaaggcttaagaggccctatagagtttgtgcagggctgggccatgatctgattttcaagtggtggaggatgcatcctaggaggcactgcccaaagcaggagaccagctgggagtggctgtggttgtccaagtgagacaggatggcagtccatgaggaaggtggctagcaggggcaggggtctgtgtctgttttgcttcctgctgagtccccggttatacacaggctctggcacatgcggctcaacagatattaggtaaatgacccaatggctgggggcgtgcagatgctgagaactggtgtgacctgggacacgtgtgcatggcaaaggtgtcagatttgccgcttgattggatgtggggtgaagggaagatgaatctagggtgacccctgggttcccagtgtgaggggctgagtggatgctgatgccagttcctgggatagggaaagtcaaggaggaggaggaaggagagggtggtgggaggagagttctgggctacatttggcttgaggggccatgaggcatctgagtggagtcaccagccatggagctagtgctaagaagctaggatgtgggggatgcatttggggaatcatgggggatgcatatggggaatcactgaaagctgggggtaaggtcactgcaggtgagagtgtagacagaggagaatagagccaggctcaagatttagaggagggatggagaaggaggagctgggagggggttgagaatggcatcaatgatgtccaggtctatttgcttggacccaagtgtgaatgagaaggacattgagcactgaggagtaaggagaagtgccagagcctcctctgcagaaatgttgtgacgatgtccccgtgcgggtctggcgtgaagatctctttgcagtacaaagcatcaggcaagatttgcaaccccaggttaggctccctagagccagacagaaacttttccagagagagagaataaggaaccagagactggaaatatttggtaactcctgaaatggagacacggaaaggattgcaagtggaatttaaaataaaagatcaaaggtctgaatatcaatacaatatctattacatgagagcagggtaagatttttaataaacaaaccaaaaccaaaaatacttcattaccattataactgtttcattggaggccataaaataagcccatagttttccaatcaaatttcaaaaattaaatcacaaaacagagtagagtgtcagaaacatgtatatcaaaagcatgaaaagattaagcaaacctagatgaggaaatgtgtggtaaaaatggacagtccttggagacaaagctcagaggtgctacctgtagctggcaggatatgttcttgaagaagtaggaaaaaattgccaattaatgtatacaataaaaaaaaaaatttccaggcttacaaaagagctaaatctaagttttgagaagctccataatgatccaaataatacaacaatcaaacagcaacactgaaacatcttttttttttttttcttataaagagacagcatctcactctgtcactcaggctggaatgcagtagtgggatcatagcttatccatccttgaactcctaggctcaagtgatcctcctgcctttaactccggagtatctgtgattacaggcatgcaccaccatgcccagctaattaaacaattttttttttcttagagatggagtttcactatattgccctggctggtctcaaactcctgggcttaagccttggctccccagagctctggaattacagttgtgagccactgtgccaagcctaaatctcttacaatgtctctaaatgacaagaaaagataaattcaacaaacagattgttacaaacagtaccatagctttaaaattgtcgacatttaaaatgttaaatatttttaaatatttaatattttaatattttatatttaatatatttaatatttaaaaattcaaactccttgacagtataataaagattctgaagccatgtctccaagaaaaaggctactgacctggaaaagctaagcctagctcattcaagagcacaagtcatctttttcagaaagttcctaaaaatgtaccaatcaaatgccttactcaaaaggaatccaaaaattgtttttcagaaattttatagtcctggtgatcttaaaaacaagaagcctgcagcttactgagcagcaaaatatgaatatactcaaagcagaaagtgttcattctgtactcccataacacactgtgatgaaaatagaaataagtcacaaaactagccacaaccacccaattacctgtacattttaaaatcaccttctaaattacagctaattaagaaagaaactgacacaataatacatggggtaggtgtggaggcacagagtggagtaatcaaaccactgcatatcagaacactatgtgatgcagccaaagcaccacttagaggaaaaaccatagctttaaaagttctgctctattattaaaaagtaaatagaaggccgggcctagtggcttatgccagtaatcccaacactttgggaggccaaggtgggcagatcacttgaggtcaggagttcgagaccagcctggccaacatggtgaaattccatctacactaaaaatacaaaaaattagctgaatgtggtgttgcacacctgtaatcccagctactcaggaggctgaggtaggagaatcgcttgaacccaggagacggaggttgcagtgagccgagatggtgccactgtgctccaggctggatgacagagcgagaccgcgtttaaaaaaaaaaaggaaatagaataacaagtcaaatgtacaaactgagtccagattgtaaatctcttgaagacattatgggtcatgtcctaatccccttgatgtttccaggacccagcaaagtacatgaaatgttgatttattcgatattcatgaacaaagatccaatgtgtaccaactatctgcaaggcactgttccaggagctggaaatacagcagtgaataaaacagaatctttaagaaatctctgctgagcaactgagcaataacaacagccagaaaggagacgaggaggacaagatggtaaaaataaaaacagagatacatcaggaaaaactgtcaattaagaaagttttaaacatgagaaatgtcaaaggagaattaataatctgcattaaagatttggaagtcactaaagaatagtgtacagttatgtagctacagatcttcaagttataattaaatggaacacatagtttacgtaaaatataaaacattaaaagtaccatgagtgtcctttaaactttcaaggaaaaaatagtgagcataaggtatagattattcctgaatgacaaaaaagtcacctaattctctcttcaagaaaaatatgatttaaatccaaaaagctaatcaagataatagcctgaaataaaactctctatctctgatttcacttattaatataaatgcatattgtttcagtaacatcccagcaaatataatttagtgacatgaaaaatggaggctttatctaggtcactccaaagatgagtcaacaaaaagaaagcactgtaattttgcagtagattaaaagataaacggaaaccatttacatagataacattttaaattcatctctaatttttaaaaatcatttttaaaaaaaaggaatagaaggatacttccttaataatgcaatatgaatcaaagtaaaactaattacaatcgatagggaaacattaaaatcattccattaaacttttttttttttttttatgagatggtggcgtctccctctgttccccaggctgggtgcagtggcaggatcttggctcactgcaacttctgcctcctgggttcaagctattctcctgcctcagcctcctgagttgctggcattacaggtgcccaccactatgcccggctaatttttgtatttttagtagagatgaggtttcaccatgttggccaggttggtcttgaactcctgacctcaggtgacacccaccttggcctcccagagtgctgagattacaggtgtgagccaccacacctggccccattaaacattttaacaaaagaaaaagagatactgcccttgcactccagcctgggcaacaagagcgaaactccatcacaaaaaaaaaaaaaaaaaaaaaatatatatatatatatatatatatatatatatatatatatatatacacacacacacacacatacacataatatgttagtatttattattatgatataatgatattatattataatataatgagattatattgtattaataatgtaatgagattatattatattaataatgtaatgagaaaaaaatacagcacctagattaaataaaaagcaaagtaggccgggcctggtggctcacgcctctaatcccagcactttgggaagctgaggtgggcggatcacctgaggtcaggagtttgagaccagcctgcaacatggcgaagccccgtctctactaaaaatacaaaaattagctgggcgtggtggtgtatgcctgtaatcccagctactcaggaggctgaggcaggatcacgccactgcactccagcctgggccacagagtaagattgtctaaaaaaaaaaaaaaaaaaaaagcaaagcaatatgtaaagtttataacactatataaaaatatgaacaaaattcccaacagaaaattggcaagggagaaaaaacaaaaaagtttatacaaagagaaatgagagaaatgcagtagccattaactagaaatcagcaatagaaaaacaatgacattagaaattaaagatatgcaaatttattcatccgtattgaagtgcaatgttatgtcccttaaaagagagagaaagaacagaagtacagtcattggagctattgggtaatcaggtctggacaatataatcagtactcacaggtttggcaataatgatcaagagccgtaatctctggttatcctaattctgtaattaaaaattagaaaagctatatgaacaaagttgttcagagcaggttttatttattttatttttatttttatttttatttttatttttgagacaagagtctcgctctgtcgcccaggctggagtgcagtggtgcgatctcggctcactgcaagctctgtctcccgggttcacaccactctcctgcctcagtcttccgagtagctggaactacaggagcccgccaccacacctggctaattttttttttttttgtatttttagtagagacgggggtttcaccacgttagccaggatggtctcgacctcctgacctcgtgatccgcctgcctcagcctcctaaagtgctgggattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatcatcgtgaacctcattcattgttctctgccatgcagctcgtgtgaggcagtaaaaatggattgtaccagcctgaacagcctagtcagaccccatgtctacaaaacaaaaaaattaggccaggcacagtgggtgccttatgcccataatcccagcactttgggaggctgaggcgggacggttgcccgagaccaagagttcgagactagcctgtgcaagatggtgagacctcatctctacgaaaaaaaaaatagctgggtgtggtggcatgagcctgtagtttcagctacttgggaggctgaagtgggaggatcgcttgaacccaggagtttgaggctgcagtgagctatgatcacaccactgcactccagcctagatgacagagcaagatcctgtctcaaaaaaaaaaaaaaaaaaaaaaagattgcagcgcaataagggtgtccatcacatcaggtgctggctgacatctcacatcagggacccccagcaaggccaagggacaagcgcttctggtgcaggcccacagtgatagcttcccactgagtgcccagtctccgctcctactttcacctccaaagcatcaggggtgggctggtgggaggtctaaggtgtccagagctgtcaggaataatagggaagggtctgggagaaacaagagaatggggcccagacaggtggtgggagatggagagaaagaccgctgggctggaatgctttctgagcacctgggcataggttcaaacaccagctctgccccattgctgcgacctcaaaaggactgaggcacagggataaatggaggccatgaatcttgagccactcccaactcgaggcaggttatagtaaagatggtcattatgacatctttgtgagctggtgtcttcagggaggacttactgagatttgcaattataaggttgaatcatgtaaaatttctgtctttgcaggttgaaacagtcaaacactggtcatgtcatatgttacaccctgaaatttgtgtactttgttaaagtccgcctgctctattgattgcatcctaagagagggccaactgaggctgcttggtgccccactgggtaccccagaaaaatacgtgaaaaatattgagtaggctatgaaagccttcatgtcctctcttctttttaattagtttctttaatttaaatgttctttcattacataagtaatctattctccttggtgaagacgtggcaaacacaaacaagcaaatgtttaaaataaaaacactcgtataccatgagttaatctgggactatgccccttccagatgttttttaattttctctttctttcttccttcccttctttctttctttttctgtttcttttcttttctgagacagggtcttgttcagttgccccggctgaagtgcagtggcaagatcatggctcactgcaacctcaactttctggcctcaagtaatcctcccacctcaacctcctaagttgggagggactacaggcatgcaccaccatgcctggctaatttttttattttttgtagaggcagggttcccctatgttgcccaggctggtctcaaactcctgggatcaaacaatccttctgcctcagcctcccaaagtcctgggattacaggcatgagccactgtgccaggcccaaatgttttattaaaaatgcaatgatgctattcatatcatttgtcaactagcttttcatgcttaaaaatatatattgtggccacctgtccttgttggcaagatagttctggatcacacttgttaaacactgtgatattctagtttatggatggtctagaatactttttttttttgagacagactctagctctgttacccaggctggagtgcaatgatgcgatcctggctcactgcaacctccacctcctgggttcaagcaattcttctgcctcagcctcccgagtagctggcattacaggcaagcaccaccacgcttggctaattttgtatttttagtagagacaggagtttcaccatgttggtcaggctggtctcgaactcctgacctcaggtgatccacccacctcggcctcccaaagtgctgggattacaggcatgagccaccacacctggccctctgatacattattaatgaatctcctaaggctggacagtaaggttgcttctgatttttttctgtgctgaggcctgtgctgcagagccgtgacagggttggacttctgcgcagctcctgatcactttgttaaactcgcacctttgcaggggaatgtctaggccagaagccactcgcttatgactttggacacatgcttccaggttgctgtcctggaagttcacactgatttacgctcctctcagttttcttgaagctgaccaagtcctttgcaaagtgtaatgtgcagggaggcagaggcctttctaagtctgtctgcccttccatccctagaagagagaaggcttctgccagctcctgcagcagatgaagaacaagcactcagagcagccggagcccgacatgatcaccatcttcatcggcacctggaacatgggtgggtccgcgcgccccctccctgcagtcaccccctctgcttctgctttcctgactcaggcatcctcaaggtggggtggagtgacgacatccatgtccccttccttcctgccccagggccctgcccctaagccccagcccacccgcacaacctccttcctgaggaattccacccttttcctgagatgatgggtaagaaaaacgagctttgggactatcgtaccccaagagcagctggcgtgggttactctgtatgtctaaattggaaagttttagggaaagagtctgaatatctaggtgaaggggctcatgggaaccctgccagccctaggcagctcaccaaggggccccaggcctgagagaaagaagtccaccctgagtagggttgccagatttatcaggagagagacagagaggtaggtacgtagacaaaggatgcccagttaaattttaacttcatagaaacaattttttttagtatatgtttagctacaaacaaataaatactaaatatatatgctcatagacattatgctgaatatatagtatatatacatatgctaaatatatacagtatatatacatatgctaaataagtgtaattattatattaaatatgaattatactaagtaatattagtttaagcatacagctaataatatactaaatatatgctaaatatattttatattaaacatatatattgtatatttatatactaaacacatgcactctactaaatataaataatactaaataattttttagtgtaagtgttcaggtagaaatagattagatcgaagacatccagataaacttattctaaaaactaccagtttatctgaaattggaatttcactgggtgtcgtgtgtcccctacccttgtcctgagaggagtctgggaggaagagggtgagcagtggctggcaggggcctcctggaagtgaagtgacagcttgtcactcgtgtcccagggccacagcagccgtggagtagagcccgggccagtgccccagggggtcacttgtccccttcggtccctttcagtgtttctaataagagacaatagtctgcctgatctcctccctctggacatggtcagggatgtccatgacacaagggcaggggtgcccttcccacagaagagtatggaaggagccagctgaggccatgccgcaggagggccggggacccaccagcccgggggttcgggcacccactttgagcctcttgggggagcagaatttagccacagtccatttactccaatgcttggcttctttgcacttgtaaggcaagaagctcatctctttgaggaacaaagtttgctcatccttcaagggcattgtagggagaaccgttcaaaatttcttgattgagcttcttcaactcagttttgaaatgggaatgcggaggagtttccacactctcccgtttctctggctcacacccaggcatccctccgctctgggctgggatctgtcttgcaagggagactttgttgtctcccaacaatgggttagaacccgccatctaaaacttgtcagttcccttggctgtcttgagaataggatgtgagttccttgagggacaggactgtgtctcaattatcgtagcctcaaagtgcaggacagtgtctgacatcagggaatcttctggtgtttctataccttgaaacttgacattacgtttaaaaagaggcttaactgagctctagccctaaccgacatcctgggtgaggttggcgcccaggcctccattgcaggcatttctttgggctgcctggatggtcttgtgtaatgacgtgacctccctcacactcccgccctctgttttgaattctcctaatgctttgactcgatgtgcctttgactcacttggtgttgggttttgctgttgaaggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtgagcagctggctgcacgctgggtgggcttccgggatagaatctttgctcggctgggctgtctcagaggcaagggcgggctcagcctatcagctctcagttttcaaggatgtctggaggcccccactgagagatgcgtctgtattcagaaataaatgggatctgtggggtattgctgaaaaccactgagtcctctatcttcccacccttggtcagccccggttctcatctttaggatgttttgtctcgcctatcaagcatcgctgggagtcccccgaagggttgggattacagacaggataccccatacccaggggctgcggctggggctgggtgtgaatcactgtgccctggttcacaccctacacttgggccgagtattgcaacgttgtcctcccaccaggtcgccatccacacgctctggaacatccgcatcgtggtgctggccaagcctgagcacgagaaccggatcagccacatctgtactgacaacgtgaagacaggcattgcaaacacactgggtgagcagggcggggaccctgtgttcctcccacaccctctgcctcaactctcgcgaccacatcatcctgatcccaccagtagttccccgggttaaaaacagagagcctcacatcctcagatcctggctcagtcctcagcaaataggggtgattggtctccctggctgaaactcactcagggtctacaccagcagtcccagggatctagctaaaatgcaggttccgacccagtagatcttgggtggagctcagggttccaagtttctgacaggttcccaggcgacttgagcgctgctggtcggcccgtgggacccattttaagaagcaagaacctagaagaggcattggccaacttttgcaggaaagggaagggcctgacagtaaatatttcaggctttgcaggccactcaacactattcctctctgcctttctggtgggaaagcagccataggcaacccagaaagcgaatgggagtgactgtgttaccagtgagaccttccttacaagcacaggcgggaggtggctggcccctgccctcggtccctgtgcaccaggttggatctggaaacgctggtgtcagtggagagttgctggcttcagagagcagtaacaagggcaagaagtcttcataagtgtaggagtgcaagcctgtgtgtttgtgtaggatgtgtgtgtgagtaggtctgtgtatgtgagtttgtgtgagtgacagcgtgcatgtgagtgtgtgagcctgtgtaggtgtgtgagagtttatggatgtgtgtttgtgagcatgtttatgtgagtcaatgtgtgagcgtaccaccccatatctatgagtgtgtgtctatatgtgtgtgaatctatgcatgtgtttgagtgtgtctatgtgagtctatgtatgtgagtccgtgtatgagtgtaccacccatatctatgtgtgtgagtgtctgtatgtgtgagtccatgcatgtgtgtttgtgtgtgtttatgtgagtctacatatgtgagtccgtgtgtgagtgtaccaccccgtatctatgagtgtgtgtgtgtccatgcatgtgtttgtgagtgtatttatgtgagtctatgtatgtgagtccgtgtgtgtgtaccactccatatctatgagtgtgtgagtgtctatgtgtgtgtgtccatgcatgtgtgtttgtgagtgtgtgtttatgtgcatctgtgtgtgagtgtaccaccccgtatctatgagtgtgtgagagtccatgtatgtgtttgtgagtgtgtttatgtgagtctatgtatgtgagtccatgtatgagtgtaccaccccatatctatgagtgtgtgagtatctgtgagtccatgtgtctgtgtttgtgagtgtgtgtttatgagagtctaggtatgtgagggtgggtgtccgagtgcatgtgcataagtgctagagcctctctgtgtgtttgtgtgtgtgtgtgtgtgcccgtgtgtgcacgtggggtggtatacacacagggctccagggctggcatcaggggcgaggccagtggtttttggtggttggagtcagtggagtcaggaacaggacagagtcccagagataacaggaaatagaagaattgctgcaatcgaacgtgcaaagctctctcaacttttctgctgacaaaccgcaaactgcccgcgtccacccccactcgtcccccttccttcctgccacagtagaagggtggggctggcgtggctatcctggctgcgcccacgccctcctgctgcccagcaaccaccccgggtgtggattccatcgctccctgggcttccagtccctcccaccagcccctgccccgctgtgcagaatatgctcggacctcctagggccacataaaaccaccccctcagccagaccagttcctggtcatcctggcctcagggctgggcactgggtcagcttctgagcaggcaggagctctgctcatgtggacctgacacacattgcatgagcagacgggaggaaaagaagccagttcctgggagggagtgcactggcgaaggagtgtgtggcgtgggcagagagcagaggtcaggggcctccctgagaagggcagtgcgactggcatctgaggggtgaggagaaaggcctggccagagtcccagctttatgaccattgcagggcagcttctgggctgtgcagctcacacacaccttcccctccttcccctccttcccctcctttctgccctggggccagcctccctcctccactcccctgaaatggctcccagccataattagcacaggacagaaacagcaaatgctggtcggtgtggtaggctcacgcctgtaatcccagcactttggaaggccgaggccggtggatcacttgaggtcaggagttcgagaccagcctggccaacatggtgaaatcccatcccactaaaaatacaaaaattagttggatgtggtggtgcgcacctgtaatcccagctgcttgggaggctgaggcaggagaatcgcttgaacccgagaggtggaggttgcagtgagctgagatcatgccactgcactccagcctgggtgacagagcgagactctatctcaaaaaaaaaaaaaagtccttagaacaaccaaggcctttctaagagtgtgccctaagcaaggatgtgtgctgaatgctttgaatcatctcatttgatataaacaccctgctaggcacgatggctcatgcctataatcccacactttgggaggccaaggtgggaggacctcctgagaccgggagtttgagaccagcctgggcaacataggaaggtaccatttctacaaaaaaaaaaaaaaaaaaatggcatagtagtgcatgcctgtgggcccagctactcaggaggctgaggtgggaggatcacttaaatctgggaggtcaaggctacagaaagccatgattttgccactgcactccagcctgggcgacacagactttgtctcaaattagaaaaaaaaatacaaacactcgggcagggactcttattattcccatttgcagatgaagaaacagagtctatggagatgatccataacttgcccaaggccccgggataagaatgtggtgggcagggattgaaaccaggctgtcgggactggaaccagttgctcagttccaggtcaccctcccaggttgcgggcagaggggcagggctggagagctaggtgcagtggagagggctggagggcagaaagcctgtgtactcccccactgggtcctgacaaggttgagccaggtgatatccaggggtcccttcagcctatggcctatccagagctgtccaaccaaaagaaaatggggccgggtgccgtggctcacgcctgtaatcctagcactttgggaggctgaggcaggcagattgccggagctcagtagtttgagaccaacctgggcaacacggtgaaacctcgtctctactaaaatacaaaaaattagctgggtgtggtggtgggtgcctgtagtcccagctactcctgaggcagagacaggagaattgcttgaacctgggagacggaggttgcagtaagcagagatcgcgccactgcactccagcctgggagacagagtgagactctgtctccaaaaaaaaaaaaaaaaaaagaaagaaaggaagaaaagaaaatgggagccaaatagatcataaataaatagatttatgatcaaaatagattacaatttgatttattacaatcaatagatcaaattttctagtagccacattaaaaagaaaacaagtgaaattaatttcaataatagattttattgaatttcatacatccaaaatacaattatttcaatagatatttaatgtaaaaggttattagatattttacagtctgtgtttcttaccaaggccacaattccaatgtgtattttacactcacaacctgtctcattttgtaccagccacatttcaggtgtttgatagtcacatgtggcctgtgcctgtattggacagagcaggttctcacctgcatgtgtcagaatcacctagagcaggggttaacaagcgttttccatagaaggccagatggtgaatattctaggctctttgggccacacaactgtcacaatgcttcagctctgccatcgtagtctgaaagcagctacagacaatccagaagtcaataggcatggctgtgttccaataacgtgttctttacgaccactgaaatttgaatttcgtattttcatgaatgacaaaagattgtttttcttttgatttgtttccaaccatttacaaatgtaaaaccatttgtagctggcagtgagccagcatttgcccacccctgacactggagggcttgtcaaacacagattactgggccccatcccaggatttcagattcagtaggtctggggtggggctgagaatctgcccttccatgaagttcccaggtgatgtgcagctgctggtccagggaactccctttgggaaccactgacctagaatagatcagaacgttggcagaaaaaggtatgatctcagtgtgggtttttggtctccccaggaaacttgagttcactgggagggagatcagcccacccaggctggaaccttctgaatcttcccagggcttctggctgcccgcttagcaccctggtcactttagagagagatgccgggggaggatcgcagcagccaccttcctctgccccgccgagaaggctgaggctgccgccatctgcactgctcctgcattttctcatctcccgctctctgcccagcggctcccaccctgcacgaccctgtttcgcccatcccttgccagctcctcactcactgcccctctcaccctgccttcgggtgatttctggccccttggcaagtgtgtctgtttgatattttgattcttctttctgctcttctttttagggaacaagggagccgtgggggtgtcgttcatgttcaatggaacctccttagggttcgtcaacagccacttgacttcaggaagtgaaaagaaactcaggtaatggaatccttccccccaagagtgtgcatttgggctgtctgcccagacacgcctcacacctttaagcaccagaaggacctgctcagctcctgcctttgaccttgtggatgtcctgtggcctttcagggcccaccacagtctcatcaaaggcaactgcagcaccatagtgacctcacgtgtggaggaattttgtctgaaggtcagaaaagatatttccttgtgtcattagcctgatggaccgctaactagcactgtttctaaagcagaaagcctcctctggggcctccttacaaatccaagctgatcttgcctagctggggcccaggaatgaagacagccatctagaatcttcactgttctgattctctgctgagcagatgctgctgctcctggtcccctgccctctgtacacccaatgtggcctcaaatgccctttgcatcctggctgtgccatatttgcacactaaggagttctgctgcagcagggctggagggctaagtctcacttccccccacctgctatgctcctcaccccacacctatggcaggagtgacttcctgccacagtggagggggaaccagtgaccccgtgctagatggccgctttttccttgcattaggcgaaaccaaaactatatgaacattctccggttcctggccctgggcgacaagaagctgagtccctttaacatcactcaccgcttcacgcacctcttctggtttggggatcttaactaccgtgtggatctgcctacctgggtaagggctgcccgcctggggctggggctggggctgtatgagatggaggctcccttgagtcagcttggggcaggtggtcgtggagacatgtgaatcaagtgggctgaggcggctgctccccttgggggctcaacgctgtttccattactgagcctcagccgctcctcacggttcccctgtgctcacacccggttcccataactgtcacagccaccctgccaccatcactctgcagcccgggtcatccagctgcccgcccccagccccgaagcttgtcaggcctggatcagcagggcttctcaccagaggcccgggcatgttcttgttccaggaggcagaaaccatcatccagaaaatcaagcagcagcagtacgcagacctcctgtcccacgaccagctgctcacagagaggagggagcagaaggtcttcctacacttcggtaagagcagcaaccccggctgggagcggtggctcacacctgtaatcccagcactttaggaggccgaggcgggcggatcacgagatcaggagatggagaccatcctggctaacacagtgaaaccccgtctctacttaaaaaaatacaaaaaattagccgggtgtggtggcgggtgcctgtagtcccagctacttgggaggctgaggcaggaggatggtgtgaaccagggaggcagagcttgcagtgagccaagatcgcgccactgcactccagcctggccaacaaagacagactccgtctcaaaaaaaaaaaaaaaaaagcagcagcctctcctcttggagcctttccagccatcctttcgtcccctttcccctgatttcctaccagaagaatagggaaaattggccagatgcaaaacctggggaatcagaattaaaacgaaagtctctctgtttcagaggaggaagaaatcacgtttgccccaacctaccgttttgagagactgactcgggacaaatacgcctacaccaagcagaaagcgacaggggtgagtcctcttcatagacaccttccctgccctccatctcctccccgctggtgtctgttcccaaaaggtgaacagaaagtgtcttcatccattaggcaaaaaaaaaaggaaagaaaaaaattagaaagcacatgttgatttgtgttacagagtaaatgggaagccacacttgtgcactgctttgagctgggaaaataacccttgtgatttaccttctgtccagatactctaagatgctgagaggattttaaagtattatttccttaactgggttctgaagatcatttttttaaagtcccgtgatcaaatatatttactaaactgctgagtgaattaacattaagcaggtttcttcgctgcaggacttatcagagcttttatgggcccaagagcactgtggttctccatgaggaaatctgtatgccaaactcagttattcatggaacaccaattaatgtcttatgaggccacttgttttccaaggaacagtgttttggggaaagatgcaataaaatatgtattcatttgttcaaagatatttcctgatggcctattatgggttaggcactctcctaggtgatgggagagcaaagatgtcttttccagggacttcacagtaggaaaaacagatatgcaactagctgtagccagagccagaatgtgacaatgccagggcagggaaggatcagggaagccagcccctggcaggattcaagggtcaaatggctgggacggtgaggtacccaggcccactggaagcctagggcaatggagcgcaagttcaaagtgtcatctgaaagagttctgggccccatctgggctcaggagaaagtgaagaactggacgtgggagaggaaggccaagcgctgggtggattttagaacagagcaggagaggaagagaatacaactgagaggacaggaggagatcccggactgctgtcacccacgaggctgggacccccaggatgggacaccccattccgcagggtccactgcctgctgtgtggataaggtcacctggcccaaaggcactgtcagagcaggtccttggggatccctgtgcaggctggtgaaggatggtttgctttgatgtgagtttaagttgaggcagaggagggcctgagatgggagagtggccagtcctagatgccaggatgacaggccacagggggccactgcaagctctgccgggcactggtgcatcagagtggcatgtgcagaattgtggtgggcattgtggtaaaggatgaggacgcggcaggggcatcggtgaggaggccgttgtgcacattcagctgagcaacagctagggccgaatcagggaaaaaacagtgaaaatgaaagaaagggggaaatcaggatatattgcgagacctgattgccattgataaaaactggaaaatcacaaggcggagctggcttgaaggggaaaaaatagaacttgttttcagacttattgattgtgtgacatcagtggaagaacccagagaaaatacccagaaggcagctgaaaatagcgatgcgtcgcttaacaacggggatatgttccgagaagcgtgtcattaggtgacttcgtcattgtgggaacctcatgaagtgtgtatacacaaagcccacttcagttagatggtgtggcctattgatcctaggctacaaacccgtatagcatgttactttactgaatactgtgggcaactgtaacacaataagtttttgtgtatctaaacattaaaaaggtacagtaaaaatatggtataaaaagaaaaaaatgggctgggggcagcggctcatgcctataatcccagcactttgggaggccgaggtgggtggatcacttgaggttaggagttcaaggccagcctggccaacacggtgaaaccttgtctctactaaaaatacaaaaattagccatgcatggcggtacacgcctgtaaccccagctactcgggaggctgaggcaagagaatcgcttgaacccgggagatggaagttgcagtgagccgagatcgcgccattgcatgccagcctgggtgacagagcaagactgtgtctcaaaaaaaaaaaaaaaaaagaaggtggtacacctgtatagggcacttaccatgaatgaagcttgcaggcttggaagttgctctgggtgagtcagtgagtgagtggtgaatgagtgcgaaggcctaggacattactatgcactgctgtagaccttacaaacactgtacacttaggctaccctacatttattttttaaattttctttttccaataataaactaaccttagcttactgtaattttttatttataagctttttatttataaacaatttaatttttgacgcttttgtaataaaatgtagcttaaaatacaaacacattgtacagctgtacagaaatattttatttctttatattcttaatctataagctttttttcaagttttaaaatttcaaaactctcatttacattgacttttttgttgaaaattaagacgtaggctgggcaccgtggcttatgcctgtaatcccagcattttgggagaccgaggtgggtgagtcacctgaggtcaagaggtcgagaccaggctggccaacatggcaaaactcttgtctctactaaaaatacaaaaattagctaggcgtagtggtgtgcacctgtaatcccagctacttgggagactgagacaggagaatcgcttgaaacctggaagcagaggttgcagcgaaccgagatggcgccactgcactcctgcctggagcaaggctccgtctcaaaaacaaaaacaaaaacaaaaaccataaatgcacacattagcctaggctgaaacaggctcaggatggtcaatgacattatcacccacctccacatctcatcccatggaaggtcctcggggcaataacatggagctgtcgtctcctatgatgacaatgtcttcttctggttacctcctgaaggacctgcctgaggctattttatagttaacattttcttataagtaggaatacactctaatgataaataatatcgtaaacacggaaatgagtgacagttgtttatcattatcaaatattatgtactgaacagaattgtactgttatgcttttacacagctggcagtgcagtgggctggtttgcaccagcatccccagaagcatgtgagtaatgtgttgcgctgtgacgtgatgacagctacagcagcactacgtgatggggattttccagctccattataattttgtaggacctctgtcctatatgcagtccattactgtggtacatgactatttgtggagccccacgggtaattctcagaggcagctgatgccgagaactgcaatgttaagaagtaactgtttaggctgggcacagtggctcatgcctgtattcccaacactttgggagctgaggcaggtaaatcatttgaggccaggagtttgagaccagcctggccaacatggtgaaaccccatctctactgaaaatacaaaaattagccaggtgtggtggcgcactcctgtgatcccagctactcagaaggctgagtcaggagaattgtttgaatccggcagacagaggttgcagtgagctgagattgccccactgcactccagcctgggcaacagagtgagaccctgtctcaaaaaaaaaaaaaaaaaaggacttaactaactgttaggcagaatcaatgaaaactaaaaatgcacctattctatgattcagtaattccgctttggtgtgtgttcaagagaaatttgtatatttgttcaccaaaaataggtataagaatgtttagccgggcatggtggctcacgcctataatcccagagctttgggaggccaaagcaggtgaatcacctgaagtcaggagttcgagaccagtctggccaacaccgcgaaacccgtctctatacaaaattagccgggcatgctgatgggcgcctgtaatcccagctactcgggaggctgaggcaggagaatcactggaacctgggaggtggagatggtggtgagccgagaccatgccactgcactccaacctcagcaacagggcgagactccatctcaaaaaaaaaaaaaaaaaaaaaaaaaatgaatgtttatggcagccttgtttgtaatcttcaaaactgaaaacaaccctatgtccattaacagtagagtagataaatgtgatacttataaacaatggaacttttataagcaacgaagtggctgaaggagtccaacataaaagagtatctactgagtgagtccatttatatacgttcatataaattaatcaatggagatgttagtcacactaatgctcacctttaggaggctctggtattgacaaggaaggcttatgagggaagctttaggatgatggcggttttctgtatcttgctctgggtagtgggtaagtgggtttatacaaacctaaaaatgcatgggactgtacacttatggttagtacactttatgtaagttgtacctaaagttttttttaaaaagtgaatggttcagaagtagagagaatgaaaataaaaacttttgtttttttttttttgagatggagttttgctcttattgcccaggctggagtgcagtggcgcaatctcagcacaccacaacctccaccttctgggttcaagcgattctcctgcctcagcctcctgagtagctgggattacaggcatgcgccaccatgcccgggtaattttgtatttttagcagagatggggtttcgccatgttggtcagggtggtctcgaactcccgacctcaggtgatccacccgccttggcctcccaaagtgctgggattacaggcatgagccaccatgcccagcctgaaaatagaacattcttgaaagaaaattggtaaaaggaagaaaagagaaaagtaattgaaggagatgacagagataagctctttcaggatgagttcctttatgtttgtagacagagaagaaagagctagaacatgaggggataaggatattgataaaagagggttgttattgccagtttaccttgtctatcccacctaatggacatcttgctcatcattgcagcctgaggccctggagagggcttgtcatatagtattaatagatactgtttgagtgattggataagtaggtagacgggtgtgtgaatggtcaatggatgagtggatgggtgcgatggatggatggatggatggatggatggatggatggatggatggatgaataggcgaatggataggtgggtgggtgggtggatggatggatggatagatagatggatgtgtgggtgggtgaatggatggatggatggatgggtggataggtggatggatgggtggataggtgggtgaatgggtgaatagatggatggagggacggatggatgaatgggtatgtgggtgggcggatgggtgaatgggtaggtgggtgggcggatggatggatggatgagtagatggatggatgaacaggagaatgggtggatggatggatggatggatgaatggatgaacagatggttggatggatgaataggcgaatggataggtgggtgggtggatggatggatagatggatggatgtgtgggtgggtgaatggatggatggatgggtggataggtggatgaatggatgaatagatggaaggatggatagatggatggataggtgaatgggtaggtgggtgggcagatggatggatggatggatggacggatggatggatggatgagtagatgaatggatgaataggagaatgggtagatgggtgggtggatggatggatgtgtgggtgggtggagggaaggatggatggatggataaatggatggataggtggatgggtggatggagggatggatggatggataggtaaatgggtaggtgggtgggcggagggatggatggatggatggatggatggatggatggataggtgaaggttagatgggtgggcggagggatggatggatggatggataggtggatgaatggatgaatagatggatggatgaataggcaaatgggtgggtaggtgggtggatggatggatggatggatggatggatgtgtgggtgggtggagggatggataaatggatggatggatgtgtgggtgggtggagggatggataaatggatggataggtggatgggtggatggatggatggctaggtcggtgggtggatggatgggtgggtgggtggatggatgagtggatgaataggtggatgggtggatggatgaatggacaggtagttggatggatgggtggatggatagatgaatgaataggtagataagtggatgggtggatggatgaatgaataggtgggtaggtggatggatggatgggtgcatgagtaaagatgggtagatggggagatgaaaaggtggacagatggatgaatagaactgggggtggaagctgaagtgtgttattaaagtaagtgactgcagaaagtgagcagagactgagctgaaaatacaggtgggggttcatctgagtcagaaagaaagtaagagaaggtgaagatacaagggatactgaagtagtcaggaggatatgtgagggaatacagcaaggtgagttatcttagtctaaagaagaaggcgtggcagtggagtctggacttgagccatgtgaaaaaagtttaaagccacctacagggaaattctataaaaagccaacagccgatgaatttgaggattacagaggccaccagttaatctgttcttttactgattaaaaaaataataataagaggcattttttaaagcctatgactttgatttgcagatgaagtacaacttgccttcctggtgtgaccgagtcctctggaagtcttatcccctggtgcacgtggtgtgtcagtcttatggtgagttcaaacactggggaaagcagaacaggatcagagaatggcaccaagctgggaggtgtgactgccctaaaatctaagggcttcagtctgttgatgtgtcaaagggaggaattcactgtaaccctaatcaggcgacctggaaatgttgatgcttccctgcctgtcttgtgctgccacctaatccatatcccctgctttaggagacatttgaattatagagcactttttttctttttctttttgagacggagtctcactctgtcacccaggctggagtacaatggcatgatctcatctcaccacaacttctacctcctgggttcaagcgattctcgtgccacagcctccccaagcagctgggattacaggctcctgccaccatgcctggctaatttttgtatttttagtagagacggggtttcaccatgttggccaggctggttgcaaactcctgacctcaggtggtcagcccacctcggcctcccaaagtgctgagattacaggcatgagccaccgcggccgacccggagcacttttttaaaaattcagttttatttcttttgaaaagaacatattaagtgtgaaccatatgaaagtgtttttgtaggtcagaaatagttattggaaattcatatggctcaaactaatacatgtcgcaagtgtgtacacatatatacacatatatatttggggaggtttaaccataaattgagttaaattgatttttagaaggcataacatgtaatattaaaataaataattatggaataagttatcaaaacaattaagaaataactgttagccaggcactgtgccacgtacctatagtctcagctgctcaataggctgaggggggaggatcgcttgagcccagtagttcaaaaccagcctgggcaacgtagactccatctctgaaaaaaatgaaagaaagaaatgactgttaactcttgaccctcaaagttgaaggtgcactgaaggagttcttaattgcctgaatgcttattctgaaaagctactgattagttcccattacttacgaagtgagaccttaaaaatccacagaacagagttgctttgaacacttcactgactgagaattgtggtattttattatttatttatttatttatttatttatttatttatttattgagacggagtctctctcagtcgcccaggctggagtacagtggcaaaatctcggctccctgcaacctccgcctgccaggttcaagtgactctcctgcctcagactcccgagtagctgggatatcaggcacgcagcaccacgcctggctaattttttgtatttttagtagagatggggttacaccatgttggtcaggctggtctcgaactcctgacttcaggtgatccacccgcctcagcctccccaggtgctgggattacaggcctgagtcactgcgccaggcccagtggtattatttttaaaacactgcgaattcccacacaatggcctctaaaggatggccaccccagtccttggagcaaggagaggggtgggggaatgctgcccgctggccacctttgtggctcccactctgtctctggggactggcaaatttggtctcacttatttaactctggtcctatactttgaactgacttccattccagtgcctgtctcctcctactgcccagaagagcccagagcagctaccctgaaatagtttaacacacgcaccctgcattccttgctgaaggactgagctctgtctcccagaagtgacgtcactagacgaacttcacacaacacctttagatgtgtgggaaggcaacctgccctcatagccacggccagggcattgttccagcttccaaagctcaaagtgcctgagtcctaccctctgcctgcagcctcctcacttgtgcattccctccctgccacccgtcggactctccaggcctgtcactccttcccagccacactcagggtcaaccctgtcaatactgtccttcccacatcctgcagctccgtgcatcctgccaattcttgtctcaaccatctgtctgcttcagccagcctctgccgagagtcaggagatagtggaggcttgtagaattaccacttactgttttgcacctaaacttggcattcaaaactgctcgacagtggaggctttagagaaagaggagggagatcagtccggaagtggcaatgaggagcaggaaggacaccctttgcccccacctccgggcccggaatatgagggttggggaggaaaacaagcctcaccagagaggcagcagtgtcttccggggagggctgggtttgggaggtgacaggaagattaaagatacagggaattttgctaatgatatttcattgagtgccagagggctcagtagaagcgtttaatgagttggggttgaggggaggcaaaatgttggaaaagaaaagggagtgaatgtccagagctcaggaaacaggggtgacctgggagcctcagtcttctcatgacaattaacatagcaggcatatcagctgtctattgctgcataacaaactgtcctaaaactcagtgacttaaagcaaacatttatttgctcgcgagtctctgcgctaggctgaatttggactgctcacctctgctctagttggtgtcatctgggcacactcaggcaggagcccatcagatctggggtcggctggctgtcagcaggcataggggtggtactcatcatccagcaggccagtgctggcttcttagcttcctggtctcagggttcccagattcgagtgtcaccagtggggaagttcttcttaaggctctgttggcctcatgtttactaaggtcccattggccaaagaaagtcacatgaccaagcccagactcatggtgggaggggaccacagagagtgtggttactgggaggaggactgggtctttgagggtcacccatcttacagtccacctcctaggcttaagggcacactgtagtgccattgctattatgttcagtacatatctgaaatattctgagaatgcttaaaaaaaaaaaccctgctcgtcaacccattaaattctccctggaacacccctcctccactgccacagcaaacctgtacccctgtgctcagcctgactccccacctccatcctctcctgcctcacacagcactggacctcactgatttcttcttgcctgtgtccagttttttgttttttttgttttgttttgttttttgagacaatcttgctttgttatccaggctggagtgcagtggcaccatcctggctcactgcaacgtcagcctcccaggttcaagtgattctccgcctcagcctcccaagcagctgggattacaggcgcccaccaccacgcccagctaatttttgtatttttagtagagacggggttttgccatgttggccaggctgatctcgaactcctggcctcaagtgatccacccacctcggcctcccaaagtgctgggattacatgcgcccaccaccatgcccagctaatttttgtatttttagtagagacggggttttgccatgttggccaggctgatctcgaactcctggcctcaagtgatccacccacctcggcctcccaaagtgctgggattacaggcatgagccaccgtgcttggcctcaggtccagtttttaggctgatgccctcgcatcttcctccctcctgtctcagagaaggggtagcctcctctttctttcctgcctagcctttgcccctggacccttgactccatctattccttctccactaccaaccagtgcccccactcccatccttctctcctgtccctttctctgttctgtctcatagtttccatgtgtttctctggtgatccttagtaagtgagctttttttcttttcatgtttattagccatctgtattttttggtgaattttctgtccatatcctttggttggttgaagggtggagtgtttatctttttcttgctgatttgtaaatgctttctaaaaaggatgccaagtctgttttatcaccttcttggtctcctttgctggcggtttttcctttgcccgcccattcatggttggtgtgccctggaattccatcctcgtctcttctcatccttcgtgtgaaagcccagacatgctcaggtcttctgcttccacctaatcctaagactccacatctaaagatgcatctccagccttgagtgcccatttcctgccaggcatctccaacgggctatcttgaaagaactgtctttctagaactgtcctctttctcttgccccttcccaaagtgctctgctgcctccattctcacccgagcaccaagctccttaacagagttttctacacttagcgtcctccactctctcccggttctatgaggcatcgtgggatggaaaaggtgtcccgtctctcccaccgatgagctgagtggccttaagtccccttcccacccagtgtttggggctcttcatcaataaaataaagtgagccaggcgtggtggctcacgtctgtaatcccagcacttgggaggccgaggcgagtggatcacctgaggtcaggagttcaagaccagcctggccaacatggcaaaacctcatctctacaaaatgcacaaagattagctgggcatggtgacacgcacctgtactcccagctactcgggtggctgaggcatgagaattgcttgagcctgggaggtggaggctgcagtgagccgagatcgcgccactgcattccagcctgggcaacagaacaagattctgtctcaaaaataagtaaataaataagtacaatgattagaccagaaaaatctccatggttcacactccctaatcaattcaaaaagtcttaggtctttaggaaaaatgagcacaggcttcttctgtccatggaggaggcagtgtccacactgtcttccactgaaccctttaagcattgctgtggaaggacaacaggtgcaaaacttcgcacttctggagggctccataactaaagtttctttctgctttagggttgccatccttggcctgaccggaagggcttctccttccctgcttaaaaatgccttccctcccctgcaggcagtaccagcgacatcatgacgagtgaccacagccctgtctttgccacatttgaggcaggagtcacttcccagtttgtctccaagaacggtaagcaaaggatggtgtctgtttctctgttttcctcaatgacaaggagtgttgggagcttgtcttcaggtggcagtcagtggtctgcattagaggaaggctcattttcccaggcaagtccacaatatcagtcagtttcttcatgtcccagccacagcacaattgcagtccagagaatttacttgctctgcttggcaagtatgtcagccttttgagcctcaattttagtctgaaaacgtgggtaaatcagtgtttaccaaggtgtggcctgaagacactgaagataattctccgggtgggatgggaggagggggcgggggacatgaataaacatttattagtaatgcctttgttttaacatgttttacatttctgtcttctgtttaaggcaagcaccattacttttccatttaatattgtgatataccttattcagctacacttaattttaaaaagtgagtctatttagagaaaatatgaagtaaagagtagcacaggtgcgtggtaggcagagatggtaaaaatcgttaagatgggatgcaaatgactgagttttgggaaacaccacagtaaataatatttagatttgcaggtaatttttcaaataatccagctcagccctggttgccaggccaccctcatcccagctgggccaggtgttctctgtaatgtgcccatccagcccttggcctaggtgaccagggagccatgttgtctctgcccagtctctgcttccgcggtcagcccagtggtcactgggctcctttaggaagaccaagcgtaggggacccaaatacagggaaagaccatcttgctctgtgtccttcatgccctgggggacacacgtgaggccgaagcactgtcttcctggggtgctcttatctatcctattgtatctaacatccatggccccagaaatgtgacctccctcctccacccaagccttgacccaccatcgtgtctccttcctaagtctggccactgtgcctttctagaatcttcctagtccttaggcaggacctcttccccgacttccacccatctctcctttctctgagctcctgcagccttgaaggggttgcccttgccatctcctcctctattccggggtagggcatcctccatgtcaggctgggcttccctccacgggggatcagtacacagcagatgctggaaaacactgatcacggggattgagcattgacagggcatctacctaagccaagcctggactgggcactgtgggatttagaaagagaaaggaaagaaggaaggatgtgagggatggaggaaggaaaggtttgttcatggtctccgaacaagtctctgttctgtggctcaaaatttctatgaaaggacagaacacttgtttaaaagcagcttaaggatgcttgcaaaagcatcgtctaaattaatacagttgcaggcaagttaactctgtacaaatgagcttatggagtccagaggaaggagtggggataactgtgcctaagggagagagagctgctagccctcattatctgaactcagaaacagcattgatctgggtattgagcaaccgagccattgtacaaagtctttttgctggaactagctgggagcctgaaatagtgggggtattgcctgaggtcacacagctttagtgacagagatgaaatgaggtccggactcctgggactctgcatctttctgccccgctctctgccctggccagctcacgatgcatcagagaggttgaggatgctcggctgggtgctggatttcgctgtagctttagttctcctcccactagactcccaccttcctgggaccctgagaaggagctcagtatgtggcatgagaactaatttgaaatgctccatctccaggcacattgtggaactgaatccgtgttctcccctgttccaggtcccgggactgttgacagccaaggacagattgagtttctcaggtgctatgccacattgaagaccaagtcccagaccaaattctacctggagttccactcgagctgcttggagagtaagtggctgctgagccaccttctgggcagaactgcccggagccttcttataaacacctttcatacttggcactttgccccatatcttctctccctggaaaggactcacgaagctgatcagagaagtggggctgcaggtggatgactcaaggggacactcagttattgtgaggggtccccctgtggcctgtgcagccctaggggcaggggtggccatgaatgtactgaccccccagtcccttgtaggtggcaagcagggtccaatccctggccctcagggtggactgtgacccactctaggttccctgcaagctggggctctgactcaaccagagagtgttgggcccaggtccagacctcaaagagccggtgtgagggcctgagcagcagctgcctgttgtcgccctggcccctcttgctcgttggagatcacagcgtctttctcggggggactgcagcgtccgaaagcaagcaggagatggacaggctcccctgagccagcagcctttagcacaaactgtgtttaggaaacaccctttccgggtgacatttctaggcagattgtctaaagctgtttcatggctagggaagagctgcgtgtgtccagccgtcttcgctgagatggtctgcacagtgatcgggggaggaaaagggggcatcacctcctcaaaagggcattttgtgagggcctggctgggatgcttccagaaatcaggaagaagcgtgtgctgccagttctgcccctctggtccctgcctccttctccaactgaggtgggcccaggcctggtgctagagcggcctttgtcactgagtccccaagctccagttcacccagcagggtcaaagcggttcgaaaaatgatgaggatttttgtgcgggtgtttttaataaactatcaagacagttccatacatttctatggaaacagcatattaggaagcttaaattagaatttcaaaaggctgctatcttgagtggcgtgggacgagctgtcaagtttcctaatctttttgcctgtgatgtgatgatttctttgttgcctggtttgttgcaaagaggaactgaaaaggagggggaatctctttgattttcctaaaaataattagaccatgttggcaaatgaccaatccctgcacaaaaacagaatccccggcaggcctgactcctaaatgatgctgaggccccgagataaaaaaaaaaaaaaaaaaaaaaaggagagagcacatcttcctaggtctgggtggggtgaccccagggagtcttttctgtctggttcttgctctgttttctgaaaaccagcctttttgtcctccaacaggttttgtcaagagtcaggaaggagaaaatgaagaaggaagtgagggggagctggtggtgaagtttggtgagactcttccaaaggtaattctagagcaaggcattccccagagggagatttgcatttactaggccagtagtaccagccagtggcagagctatggccaggcctgaccagaggaagcaggaatctcatagaccaaatgcagaaagagacccactctaggagcaagctctcgctcaaggtggttcgtaacacactttacagcagtgggtatgtggccttattattcctaaatggtttcagttcccctaaaggatcacagaagggatctagaggtcagctcgtctaaccacatgattttgcaaagaaggaaactcaggtgcagggccaagcgctgtttgctcatggcctcatggctgcagtaacacacctaggacgcaaccccaagaccccgatcccctctttgacgcttgttttcctattcagtgctggttcatagaatcgagtacaaagaggcatagagaggggtccattggctactgatcatacacttgtgaacacacgaagtactcgacatgtctgtggccctgcaaagagcagagggtggaattggaaacactcagccagaccttagtgggaacacattcttctttgctatagaaaaaatggttttctggcctggtgtggtggctcacacatataatcccagcacctaggaagccaaggcagggggattgcttgagcccagaagttcaagaccagcctgggaaacatagtgacatcccatctctaccaaaaaaaaattttttttctcttgtttttttttctttttctctttcttttttttttttttttttttttttttttttttttttttttttttttttttttttttgagacagagtcttgctctgttgcccaggctggagtgcagtggcatgatctcggctcactgcaacctcaacctcccaggttcaagcgattctcctgcctcaccctcctgagtagcttggactacagatgtgcaccaccacacccatctaatttttgtacttttagtagagatggggttcctcatgttggccacgctggtttcaactcctgacctcaagtgatccactggtctcggcctcccaaagtgattagaggtatgagccaccgcatccagcctaaaacatttttttttaaattagccagacatgatggcacatgcctggagtcctagctgctctggagactgaggcgggaggataacctgagcctaggagatccaggctgcagtaagctatgatcatgccactgcactccagcctgggtgatgcagtgagacgctgtctctttttttgttcatttgtttttctactgaaactgcttttgtggagctaaattgacagtggagatgttgggtgtcctcgagtacaagcttattatgagcttattagttgttcatgctgggtgggaagtggagtttctttctcgcaccatgagggaggggtggaatgaaggggagtcccaggccaggcagatccatcacaggaggtggggcgtcttggaggctcccctaggagattccctcagaggtgacactcgaggtgaattttaaaaggacagtcttaagcaggcagagggaccattctctcctgagactggggtaggatgttggcaggtttcagggggctggacccacattggcattaacttttgattggaaccaactctcaggccatgtaaaaaggccatgtcatctccggagcagaggctgatgcctgaactccagattcccccagctgcggcacaattccaaattactcagaggctgcggccagctcacatggctctgactggggtctcccactgaagccccagaagagctgtcagaagtccctgttctggggctgtcttcaggcccctgagtcgtgggggctctgggctccaaggagacatttctgcctcacccggcccaagcccgtcctcctgctcctcctccctggctgcttccaggcagggcctgaacagtagtttcctcctttggtgaaggtggaaaagagagcagcaccccattccacaacatgttcaccccctggtccagctcagggacccctagggcccctgtcttcctccattccccacatcctcacagccgccaagtcctgctgttcctcttgcctctgtcccctccctcagtccccctgccccctcccagggggtccactcctcctgtctcctgcctcttgctgaggcatcctgaacgctgatggatctttctggaatgcctctctgatcctggagtccccctctttatccggtcgactccctgttgcctagtgaggcaagcagcctcatctgctgttcccacaggactgcaggggccttcaccgtctcctgctccctgacccccgccccacccctgttgcctggcggcctcctctgttcaccctgtaaatccctgctgtggccccctagatagttctcctccctgccaccgcctgccagggtggtggtgtcgcacagagacatttgttgttcagatgtctgtcaccccatttccactccatcccagggaggaccgggtcttcctccagcatccaagaaccccagctctggccctgggtctagcttagagcctgacatcacctcatgccaggagccaagtgataattggtgcagctgtagaaccctggagtacccagagctccactgcagtttccagtcatctgttctggaacttttttttgagactgagtcttgttctgttgcccaggctggagtgcagtggtgccatctcggctcactgcaacctccgcctccaaggttcaagcgatttgcctgtctcagcctcccgagtacctgggacgacaggcacgccccatcaagcctcgctaatttctgtattttttagtagagacggggtttcaccatgttggccaggctggtcttgaactcctgacctcaagtgatccacccacctcggcctcccaaagtgctgtgattataggcatgagccactgcacctggcctggaactttctgaatggagatatagtgagtctgccctgttggccaacatggtgcccagagccctgtaccaggagccttttggtgtctggaaaggaagggagggaatcgcctagaacaaagtatcacctttttatttggcccttctgtatgggagtcatcgtgagaaacagccccacatctgaaaaagtcataactcgtggcagacgaggagctagtgtgcgtgtgatgctcctccctgcacttgcccggacacagcccccactggccagtgctgtgcaaagcctgttagcagccacccccgctgccagccaggccagcagggcctctgggggagctggcactccccagctctggaaacttgctcgcagatggaatgtgggagcctgtgtctgtcattcgctgagccacacccccaacaatcggtaggacactccaggcccagctgggggctctgccaggatggacacagaggctgcatcctccctagataggggcaagccagacaggggcagggctgggatgcagccacagtcctggagggggccaaggagaaattctgtgctctgtagggggagcctggcgcagggtggagtgcatggatcattccagacctggtgcctggccccacttccccgccagcctgccttctcctctatgaccctggcctagggatgggaaggaacgggggcaatggatggggcccatctggggtcaggccttcttgctgggacctgggagccagctcagtttaggaggcctggggtgcagcgtggaggtgagggggacagggaaggaagctaacccccaccttgctggacagggtgtatgtgaaagctataccccacctgctctcttgggtatggacagcagagatttagatctgattactaagaacacctttcgtcatcttcatccacttgtccacccacctgtcccctcacctgtcccttgcccatcaactccagtcctgtgcccttctctctgcagctgaagcccattatctctgaccctgagtacctgctagaccagcacatcctcatcagcatcaagtcctctgacagcgacgaatcctatggtaagggtctgtgggcaggtgccacacctgcctgtgaactggcggcctctgacgtagcattgccttcaggggagctcacctggcacttccggtcataggctcctgcctctcctttcctcatcccagggctgctagtgggaccgtcaccactaagtcatccttccctccccactaggcttctgggcaggacagccagcagtggcaaccccttccatgtattgagccttccctatgtgtgagatctgtgccaggcactttccagtatcatgtgatataaccttgacaagaccttactgttctccaatgagtaaacagaggctcagaaagatcaagtgacttgcccgagtcatataggtagtggtggctgggccctagtttgaacccaggcctgcctgcccttctctgcttctcaagtgtcctgagtcagccttctcagctcacaggtctggagctgcggactcccctctgctgacccagtctctaaaacacctgctcaggcacaaaggggctgctccttctgcccccaaggagccaccctctgcccgaagaccccctctccccagccagagcaatttgggctgaggtgtcgttcagggtcccctgagtgggacttggggtgctggaaacacagctcagggctctctggtcttctgctcagcatcgcctggtgcccagaccaggcaggctgtggaggcccacagccagagagacagcaggggcttttgtaccatctctgcctgtttgtggctccagcccaaagtcaggctcacccttgctagaccacatgtgtggctagaccatggggtgagagaggcagagagagcctggaggggacagagagaggcaggaagcaggagccaggccaagcctctccttacaagccaagctaagagcaaataccttatcccgagggcagtagggagccattgaagattcaagcaaggaagtaacaggatcagattcacatcttggaaatccgcatctgcagtgatcaagacgacagatgagtgagccagaatagaagtagtgacagtaaaaaaggagagaagcggatgacattgagaggaatggagtagaaaactgtctgggcctgggattggggaaagggtctgtattagtctgttctcatgttgctgtaaggacatacttaagacgggtaatttataaaggaaagaggtgtaattgactcacagttctgcagggctggggaggcctcaggaaacttacaatcatggcagaagaggaagcaaacacatccttttcacatgatggcaggaaggagaagtgggtgcccattgataggggaagctccttataaaaccatcagatctcttgagaactcactcaccatcaccatcactatcactattgagaaaaggatgggggaaaccacccccatgattcaattatctccacctggtccctccaatgacacatggggattgtgggaacgacaattcaagaagagatttgggtggggacacagccaaaccatatcagggtctgagcggctgcatgaatgatgcttctacttcttgcactgggttagatgcagtgccgcgggtaagggagaccaaggcacagccacagcatatgaggaagaccagaatgctgttgtgctggggacaccatcagaagagttgggtcaaggagagggtgtggttacaatagcaaatgtggccaagggacccaacacaaagaccaagcgtctcttagatggagatactcagaccatcagcagacttggtgagcgcagtgtccgtggaagagctggggtgacatcagacctcagcacttaggagtgaacaaagcatgaggagggaggcagaggagaatgcgcctgggtcaagggagcacatttatccacgtgcttatttatttgaaatggaaaacctttgaatactgctcggtggaagtcactaaagaggaagaggctgcagacacaaatgaaagccccacgcatagtctcccattgtgcaggctctgccaacacctgggtgtgggcactgtcgctcccctccttggggaggtgaggaaaggaggctgggagacctgaaggtcatgcagctactgagcagcttgttggaggtaactacgtgatcttgggcctgagcccaggcagctcttccccgttcccagtgcagcactggcaagagggtccccaagctgcaggaggggtgggaagagcttgaggagtgtgatggccctaatagggatcccctcgtcacggatgcaagagcatctgaatggctgctgaaatgtttgaagctttgttagcaggaaacaggcagtacgcaaaacacacgcttcattttctcattcaaatcctgtatttctgcgacacggcaagaccatgtctttaaaaataatatactgtaatcctcctttgtttcttccgcttcatattcatactcacaagcagcatatcatcaaaataaaaaggaaaaacatcaacagtctcattccagtaatcatttttattttggtttcacatttccagcctcatacataggcatacctagattttcatacttacatcacagaaacatcattttatactctgcttccctcacctggtattagatgaaacacattttccatgattctcctgccccatctttgtgactgttccttttgatggctgcattatattccatggacttactgcatcctcattttaaaagtattcctcactttaaaagtactattattgaggctctgtcagttgtttttgttggtgctatcagtaacactgagatgaatctctttgtggacattttttattattcttcagctacattttttattcctttgagtaatctcattaggacaggttcccatgtttgccggatcagagggtgtcaatcagtgtttgtgcttcttggcgcttgacaccaaactgattgccataaaggctgtctcagctgacctcaccacggataggcttccccagatccttgctggcattgggtggttttgttttttgtttttggaggccagagtgcagtggcacgatcttggctcgctgcaacctccgcttcccagattcaagagattctcctgcctcagcatcctgagtagctgtgattacaggcatgcaccaccacccctggctaatttttgtaatttttcgtagagagggggtttcaacatgttggccaggctggtcttgaactcctgacctcaagtgatcagcccgcctcggcctcccaaagtgctgggattacaggcgtgagccaccacacccggtgcattgggtgttatttttctcgcttcctatctatgctaacttcatgtctgtgaaagagcaacttaatgattccttagtttgcatttttgatggctaggaaagtggaactattttccatttattaaaattaaccagctgcaattctttttgtgtgaaacgtctgtctgtattatctgttcatgcatctgctggagagggtaccctcttgcctggggagctagctgcagatactgttcccaatccgtttcctttttattttaggttttttctctgtgcaagttttaaacttgcatgtcctcttgcccgccaattttgttctgtcatgtcttatgctgcatcaaatcttgggaagttttcattccctacagcgatcagatgagtgtttaattctgtctttctgctgcattttctacaatataattttttttacatcaactaatccacgttttgttctaagacttgagacatttgcccccaaagtactgtggtgttgttctgacggatttattaaataacccttgcctgggctatagtttcaaaggaccaactctccggccaagagtttggtgtttctgccatgaaaaggcagggtcttcacccagctgtctcccactttccctgcaggcgagggctgcattgcccttcggttagaggccacagaaacgcagctgcccatctacacgcctctcacccaccatggggagttgacaggccacttccagggggagatcaagctgcagacctctcagggcaagacgagggagaagctctatggtaagcagcaagcccctccccagcgccctcttcagccccccacttagggacgggaacgtgctttctctcagcaaagctgtcgaatatgctctctgctgcggcctcagagcagaaatccagcactggaaaagatctcagacaatctggcccaaccctcactcaactcaaaaatgtcccaacagaacccaacatccagcacccccagatcaccctccccgaccctgtggattttttagggccccgaacctcacctgtcagcctttaggccttgtcattcccccattagcacctccactaaaagaaggacccagtgtaccaagcgaacctacgtcttgttaaatggctccttccaggctgtccggggaaggccacagctacagctgcagatgagatttagaatttcttgggcgacctctgcttgcccacacggccacatggtgcccactcccatatacaaacaggccctcgtacgtacctaaaccctgccctcatggtgcccacccaggtttctgtaccttctaaactgctttttttttttttttttttttttttttgggacagagtctcactctgtggctcaggctggagtgcagtggcacgatctcagctcactgcaacctccacttctggggttcaagtgattttccatcttcagcctccagagtagctgggactataggcacccaccaccatgcccagctaatttttatatttttagtagagacagggtttcaccacgttgactaggctagtctggaactcctgacctcaagtgatccacctgtctccgcctcctgaagtgctgggattacagacgtgaccactgcaccgagcctttttttttctttctttcttttttggagacagtcttactctgtagcccaggctagagtgcagtggcacaatctcagatcactgcaacctccgcctcccaggttcaagcaattctcctgccccaccttcccgagtagctgggattacaggtgcccaccactggctaatttttgtatttttagtagagacagtgtttcaccacgttggccagactggtttggaactcctgacctcaagtgacacacctgcctcggcctcccaaagtgctggggttacaggcatgagccaccacacctggcctgtttattttaatctgacaaaacatacttgcctgttttgtttcttgctgagaccagtaagttggaaatgtcacatgaaatggcaactctggatcccaactctcctctctgtggatccactgcaggcataactaatcaatcactgaactcttaggaggcctcagaatcttgcttaactcacctctccaggtactcactattcactgtgcagcttcagcctgcaaatggaaacccctttgccatccctcgcctaagctctggaagctgggccctcacatgctctttcccgtccctttccttccagactttgtgaagacggagcgtgatgaatccagtgggccaaagaccctgaagagcctcaccagccacgaccccatgaagcagtgggaagtcactagcaggtaaagtgggcgtggggtgggtgttggggggggtggatatcagggactcatgacaaattagcatggtttggccgggtgcgatggttcacgcccataatcccggcactttgggaggccaaggctggaggatcatttgagcctaggagtttgagaccagcctgagcaacatatcgagaccctgtctctacaaaaaaaatgtggtggttcatgcctgtaatcgcagcactttgggaggccaaggccggtggattgcttgaggtcaggagtttgagaccaggctggccgacatggtaaaaccccatctctactaaaaatacaaaaattagctgggcgtggtggtggcacacgcctctaatcccagctactctggagggctgaggcacaagaattgctcgaacccaggaggcagagattgcagtgagccgagatttcaccactgtactccagcctgggcaacagaccgagactctgtctcaaaaataataataatacttagctgggtgtagtagtcctaactacttaggaggctgagatggaaggattgcttcagcccaaaaggctgaggctgcagtgagctgtgattgtgtcactgcactccagcttaggcgacagagtaagaccttgtctcaaaaaaaacaaaacaaaacactagcatggctctgcaaacccagggcctgtgagaaggtgaactgaagcacagagaaacccaggacacaggagaaagaagctccagcccaggagaggtgctctcctgcctcctctgcgagtctgttgaccgctggagaggttgatgtgactgtgacaaagctggggaaattctaatgtgacggaaagttcagtttgactcagctaacatttgttgagtccctgtgatgtgtccagttctagagaaatcaaggcaaattcagtgcagtccctgacttaggaacttgcggcctagtgcatgaagaagtgactgcggagagaatggagagattccaagtctacaaatggtggctgtgtctcctgtgggacagaggacaccagcaatcatgggatctgtggccaccaaaccccaccctatccactagcaagaaaaatcactgggggaaaatgcacactggttgctcttggcagagactgaactgagaatagtacagatgttaaagtctgtattaccagaatacagacgtccttggtagcagggctgccctaactcaccgatgtggtctccgagatccagaatcaagttctggtctctttgccggctcaccagccgaggaggcagaaccatgccagcagcagacatagcttgttcctctcctccctcccttccccacaactcatccccaccaacccttgccctcaccccagccacccccgctgtacacaggaattctcatctctagcacattccctgatccacttccagcttccgatgttcacagccgtgggcacacaagcatcccctttccctctttccctcccatgataatcccatcagcaaatgcatcctggctctgaagtgtctactgtgttccagaatcaggatcagtgtagggaaacaaattcttttccattttgactagcatgagaacgagcatttatttctgaagcaggcagtggtggatgggaacaaggtacagctcggaaccaggctggcagagcacatgggagctgtggagtgtccctgacagcctatacgctcagaactcagttctcaggaggccggtgcctgacacagtggcagcgtgcagtgtgtctgttggggccaccttgcctgggtctgggccatcccctccatagctttaagctgattgcccccaattccaggctccaaccttgatctctgtgacctcacactcatttttctaaatatgcacatggctgtctctatgctgacgctgcacacacaaatgtgtgagctgatgtgttccagaggaacccctgctggagtctgccctgaaaatcccctccttcctgccacccaggctacccccccaccatctctctgccctgccagccttgccagcttctcattccatcctctgcacctgctcaccagccttcggaccgtccaggaacaggccaaacccctctcacctggaggcctttgcatgtactcttgccactgccgagaacagtctccccttctttctctcttatctgcttatcttcttatctcagatgaaagaccacctcctcagatggggcctcctggggtcacccaatgcccagttggtcccaacacttcactagtccccatctctgccccttgttattctcagacttcagcactacatcaataccgtgtctctgtgtcactgagcttgtttttctctcccatcaaaagtgagttccataagaacagagaccatggctgcctcactcacagccatattccctcctcccggcctggggccaggtgcttacgaggccctcagtaatcacggtgttgcatggatagatgaatgaatgaatggatcactgcccaagaggtgaaggagttgaggagagctcgagagagccctagggttatcagaggacactttccttgggctggtgctgaccccgagaagggaagggacccctgagatgtgactccatgtcctccctgcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggtgagcatcctcttcattaagacggctccctccctccttatgaaagcgccctgggctttgggctttcaccctagaatggaagcctcataagggccacaatttgtgtccacttggctcatgacttatccctggggcctgaacacagcaggcccctgacatgtatgtggagtcttccatgtcctaacctgttagtgcaactcgattgctttttaaagggtaaaaatttgtaaagatattgccaagaaaaggaacctcctataaaaactatatacatatcaaaaaacatgttttgggccgggcatggtggctcacgcctgtaatcccagcactttgggaggccaaagcgggtggatcacctgagatcgggagttcgagaccagcctgaccaacatggaaaaaccccatctctactaaaaatacaaaattagccaggggtggtggtgcatgcctgtaatcccagctactcaggaggctgaggcaggagaattgcttgaacccaggaggtggaggttgcggtgcgccgagattgcgccactgcactccagcctgggcaacaagactgaaactccgtctcaaaaaacaacaaatttcggccgggcacggtggctcacgcctgtaatcccagcactttgggaggctgaggtgggtggatcacttgaggttaagagttcgagtccagcctggccaacgtggtgaaaccccgtctctactgaaaatacaaaaattagccaggcatggtggctcacacctgtaatcctagctgaggcaggagaatcgcttgagcccaggaggcagaggttgcagtgagccaagattgcaccactgcactccagcctgggcaacagaacgagactccataaaaatgccaggtgtggtggtgcatgcctgtaatcccagctactcaagaggctgaggcaggagaatcgcttgaacccaggaggcagaggttgcagtgagccaagattgcaccactgcaccccagcctgggcgacagaacgagactccataaaaatgccaggtgtggtggtgcacgcctgtaatcccagctactcaagaggctgaggcaggagaatcgcttgaacctaggaggcagaggttgcagtgagccaagattgcaccagtgcactccagcctgggtgacagagtgagactccgtctcaaaaaaaaaaatggccaggtgcggtggttcacgcctgtaatcccaacactttgggaggccgaggcagacagatctcgaggtcaggagatcaagaccatcctggctaacatagtaaaaccccatctctactaaaaatacaaaaaattagctagatgtgctggcacgcacctgtagtcccagctactcgggaggctgaggcaggagaatcacttgaacccgggacgcagaggttgcagtgagctgagatcacaccactgcactccagcctgggcgacaaagcgagactccatctcaaaagaaaagaaaaaaaatgtttctagagctagttaacctttgggcatctcccgctccctagagggccctgtggaacagggtgggagtttccatgtagagcctgctcgcaccctccagttcccctcttttttctcgaccatgaggttccccattctataagcagcttcctagtctctcctgtaggggacacttagttagaaactggaactagggatgtaaaaggcagggcagccagcctgcagagagaggaggcccggccctgaaactctggggaagccccggacggtggagaaaactgatctgagtctagaactggttcaggcagaagaatggaagccagataggagaccgggctacgcagccgaggaacagggtcagcacttcccaaaggcacagacgctctctggtgctgctggaacagagcagagccaaccatgggtacctcgtggatacacaagtggggagctctacatgtttctagtagccacaggatgacagacagacgtgaaagtgcaggcccaattaccaacgatttaagatgggcaagatagcttgagcactgtcttcccttgaggctctttgctggcttatcataacctcaggggttcactctcagcctctcttcctctaacactggttttttcttcatcctttttccatgaggacttgcgtgctgtccgccacatggggcagagccagcagcggtgtgttctccatcacactgtcctccagctccctccagttccacccttcccaggcctgacctggcagggtcttcctctggatggagaagctgttgacagtctcatttctcaaaatatgcgagatatgctctaagaaacggataggccaggcgcggtggctcacgcctgtaatcccagcactttgggaagccaaggtgggcagatcacttgaggtcaggagtttgagaccagcctgaccaacacggtgaaaccccatctctactaaaaatacaaaaatcagccaggcgtagtggcccacacctgtaatcccagctactcaggagtctctgagacacgagaatcgcttgaacccgggaggcggaggttgcagtgagctgaggtcatgccactgcactttagcctgggtgacagagcaagactccatctcaaaataaataaataaataaataaataaataaataaataaataaataaatagatgagaggaagtcaggaagagagagagaaaaggacaggacaggatagccctgaagctcagctcagctgtctctctctctgcctctgtacagagtttgttgatagggtgtcagaccctggtcattccctaagaaacttggagggaggagaaacagcctcagtttcctgccctggaaatatgaggacaaaaggcactattcagtgggtatcaaggtgcctgtgtggccacctctttggagaccccaggaaatggagctctaagcaaccagaaagaaaaaggagcatgattatttgtgtaagtgaatgcttttcagctcccaaagcgaatggatcttggtgcataacaacgagcacacagcttggtgggagcatgctccccacagccccatggtgacagctgcagacaggctgccatccacgggcaaggggcccccagggtacgcttctaactcactgctcaccaaggaggcgcttggagcctggagccctgcagctcgcacacctgcctcatccctttccgctgctccaggtcccaggctcagccagagcaaaggctgtggaagggggtgttccaagcaccatcagtgtttccccaccatcacccagacccaagtgcagggactgaccttcccggtttgccaagtactgtcccagttttagcactgaaagtcccacatctcaggaaacccttcagtcctgcgtaagcaaggacaactggtgaccccagatcgaagctgtgcaattaggaaggggactcttctcagcccctggccagtgcttagctgctttggagatgagactcgtctcctgaatctgagaagtacagtcatttgctgcaggaatcaactcgtcccctagatatcggttcccttattcaacaactgtggcctgctataggagtcaatttcttgttacctttggtcaggggaataagacttacttttgagtttttcatggttttccccagtcttccccgcccgccccaccaagcttcccctctctaagtgcaacagaagcctcctcttagagggaaggcttccctggtctctatctcactgctcttttcccagaggagtgagctttagaatcacaaaagggcttgcacccagggctcttcctggtcctgcccccagttctctgaagtcagccccctcctcccatctcagcccctgagagagggtggtcagaggtcaggacttcttgctccttcatctgaaaacttgtgaccatgccagttgcaccctcctgtgccctcttcccttggctaactcacagcaacggcctttgagggtccacacgggggtcagaagagggctgaacatggagggggccctttccaaagtccttgtttgaggccccagcatttctatgtatgcacctgctctaaggtgtttccaaaaattaatgggcaacacccccaggtgcacagtcaggctccctttggtgtgtcccggaggccagcctccctggagctccatggcttctcaccggcacctgtgtgaggacgacatcccgcctttgtcccctgagcccacacctgctccccagagtcactgttgagtgcctgtgagcagcttctcagtgcacatcccatcagtaacaggcgcaacagcctcaacagctcagtgggttcccagcgatccacaatttcttcacgatagcttccttttctgtagaaagcagaacccagaacactcccctgggagattctgctgctagtcaggaagtaaaatgtgttcccatttctcgttctcatagtttgctcagcaggaaatcacctccagtcagagcagtgataaatcagaacacaaacaagcaaaggcagcacttgcctactttgggtcacaacacaggagcttcccctgcccatgagttgagtgggcctttcttctagctactggccttggcttccccagtactcgcaagtgtccaagttccctctgacttgcaccacagccaccacgtgttccttccactgtgagttaggagaggcttccagggagaggacttcatgtggctgggaaggacactgtgttaaccgggatgtcgggccccctgagctcagattctgtccttgtttgtggctgtgttgctgtgcctgggaaagtgtctcacacatgagtttggtagatggagcctcttgagctttcaccctcaagtagcacaagtggttcctgaggaggaggtgtgatcgccttcctgagcggtcatgcaaatgctgggtcggagcagaattgctggagtcagaggagaggctgcggggtggggatgggaggaaccgggaaaggaggcctgttgactggggaggtgggaaggggctgtggagagcaggctcatctgatgaggatgaggggttgatactgaggtgccatgtaagttctcacttcatttctcccacaaatcctccagtgccatgccccttgctcacagatgctctgatgtgaacaggttttatagtggaaaaggtcccaggccagaactgaggctgtctttgaggacaacgtatgatgaacacagtactgtttcctcttcctttttttcacttgaggtgaaattcacttaacataaaattaaccatttcaaaatgaacagtttgctaggctgggcacagtggcttatgcccataatcccagcactttgggaggccaaagtgagaggactgcttgaagcgaagagttcaagaccagcctgggcaatatagtgagactccccatctctacagaataaaacaaaactaaaaaattagccaggcctggaggcattgctactcccagcaatgtccagctactcctagctactcccagctactcccaagtagtctcagctacttgggaggctgaggggaaggactgcttgagcccaagaggttgaggcagcagtgagccatgaccgcaccactgcactccagcctgggtgacagagcgagactctgtctctaaaacaaaacaagacaaaacaatttggtgccattcagtaaatttgcaatgttacatgtctctatctagttcagaaacatttgtatcaccccaaagaaagacccagagccattaagcagccatgctcccatgtcttctcccctggacatgtgtcttccctgctctgtccctggctctaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggcacagtggatcacgaggtcaggagatcgagaccatcctggccaacatggtgaaaccccgtctctactaaaatacaaaaaattacccgggcatggtggcgcacgcctgtagtcccagctgcttgggaggctgaggcaggggaatcgcttgaacctgggaggcagaggttgtggtgagccgagattgcgccactgcactccagcctggtgacaaagcaagactccgtctcaaaaaaaaaaaaaaaaaaaaattaaaaaacaacaacaacggagtttcactctttgttgcccaggctagagtccagtggtgtgatctcggctcactgcaacctgcgcctcctgggttcaagcgattctcctgtctcagcctcccgagtggctgggattacaggcacctgccaccatgcctggctaatttttgtatttttagtagagatgggatttcaccatgttggccaggctggtctcgaactcctgacctcaggtgatctgcctgcctgggcctcccaaagttctgggattacaggcatgagccactgcacccagcctcattgttattattaagtcgcattcatacttgaaaatttcccaatattttggagaattcagcacactttccctctccttcatgtaaaataaaaaattttttgagcaaaactaacagtgattaagaacagactccaggccgggcgtggtggctcatgactgtaatcccagcattttgggaggccgaggtggatggatcacctgaggtcaggagttcaagaccagcctaaccaatatggtgaaaccctgtctctattaaaaatacaaaaattagctgggcattgtggtgtgcacctgtaatcccaactactcgggaggctgagacaggagaattgcttgaacccaggaggcggaggttgcagtgaaccgagatcgcaacactgcactccagcctgggcgacagagtgagactccatctcaaaaaagagaacagtcaggctatgttggatttgaatcccagccctcccacctcctggctctgtgccttgagcctcagtttacccatctgtaaaaaggggctgttaatagtacctacctcatagacttagaaggagaattgcattgtaggctattatgtattattaccatgtattatcatctatatagaaattatatatttatatttatgtatttacattgatatccattacatatcatttcatatatatatactatacatattacatatgtgtatatattttatatatatatatggtacgtacctgggtgtggtgccatgcacctgtagtcccagctactggggaggctgaggcatgaggctagctggaacccaagaattcaaggctgcagtgagctatgattgcaccactgcactccagactaggcaacagagtaagaccccatttctaaaaaacaatttttttaaataagcaggtaaagtacttagagcagtgagtgctggctcttctcagctacacgttaaaggaagcctggcctagcccacagcatgcagggacctgggccacttagttcaacatggcctggtgagaatgagccctgacagcccttctgttcttgtcccacagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 2538 - DNA, 148009 bp, Homo sapiens; identical to SEQ ID NO: 2537
  misc_feature 78707..98706: note = Unsure
  source 1..148009: mol_type = genomic DNA

SEQ ID NO: 2539 - DNA, 9386 bp, Homo sapiens
  source 1..9386: mol_type = genomic DNA
attgcaacatacgtttttattactcaaggacaacctggacgtcaccaatgcccagcttcacgggggcatgtagtgtgactcacggctgaacacaaaatcactgtgaagcctgtgctacagccctgggctacttttggacacgcaagaggacactcggttacatgaaacctgacttgcttctgaagacatgtgatacatgtcttttccctgaaaatgtttcccttccctgtctgccatgctcccaacttttctgccttccaggggcttctcactgtctgggtaactaggtcttgggcctagctagaccttgggtagtggcccctctgccacaatcagtgcctgggcctgaggctgagcttgtggcctccgaagcctgacctggctcggagctcgtctgtggcgcccagggatggcctggcttgcaggccaccacattaggccagctcgcaggtccccagtaaagcctgaagacactggcccgaggttggaggtgggtgctgctcgactttctggaggatctcagaattctcgcttcttgctaggactgaaccatgagacttacagccatacttcacttttcccagggtttttctttttgaaacagggtcttgctctgtcacccaggctggagtgcagtcatacaatcatgactcactgcagcctcgacctcccaagcataaatgatcctcctacttcagcctccccagcagctgggaccacaggcgtgcgctaccacgccaggctaatagtttaaaaaattttttggcagagacagggtctcatcatgttgccctggctggtcttgacctactgggctccagcgatcctcctgccttggcctcccaaagtgctgggattacaggcgtgagccaccgcacccggccacacttttccaaattgtaagcaggtaggagggccctaggcctcgtcggccccattgtgcagggtggccactgtccaaagagatgggcaaagagctgctgccagaggcctgggctgcagacgccctgcatggctctcaggggagccagctccctactccacacccctgcacagcagcccctctcctcccctcacgggtctgtgcagccagcagcctcccaacatgcgccagcctcctcactggatgatgccagccttccttgcccccagatgctggcatggaggcagggttccactctgcctgcctatgcccacagagcctagaacagcagggccacctccttctctcccccgcgggcatgggcccccacccccactgccggcagagtgctgaggactcgtgcaccatgagaacttctgaccatgagaactttgacttccggatttgggggatctgcccaggtgaacacatcagctctgaaattcatcactttcttcgggcccctgcctgtcctgttccaggcccaagcctacagaaggaagaggaaagtccgcttagcaaatgggggaggctcccctactgccagaagccctggctcaaggcctgggccatgctcccttatctcctggggcgttcgtgggaattgagggtttttgtttgtttgttcatttgtttttgagacagggtctaactgtctcccaggctggagtgcagtggcttgatcacagctcactgtagcctccacctcctgggctcaagtgatcctcccatcttggcctccaaaagtgctggtattataggcatgagccacctcgcccagctgagggttcctaagcagtggttcttcaaatagtacctgggatggaaaattcctgctggggcttcctatttcctgaaagcacagagtggggcaggcaccctcgggctaaaggaggtgctactgtcaggaggcgagggaaggagtgggccagggtcttgctaagggaggcatgtggggccggctgggcttctagaggtcgccagagccagtggcctgcccggctgccccacgccctcagcgcagtcgggacagacactctgctctttggggctgacacggatgcgcctgagcaccccagaggccagcctgggcggcagcacctgggagggagctggacgacagcagctgcaggctgtccagggccccatcctcgtacagggccagcttctggaccatcttctgtcgggcagggttgatgataatctgcggtggctctgacgacgatgatgcagagctgccaagggccagtcctggggtggagatggcactcccttagcctcatgctgtggctccccagcccgcagcctagcaccctgcctccctggcctcaggcctgaattcctcagagaagtccaagggcagggcccagctctcaggctaccagacagagccctccttgttcccagccttcaggaatggggtggggggagggctggagagcaagctccacctgggaaggatgtggcctggggaggggaaaccagggttgctaaggtcacagtgagctgaacatttggccctggttctcttctagaaggctggggtggggacttacaggggctttggcccaaagaggccttggtccctctcctgggaacccgtctccccagctaccttccacggctgtgggccgggatcctgggccactcccccagctcgattctcctgccgtgtccccctgaggacagccggcctccctgaggggtgctgggtccagagggcagcttggagtcaagtgccaggagcgcagggcagcagagaggccgcctaggctctcgtcactctccacgggctggttggggcctctctgcagctgctctgctgcctgggcactggctcctgatggcgctgccaggggctgccatggagcagccccactgtgggctctgccagtgctggacacgtaggagttctcctgcggggaaggggggatgcagctggcggcctccgaatgcccgggcacccccgccaccactgcctgcagcttctctagcctctcgtacacctgcaagtggaaaagagggactctcagggtgagatggcagccctggccggtcaccccgtgggcaaaccacagggctgctccaggccgtccgtgacctgccccagggctctaaaatgacataccctgcagctgggaacgctctgcccctcgcccctctgttcccatcacagggagtgctgagaagcgcggctgccaaaagcaaggactgagaatggcctcgttcttttctacaaaatgaatctcactgccccgctgccctcaaacggggcctctccattttcaactgtcaccagaggagaagaggtggggtactagggaggggacagaaaaaggcagatgcagtagtgcagtgcgcccagcagggggcgcggcagcagctctttccttctctctatgtgaagggggtcggagctgggctccgcaaagcaggactgcccggggcccctcagttcagaggggcgctgccccaaacagaaccaaagggcaagcaagaaatgtgtggagactccagagagacctagcaggtgctgagatggggtcactacagagcaaggcctggaatgcgggctttctatctggccaccccgtcccagtgcgcagctggctacctgggtcataggaggcctccttttggcccggcggtgcaggcagcagcaggccagctggcccaggcccaggcccagctcaggtgggcagggcccgggcctggggtccaggtgcttcttgtagatctgcatggcgatgggagcagcccaggcatctgcagccagacctgcttgcagtgtgctctgggtgcttctcaaagccactccagcctcctcagcctcctcttccaccaggtctttctgtgggataaatactgtcagtatggctaccaggtggccacacctgcagctgcagtcctcaggtccttgtcactcaatcgtatgggttttgataaaaaaaaaaaaaaaaaaaaaagagatggggtctcgctttgttggcctggctggtctccaagtaggctcaagtgatcctcccgcctcagcctcccaaagtgctggtgttacaggtgtgagacactgtgccacagctcttggtctttctacaacttactttttttctgagacagggactcattctgtcacccaggctggagtgcagtggtgcaatcatggctcagtgcagcctcaacctcccaggctcgtgatcctcccacctcggcctcccgagcagctgggattacaggtgtgtaccaccatgcctatcttgctatgttgcccaggctggtctccaactcccaggctcaagcgatcctcctgcctcagattcccgagtagcttctagagatttattaaacacctactgtgggccagtggtgctctgggccctagggatacaggaacaaacagaaccctgggacccggtttgacagagctgacttcctggtgggggagagccccatggagctggggtctgaaggcaggaagtagcctgagagggcagagccgagaaggaaagcgccccacagagaggtgccccacagacaaagaggtaccccagagagagaggcgccccgcagagaggcgcccccagggtggaaacaggaccggaggccatctccagttctgaaatcagacagaccaggaggaaccacctgggtgggcggtggcttttctcgcagagcgaacggcacatactaaggctgtgaagcaggcagcagggagcgccccgagtcccagggacctggggcgttggggggtcaaccacataagggactgggccttcaccccaagagcagagaaaaggcaaaggggcctttgaaaagagcactttggctgcagggtggggagcaagtggggaagtccaaggacccccaaggagcctggtgcgcttcttcagcaggatgcatggatggacggacggggaagggaaaggaaggagggctcaagcccggctcctgggttctcagcggggctgaatcctgacggagaccccacagcacacaggaaccgccccaaacaagaggagaagcagtgaagcaattactggctgagcacattctgtgaagtctgttttgcatatgggaaaacaggcccacaggggagcaggaatttgctggaaggccactgtcaggctggggctaaaacccaggtctctagtctcctggccccaccacagtccacggtgaggcagactgagtggagtaagaccgtgaggcagctcaggctgccctgcacggtgcggagagctcagctgcagcctgctggggcccaggaggttcctcggggcctgcttcttctctaccaccgcctttctccggccagagtcctctgagttccactgcagcttgggtctcagtgccctgggaccgcccttccccctgcccccagcccaggtggggtctgtacaaggcccatagtgtctgcaggacagacaggtttgtcctcggcaaggtaaacgaagttgtttggagccctgcctactttcaaaaatgaggccactgtggcagcagaggcatccatgggcactgcgccccagttatccccgccactggggctgtgcctgctggctgccagcagctgtgtgtccctcctggccctgcctcaaggggctcaccagatacttggtcctggcaccgtgcgtcttcacagccctctgaccagccaaggtctctagcactacctggagagagggaagagggagagcatggcagtggccttggcagggaagaggcctctggtgtggacatggattgggcctgacaagggtgtggacaaaggcagagccagatgttatgggactgaagctcgggcaactcggagagcccacttgaagacaaattacaaacacacagttaggtgcagggtgaggaggagggcctcggagggagggggaccctggagctgcagcctcctggggtcttggcagatggcccctggcccgcagtgcactctgcagcccccacctctgcctgcctgtggcttctcctcctctgagccagcagaggggtcagtggctcaccaccccaaagctgaaggtgtccgtgtccacagccagccttcccgtcttgatgtactcctcgggcaggtaggccagggtgccccgcactgtctgtgtccgggccaccatgctgctctggctggggctggacccggcaaagcggctgaaccgggccaggccaaagtctcccagcttgggtgtcagcctctcatccagaaggacgttggaacttggggagagaagacagtggcgtcagcccggtcctagctcctacacctgcccggcttagataaggctggactcgaggctgccagcccggtgccttgcccacagaaagcgctggcactgccctgagcgctccagctgcctgggggcctctgctcatcagtagggcccatccttggcccgttcccacacctgtgcgatgccggggtgttgaggtcccaggccatgcctgatccccacattgataggacgcggggccccccttgctgcaggccctgccccggcagttctcaagggcccctcctcacctcttgatgtctccatggatgaggctggggctgtcctgatgtagaaactgaattgcccgggctgtacccagaaggatgtccagtcgctgaggccaggagagaggtgggcaggcctgggtctggggtggcaaagggggacaggggaggttgctggatggccgttccttgatcccaaccatccttctacctgtcaccgtgcagcctggaacagccacttcactctctaggcctcagtttcccccttctggaaaacgaggagcaaagtctccgtgacctgcacttcttaagcaatggctggggacacgttcaatagaatctgctgggcttcggctcccagggctcatccctttgtccctggtggtcgggaagtccttgaaggcattcttcccgctctccccaaacgcagcatgcaggaggaggcaagggggccctccctcagctgtaggtggtccagctggtagccccagaccccctcgcctccggggcttgctgatgagaccctccagctacgctgcttgcaaaggggagaggcctgggaaagagctctatagaaaacattgggtcgggccaggcgtggtggctcacgcctgtaatcccagcactttgggaggctgaggcgcgcagaccacctggggtcaggagttcgagactagcctggccaatgtggcaaaacctcatctctactaaaaatacaaaaattaggcaggtgtggtggtgcatgcctgtagtcccagctactcgggaggctgcggcaggaggatcgcctgaacccgggaggtggaggttgtggtgagctgagatcacaccactgcactccagcctggatgacagagcaagactccacctcaaaaaaaaaaaaaaaaaaaaaaaaaaaaaaattgaccccaccgtgggccaaatcctgagccgggtgctgctggggagctggaagtgcaggcctggcctgctggcaggacccactcacacaggctgaaagccctaggccccgcgcccggctccagccaggtgtcaggagtgctttgggtcctgggaagcgtgccgggccaggtgagcctacctggcagtggagacggtcctccagggagccgttgggcaggaagccgtacaccaggcagtagaagccgttctgagcacagtagccagcaaagtccacaatgtttgggtgacgaaacctgtttgaaaaaggggagcactttccatcaggccagactgggtgggcagccctggctggggcctcagctcgcccgggcctgccaggcctcaggtgcccaagggagccaggtcctgtggtgtgcggtctgaagccccacgggacctggtgtggctccccctctggcctcacctggacagctgctccacctcggtcaggaagctctgcttcactgcagtccactccaggtcagcgttctgcagcccccagggtgcggtgggggaaggggcagggaagacgggcagcgtgaggctctcgaagcgaaggccttcgggccaccagtgccacctacccgaggcccagaaccaccaaggggccagggaccctacgccagaatgagggctgaaggagttgtgtggggaagcgagggggaaaggctggagaagtggtgagggttatctgatggccttccagggtccctgccagggtgcgacactcacctccttcagcctcttcacagcatacaccgtgttcctcatcaccgcccggtacacgcacccaaagccaccctccccgatcttgagctcctccgagaagttgtgggtgccccgggaaatctcacagaggggccagcaaaacggaaaggggcgggctccctgcaggagggacactgagctctctgggcctggctgtgggaagagagcctggatcaggtggggtccctgtctcttcccttctgcccaaggctccaggctctccccaccacagctgcctcccagctgacccagcttggctgactggggctctgcgctacatcaaaggctgaattccttcctccttgtctcgaatcttccctggggggcaggggacacctaccttggtagaagaaggggctggagatggcggtggaggccacagggaagcagggcttgggaccaggccgagctcaggccctgaatgggtctgggagcctggaaaagcttcataaagacaccagtgagaggcaggcagagaccagcagcagggtctacagccgtggccgtggtcaaggtgggctcttctttgggtccaccgagcctaacaaccgggccctcttacctggggagaggaaggtggaggctgaggatggcaacttccgggggctccaggcctcggcctcggcgggtgcagggatgctgctgggcctcggggcagtggtgcctggggacggaagcggggcgggagggtgccctgggacgccaaggaaggaaaggaaggttgaggcccgggtgggggagccccgtggggcccgccggcctcccagccgtggggtgcccggagtcccgcgctcacaggctgtgatgatgtcccgcgcacggagcagctgcaggtgcgtgaggatgtgcacgaggtcggccacacgggcgttgcggttgatccagggccacaggacgctggccgtgcgctgcccggagcgctcgcacagccgcagctcggtctggtcgcgcacgatcagggcggctgcggggcggggggcgtcaggcgtcggcgccaggagcccgcgcgcctcccgccccccggcagcccgccgccacccaccgaactggcaccagtcggcgggctccagggcgtccatcactttgtagaagcggcacatgacccagggcggcacctcgtacaagaagtgctgggcgccgggggctgcgggctcccccgggcccggccccccggccatggctgccgccgccgggccgggacctgccggggcctctcagggccgcggcgggcgcgggcctgggccggccgggtccgcg

SEQ ID NO: 2540 - DNA, 9386 bp, Homo sapiens; identical to SEQ ID NO: 2539
  source 1..9386: mol_type = genomic DNA

SEQ ID NO: 2541 - DNA, 9386 bp, Homo sapiens; identical to SEQ ID NO: 2539
  source 1..9386: mol_type = genomic DNA

SEQ ID NO: 2542 - DNA, 5257 bp, Homo sapiens
  source 1..5257: mol_type = genomic DNA
ttcagtgctcccaattttatttttatttaatgctaaaagttaaagaaaaaaaggtactgtaaatctgacaaatgacagaattcaggtgatatttccatagcgtgattttaaaatataataatgttggtatctgagattacactcacttcagttgacatgagtttcatcatatatagaaaaagtatcaccttcaacttaaaaaaagtaaaggttaaaaggtggcacacttttaaaatacttggtggccaaggaaaggtatatagtaaaagttgtaaaccatgtgtatgttctcataactttaaatgtgaggccacatgaaagacagtacatctgttaaattctataaattgttaaaagcaaaaaagggaaagcttcaacaccccatcccctaatattttgagtattaaaagcacagctgaaatattaggatttgaaatctgatactgcccatgtacagtaagtagctttgtgacatttttatccagctgtggagaatctctgcactgtcatcaggtacaacaaaagatcaaacccatgtcccgatgttaactttttaacttaaaagaatgccagaaaacccagatcaacactttccagctacgagccgtccacaaaggccacccaaaggccagtcagactcgtgcagatcttattttttaatagtagtaaccacaatacacagctctttaaagctgttcatattcttcccccattaaacaccagtacagagaaaccacaggttgccctttccacagctggatagacttatccaaaacggcaggatggttctgtattaatctttttggaaagcatgtctgtattaagattgcaaaacatacagatagctaccacaaattaggtcaaacgactgatcaagttgtaacatctgtgaggtcaaattccaaagtgcctagatacacatttatacaacagaccataagagctgaattctttacaaatgtctttatgggcatgtaaaattgactctgcatttctgcatgtgtgcattcacataagagagaccagtctgcactgagtcatatatactccaacttgaaaaagtaagtgtaacaactggttaatcatgcaagtctgtttgtaatataacaatgactggtaaaacatgaattctcgcacagtagtaataggtgcactcattaaaaacactacggaaaaacactgtatttggtgcagtatctgattttcaagtgttagtaacttgaccattaaaaaatagttttgaacaatttaaaaaggaaagacaaacatataactaaaaaagaatccaaagttggtaaaaatctgtattttcaaatgtaaatagaagctaggctgtgaaccatacacataaattgtagaccttgaagccataattcagcctaattataaggccaagttacaaacacctgaacgtaaggatttaaaatagtgttcctgtcaatgttaaatcataacagcacaaaagaaaaaccagtatcactgtgagacaactatttctaataattgatgatttattggttttaaaaaaatcattttactgatgcaaaatagtgatcaaaagaaattagtttacaaaaagacttctaaaaatattttgagaggtggggcctgtctattatataaaacccttaatttctttaatttccactagtttatcatttttttccagaacagtattattcacttggtatttcaaacacatgttaagaaggaaattacaggtttcctccacccacatttgggctgtcactgatatgcccaagggcagtcctggcagcaccacgcggctgttactgtcattgtaccatactgtattcagcactcactagaaacagggtataggtgatagtatcaacagcaatagcactacaggtaaatgataaacaaaacaaaacagaaacaaaaccaatcccacaatctccaagttcacctggactgtaacttctcttgcaactctttcaaaataaaggacaacagcaacaacaaacagacctctagggtgtttaaaaagatgaagtggcgctgcagagctgggctctgctcaaagatggcagtgccatcttgtacacaccaccatccattataaccgccttccatcactggaattgtatcttatgtaaccaactagcatgcagcattgtaatcttacaactgatcacgtggacagtgaacagcggtcaactttgtcttaaaaaaaaaaaaacaaaaaaccccaaaagaccacacaatcctgaaaatttcccagcagcactctcagtcatcagtatctcaggaactgaacttttgagcaaaatagagattcaaaatccactttcctactcctctgaggacaatgtttcagggtaaactggtggtatttcccagtggcatgcccacttgacaacatgcccgttcgatcatttcctttccttctccaccacttggcctccggcctgagaaaggggccagcaataaggaatgacagacagtaaggcaatcttacaatgtcagaaaatgtatttggctttttttttctttttaaaataagtgcatacaaatacagctagaagcatttctgatttgccaagtgctctaaaaaagcagcgcaagtcacagcctacatagaacggtaactgtcaccaggataataaagcacaaagatatgctaataacgttaacaaaagaaaaaaatgtctttataagtacataccttttgtcgtcaaaaaaaatatagaaacacaatgtattcaaaaaaaatcaaaattatacagccatgtttatgaagtctacatttcccttgtcttggatatatatatatatggagatatatatacaattcaagcagttttaattaagggtaatcattgggtttttctgaaaccggaaaagtcacgagtctctctcttttttcactttcacatctccagcaaggatggttgcaatttccccttgcataaaggcccaggggacattggagcccacaagagggcatttttccccactgggacaatagacctctccactagctccctgctgtttgatgctttgtctggagcaagggaagcagaacttgtgcgaagggacggacgggcactgcacaaaatgggtgtcctccagccgctcgtggcagagggtgcagcacagcggggcactggttgccagagaggagtccgggaggctggcagggtgcactggctccagtcctcctgtgttgcctgctccctggccccccacctctctggggcccagccttctttggttcatagaggacggagagggcggactgttgctattcctcctggtagtggagtgaacctggttggcatcttttgaggcatgactgccccctgcattgtctgctactaagatcagggctgccatgggggactggccattctgggccgcttcaggcggtgtggtccggttggaatgaggtgaggcagtgggtggtggcggagacacaaaagaggatgtaggagtcatggggatcttgagcccctctgtggatgtggacagccacggctgggcctctccgttgatcttagggggcccgacttcaccttctggttctggagagggcttccttttccttgctgttcttgcaactggaaacacaaagaaataaaaggaaaaaggtaacataagtggcggtgcactgaaagagatcattctcttcctaacccgaaacaaaagtcgttacagaattcctcctctctaaaagcacagacagaaaatactcatatacgagtttcaggtgcacatgcaacttaaaaccttcaggcgtacgggattctgaggcagcagactgatttaaaatggagccactgaaaatgacacgcttgtaactgcctgtttgtacacatgcacaaaagtaccctcgtttgcactcaacatgtgactgctaatgtcccccaataggttaaaaggtgactggtgccctcatgctcccatccaagaatgtgctgggaaaggaaaaccccgtgtcagagcgtatcagcccagtctgactcatctctgttatgctgcttcagcacatgaacacgttgccaccaagcactggttccgcctcaggcagatcaggaagtggggtgtttgttgtttctgggctggggtaaaatggtgaatccaaagaaccacccttcctctgctctccgtccccttttctcccctagaccccctcacttcacagccgcccctacctgctttagacccgttggccccgttggcctcgaaacccaacaacctgcctgcagtcagggccggctccttcttaaacttgctctcgaagggccccgagtggccgtgctggtgcagcgccagcagcgtgtcgcgcacggtcttgggcctgttgacccagtcctgctctccagacccgcggctcttgcccgcaccttccgcgctcagctcggcggccccggccgcggtggacaggctgtcggccgggccccggtgcgcaggcggcggcggttgtttctccttggctgccgcctcacgctgctcgtgctccacggcagcgctgctcgacacggatgccggccgcttgtgggcgcccagatcggtgggctgcgcggagcccaggctggcggccgcggttccggacaccgcggctaaggaggcggcagcgcggccgccgaggccgagcgcggtgggcagcggcgtggccgagccgttcatgagcggcaccagggtgggcggcaccgcgtggccgcgccgcgggttcgggctctggcgattcagctcgggcggctcctctagcttggagaagccgttgggcaccaggatgccgttcacgggcggcggctgcggcgtcggcggctgggccaggctcgctgccgggcggctgctgccgaagtcagagccgaggcgcgggggcctctcggccgcggccgccaacgggtagcgctccaaggcctgcggcgcgcgcggggccgcctcggggccgccgtggccaagctgctgctgctgctgcaaaaggatgtccttggcggagagcggcggcggcttggcggcggccgaggccgcggcgccgggtggggagcgaccctccgggaagcagccgtgcgcccgcttgagctgccgcgccgtctcgatgacgaactcgacgcggtcggcgccctcgtagttgacgcagccgcggcagacgggttcggtgaagtcccagatcatggcccagggcatgcggggcaggtcacacaggtagcacgactgccgccgggacgcggccgccaccgccaccgccgcggccatgtccgaggagcccgcgacgccggaggaggag

SEQ ID NO: 2543 - DNA, 5257 bp, Homo sapiens; identical to SEQ ID NO: 2542
  source 1..5257: mol_type = genomic DNA

SEQ ID NO: 2544 - DNA, 148158 bp, Homo sapiens
  source 1..148158: mol_type = genomic DNA
gcgctcaggcgcctgcgctttagctgctaactcgctctagtagctgtggtcggggctcgggaccggctgccatcttagtctagggactgaggagtcgccgccgccccgagtcccggtaaacccccgtgggcgaactcggggcagttctcgggagagggagggagtccggatgagaatgttcggggagaacaagggtagaggagtgggacgcgcggttcgggaccccagagccgcggctgctccttcttccagagccggtgtctgtcgggggcgcggggagctcgggctactggcccgggccgggcggtgggggtgggctgtctggacgttcggagggatcagtgtctggcacaggcttccggaggccttcgcctcgcgggctccaagttgtgaaagggctgggccacgacgggcgtgggtaccgtccggcccctcgcccctcagccccgcctggggccactctccagcggttcggcctacgcgcggggcccggcggcggggccggcgcgggcgacgtggccctgtgaggggcggcggccgggtcccccgccacccagctggccttctcgagacttttccgagcccccagtcgctagaagggcccagcacagcggctgcctccccttctctctcccactcgcctcctccttccattgtccccccggcgtggtggtcccggctccggcgccctccccgacgtccgccaccgtcgtggcggcgccgacttttgcagacgtggagctgtcactgcccttcctccggagagtgcccttttctttagcagagaaaagaaaaaagtagccgttgaacgtattctaagggtcgaagcatgatgacatgacttttaagtggagaactcaagttttccaagacagttcccgtccgcgacagaaaagagaatcgcagaatttgtgcgcccgaagtagacgctgggcctaaagttagttggacatgtaaccaggtgaacttgtaaagggccaggaattcattatccccaataacaacgcaaccttgttttcttggttgtattcgtatcctaatcttattacattttctgccattcttccacagctacagtatacttggtttggagtgggggatggggaattgtgggatttttgccttgaaaattagtaagaccctggagccagccacccacttaggtgggttctcctgcatcttttcctgatagaattcgatcttcaggaagtatgtaaaggcagtgtatttccattctcaaaatcggctaaggaatggtttatcagttgaggtgaagttctcatggcagatctgctgagagcttgctatgtgtatttacaggtttatttaagctacgatttatttttaaaattaagaaatgggccgggtgctgtgtgtggctcacgcctgtaatcctagcactttgggaggccgaggcgggcagatcatgaggtcaggagttcgagaccatcctgaccaacatggtgaaaccccgtctctactaaaaatacaaaaaaaaaaaaaaaaaaatcctgggcgtggtggcgcgcgcctgtagtcccagctactagggaggctgaggcaggagaatggcttgaacccgggaggtggaggctgcagtgagccgagatctcgctgctgcactccagcctgggcgacagagcgagactccgcctcaaaaaaaaaaaaaaaaaaaaagcaatgggatgggtgtggtggctcacgcctgtaatcccagcaatttgggaggccgaggtgggcggattacgtgagcccaggaattggagatcagcctgggcaacatcgtgaaaccccgtctctacaaaaaatacaaagatttgccgggtgtggtggcaggcgcctgtggtcccagatactcaggaggctgaggtgggggaatcacctgattccggggggtcgaggctgcggtgagctgttaccgttgccactgcattccagcctgggtgacagagtgagaccctgtctcaaaaaataaaaaaaaaaatttagaaatgaaggtggaaattctactgcttctttgaactgtgaatttaagttttgtgagtccaaaaggaattccattacattcagcatacaggtcaagtcaccaaggatatcatatgaaattaaaaaaatgagtacagactacttcttcagtgtattctagaatcaaacatttctacattctttagaaaaaaatacatctttttcgtttgtttgagacggaatctaactttgtcacccaggctggagtacagtggtgtgatctcggcttactgtaacctccgcctcccgggttccagcaattcttctgcctcagcctccgtagtagctgggactacaggcgcgtgccaccactcccggtaatttttttgtattttttagtagagatgggttttcaccatattggctaggctgctctcgaactcctgacctcgtgatccacctgccttggcctcccaaagtgctgggtttacaggcatgagccgccactcctggccctaaaaaatacatcttttcacttattgggagaggcagacaaaccagtagtccccaaatttgaccattagaataattaggagagcttagaaattccagggtcttaccttctgagatggatttagtaggtctgggttggcttcaaccaatttatttttaacacatgccttaggtaattctgatggtcttgggaaccactgagggcaaatggtactgtagacttaccaaggaaaggtcaaaaagctttgagacgaaagaggaagtggccaattctgtgtgtgtggctgggtggaggattggttagaagaggcaagatttgcccctgaacccacattgggtcttacatgaagagtaggagtgtgaaaagggcggggaaagagaaggacagggtaggctgagtgaatgccttaatgctgtgtgtaaattcagaggattatggaacaaaaagggttcagggagtgtggagtggaatggggaaggagagcattttgaaacgcaaggtcagaaaggttaaaggaagcaagtatatgaaaagtgattttttgttgttgagactgggtctcacccagtcacgcaggatggagtgcagtgacaggacctccagagctcaagtgatcttcccaccccagcctccctgagtagctgggacaacaggcatgcattagcatgcctggctaatttttaaaatttttttgtagagaaaggttctctttacgttgcccagtctggtcttaactcctgtgttcaagtggtcctcccaccttggcctcctaaagtgttgggattacaggtgtaagctactgtgctctggctaaaaattttaagtataatgctaaaaatttggaattttatgttggtagaaatagatacagggctgggctcagtgcctcacacctgtaatctcaacagtttgggaggctgaggcgggtgaatcgcttgagctcaggagtttgagaccagcctgggcaacatggtgatatcccgtctttaccaaaaggaaggaaaaaaaaaagaaatagatgcagatttttcgacagggaaatgatgtgagtacatatgtgttttagaaaattgctgtgtactgcaggacaaagataggtatcaaaaaacaaaaaaagaaagattgctctggtgatgagcgaaaggatgagggactagctattgcagaagtctagttgagaaatgacaaagcctgaccttggagagaggttgtggggatgatcaaaggattggatttagctttttactagtgcaatattgttgccatatttctagatgaggatttttttttagagctaatctgggtaaagggctccttttctgtcaaaagaacccattagcaagtctgaataatattgccaggttatatatgttatgtatagtatgagagtgaattgttcattagcatctttgagaaattagaaagaactatgtcaggtgtaatttggaagagaacttgaagtttgttattgttactatttttgagatggagtcttgctcggccatgcaggctggagtgcagtgatgtgatctcggctcactgcaacctccacctcccgggttcaagcgattcgtgtgcctcagcctcccaagtagctgcctcccaagtagctggaattagaggtgcatgccaccaagcctggctaatttagaacttggagtttggactgaaatttatgcctctaaaaagtattgatctaggcttgttgggagtgtttttctctcagcctgtagaaacttgctcattgagttttagagttgggagaagttacagagattatctagtccataatggcaaatatattttggtttattggccagctctaattggaagctgccagaagcactgtgtttggaaggattctggttgtaggtgctctgagaaattgtattatggttgatcaatgatgtctcctgtggacagttacctagtaggtagtagacatgtgccaaatatatgctattcttagataagtccaatctcttagttttctgttttgttgttgtttgtttgttttaaaggttaaataatttacctgaaactagttaagagtaagaactagaactagaactgggttttgcaactctgggactggtattctctggtttacaaagatcaatgtgcactactgaagagcttctggtattagactagaaaaagaaaagggagatttttagcctatgcgtcttgactgtttaggcaagagtttaacaaggaattttggcctagaagtaagttttgttatattcattctgtcttaagaaatttgtgttagggccgggcgcggtggctcatgcctgtaatcccagcattttgggaggctgaagcgggcagatcacgaggtcaggagatcgagatcatcctggccaacgtggtgaaacccccatctctactaaaatacaaaaaattagctgggtgtggtggcatgcacctgtagtaccagctacttgggaggctgaggcaggagaaccacttgaacctgggaggcggaggttgcagtgagctgagattgtgccactgcactccagcctggcaacaagaatgagactctgtctcaaaagaaaaaaaaaaaaaaattcgtgttagtactgataggaaatagtcatctgttttgttgttttgccactttctttcttgttgcctaagtctctgttttgggttttggacattggtttcctttataagaattaagacaaaagtatgtaaggtttttttttttgtatttatagtacttagccaaattctgggctcataataagcactcagtaaaggcatgttgacttttatggctgtaaatgatactggctttgagtcaatataaattagttagggggttcacagaattgaattgcagcattctctggttgggaggttggctttcagctaaaaacgttaagttggaaactatcctcacaactagaagcagttaaccagaagctgttcctgcctctatcctcctccagtctagcagtgtactgtccttgaaaaactgctgccagctcagcttttttgcttcttttcagaactgactatatccagatccttggtgtgcgttttcttttcctgtccctaggagtctccaagttgcagggactatcattatggtgacccttataggctggtgtatttatatggccatcctcattttgccagatagccgtcatactcagattggtgtcttcccataatacgtatgaatcattttccctcagttctttcttttgtcctgtctgctccattaaaaattgtctatcccatgaaatttttaaaagagactttgtgcttttagagtcgcaaggtcgttgcagatctgatgtgtttaactatagaggtcagctgggtgtggtggctcacgcctgtaatcccagcactttgggaggctgaggtgggtggatcacgaggtcaggagttcaagaccagcctgaccaatatggtgaaaccccatctctactaaaaatacgaaagttagccaggcgtgggggtgcacgcccgtagtgtagtcccagctactcaggaggctgaggcagaagaatcgcttgaacccaggaggcgaaggttggagtgagccaatatcatgccactgcactctagcctggcgacagagcaagactccatctcaaaaacaaacaaacaaaaaaatatagaagtaatgtgttaatggactctccttcctttctcaggtaccatgcatttcacggtggccttgtggagacaacgccttaacccaaggaagtgactcaaactgtgagaacttcaggtatggtgtcatcctgtgagagaaattgggggcaagagtgatgcagaggccaagctctggtcttatacctgctgtgaggagagagcagtgttgatgctagctgcatcagttggttgaacatataggcagcttcacttggttctgaaacccaaagctgcctctgcagggattagcctgtgagccacactgtgctcttaatttgggttttctgacttttctgtttttgtagatcccttatacatatgcatactttttctatttgtgttgttttatacacgtttatctctgtatactatctagacatgtgcatgtgtaggattaagaggtgggtaatgaaaaagaagacaacatggccaggtgcagtggctcatgcctgtaattccagcactttgtggggcgaaggtgggaggatcacttgaacccaagagtttgggaccagcctggacaacatggcgagaccctgactccacacaaaataaaaaaaaatcagctggtgtggtggcgtgtacctgtaatcctagctgattgggagggtgacatgggaggatcacttgagccaggaggttgaggctgcagtaagccatgatcacgccactgcactccagcctgggtgacagagtgagaccctgtctcggaaaaaaaaaaaaaaaaagacaacatggttcagtgcagaaagaatagaggacttggaaagaaaagatctgggttccgatttgattttgccactgacaagctgtgtgactttcggcgagttatttaatcttgccagacctcagtttatacatctgtaaaataggtaagtattgattcctgtctccatccctggcattgttgtgtggatcaaataaaataatacctattaaatctttagaaaaggaaatgaattcatgacttaaaatgttatcttggccaggcacggtggctcatacctgtaatcccagcactttgtttgggaggccaaggtgggcggatcacttgaggtcaggagtttgaaaccagtctggtcaacatggtgaaactccatctctactaagaatacaaaaattagcagggtgtgatgtcatgtgcctgtattcccagttacttgggtggctgaggcaggagaatcatttgaacccaggaggtggacactgcagtaagccaagatcgtgccactatactccagcctgggcaacagagtgagagtctgtctcaaaaaaaaaaaaaagaaaagaaatgttatctagatccacaaggtgagagaagttgagagtagtattgtgaaggaaaacatgaggacaagacagatcactttaaaaggtcaggagagaaggaagactactgggtaagaaaaaaaaagtagaacataaagttaagcagtaagagaatagggagtgaatgaagttgagcaggtgaattgttagataagaaagctgaggctgggcgcggtggctcacgcctgtaattccagcactttgggaggccgaggcgggtggatcacgaggtcaggagatcgagaccatcctggctaacaaggtgaaaccccgtctctactaaaagtacaaaaaattagccgggtgtggtggcgggcgcctgtagtcccagctactcaggaggctgaggcaggagaatggtgtgaacctgggaggcagagcttgcagtgagccgagatcacaccactgcactccagcctgggcaacagagccagactccgtctcaaaaaaaaaaaaaaaaaaactgaataggaagatactggtaaaatagaactaaaatatgatccagcattgccacttttgggtatatatccaaaggaaataaaatcacttcttctttttttttttttttttttttttgagatggagccttccccaggctagagtgcaatggcacgatcttggctcactgcagcttctgccccctgggttcaagtgattctcttgtctcagcctcctgagtagctgggactcgggaggccaggcgtgcacccaccacacctggctaattttgtattttcagtagagacggggtttcaccacattggccaggctgctcttgaactcctgacctcaggtgatctgcccgcctctgcctcccaaagtgctgggattataggcgtgagccactgagcccggtcctgttcttttttataatcaagagaaaggaaggagatggtggaatgatttgtgatagctactataaagcaatttaaaaaatatttaaaagtattattaaagtatttaaaatatctttaaaatatttctcagcatatccatttcatctcaagctcacaaagcagttctttgtggaaaggtatttgagccaacattcaggaaacctgcgttctaccattggtattactggtcacttaaattctgtgatcttgggcagctcacttaaatctccctgggcctggtttcctcacttatctattgaatgttttgaatatgatttctcaggttctttccagctcactctattatattctgtgctttatgtgctaactcactgatttttcatggctttgttgacatcacaatatatgactgatatcagaaatatcttataataaggcttcggccggccgcggtggctcatccctgtaatcctagcactttgggaggctgaggcgggcggatcacgaggtcagaagatcgagaccatcctgactaacatggtgaaaccccgtctctactaaaaatacaaaaattagctgggcgtggtggcgggcgcctgtagtcccagctactcgggaggctgaggcaggagaatggtgtgaacctgggaggcggagcttgcagtgagccgagttcacgccactgcactccagcctgggcgacagagtgacagagggatactttgtctcaaaaaaaaaaaaaaaaggcttcataatgtctgatgctttataaatgagaaaccatgttattttaagttctacttttttttttttttgagagggaatctaactctgtcacccaggctggagtgcagtggcgcaatctcagctcactgcaacctccgcctctcgggttcaagcaattctcctgcctcagcctcctgagtagctgggattacaggcacccgccaccatgcctggctaattttttgtatttttagtagagatggggtttcaccgtgctagccaggatggtctcgatctcctgacctcgtgatctgcctgcctcagcctctcaatgtgctgggattacaggcatgagccaccgtacccggccttttaagttctactttaaacattggcactgagagacctgtaggaaacgtaagtatagaaagtttaagtttgtaatatttgacaaggatctgttgagctgctattgtgctaggttccaaggggtactcaaatataaaactcctggtttaaggattttgtcaggaaaacagacttccttgccagtgattgattattataaaaaggaagttggtaaatgttacaagagtttcattgcattgcaatttaagaaattaagttcagattttttggttcctttaacatgattgaatgtattccttttttttttttttttgagacggagtttttctcttgttgccgaggctggagtgcaatggtgcaatctcagcttactgcagcctccacccactgggttcaagcgattctcctgcctgagtctcccaagtagctgggattataggcatgtgccaccacgcccagctaattttgtatttttactagagatagggtttcactgtgttggtgaggctgatcttgaactcctgacctcaaataatccacctgcctcgacctcccaaagttctggattacaggcataagccactgcacctggccaaatgtattttttttttttttttgaggcagagtcttgttctcgcccaggctggagtgcagtggtgtaatcttggctcactgcaacctccgtttcctgggttcaagccattctcctgcctcagcctcctgggtagctgggattacaggtccctgccaccatggccagctaatttttatatttttactagagatggggtttcaccatattggccaggctggtctcaaactcctgacttcaggtgatccgcctgccttggcctcccaaagtgctggaattataggcattcggcctaacataattgaatgtattttaagtgctgctgtatgctagacattgcagggacttatggtgaaaaagcaatctctgccctccagcaactcgcattttttttttccatgtctggaaattgcttaccctaatagatctatccttctgtcccagaaaagagaagaattttaatactatgtcgtcacttacaggttaagaattcatctacatattgagcttaactcactccagaaatatctactaacttgcttgctttctgagaaaatgtttattattttactggattctgcaaccttttctttgtcagttacaagagaacattttttttttttatttttttttaagatgcagtcttgctttgtcgccaggctggagtgcagtggcacagtcttggctgactgtaatctccgtctcccaggttaaagcgattcccctgcctcagcctcccatgtagctgggactacaggtgcccaccaccacgcctggctaattttttgtattttagtagagacgaggtttcaccatgttggccaggatggactttttattttttatttttttaagacaagataagctccagaaataaccatctgcatttaggtgaactttgatttgcttgttaggccttcattcgtgcaaagaaagagtaggttctacaattttgtcttgattatttttccaaataatcaaatttagttggtcacaaaggaaaggattttagtctaaaggattatattgtaggagttaacagtatttactggagttaggttgattttgaattttgactctactgtgtagtggtggtatgatcttggccaacttgcctaacttctttttgccttagttttctcatctgtaaattgggaatagtaatagcatatatacataggtattatgtgtttctgcttgaacaagacttggctcacagtgtgaagtgttagtcgttgttttcattatcatcattaccatcaaccttatctttcttaaagttatgatctgagttcataaatcattcagtaaacctatttaggctgagcattgtaaatttaaatgcctgcaagggctggatgaacatttagtaagtaatgacagatcagactgggactttaagtgaactagggaattcattcccctccaagggagcagctgttaaagcagctttggcttacaattttttttttttttttttgagacagagtttcacttttgttgcccaggctggagtgcagtggcatgatcttggctcactgcaacctcaacctctgcctcccgggttcaagcaattctcctgcctcagcctcccaagtagctggaattacaggtgctctccaccacgcctggctaattttttgtatttttagtagagatagggtttcatcattttggccaggctggtgttgaactcctgacctcaggtgatccacccgcctcggcctcccaaagtgctgggattacaggtgtcagccaccacgcctggcgtgatttttttttttttttgagacagaatctcgctcttgttgccccagctggagtgcaatggcgcaatcttggcttaccataacctccgctttccgggttcaagcaattctcctgcctcagcctcccaagtagctgggtttacaggtgtgtgccaccacgcctggctaattttgtatttttagcagagacgaggtttctccatgttggtcaggctggtctggaacttccgacctcaggtgatccgcctgcctcggcctcccaaaatgctgagattacaggcgtgagccaccgcacctggccttttttttttttttttttaatggaggtaaaagtaagtatgtgaggttatgtatatgttatttagctcgatttagccattccacaacatgtacatattttaaaacatgttatgggctggtcatggtggctcatgccataatcccagcactttgagaggctaaggcaggaggatctcttgaggccaggagtttgagaccagcctggataacatagtgagaccccatctttattttatttcaataaataaataaaacctgttttacatgataaatatataccttttttgtcaattaaaataatttaaaaatactacttaaggtcttgggaatacactcacaatgtattggtagttaaaatttttttttttttttttttttttttttttttttttaccagttgctgtggctcacttctataatcccagcactttgggaggccaaggtgataggattgcttgagcctcggagtttgagaccagcttgagcaacatagcgagatcccgtcattatatttttcaaaattaaaaaggaaagttttcagaaggttaaaaaaaaaattgaggcaaaattcactactttaaagtgtacaattcagtgttggcttactattgaccttggggagagtgcagaccatgtgcagactgaacatcttaatttttttctaaggagaagctagaaatcaagattttgtaagaaatttttattgttaaatgttggcaacttatgaattcatagtgtaaacactgtgggccaaacaaattaccactgtgggcagaatttgtcttgtggcttgctgctttacaacctctgatctggggcttgactttctgcagcataacccatgttttctgccctctgagaagaaagttcttacccacgtaaagatttaaccagcctcggcagcatggtgaaacactgtctctacaaaaaagcctcataaaaatcagccaggcatgatggtggtgtgcgcctattgtcccagctgaagtgcaagggtcgcttaagcccaggaggttgagactgcagtgagctcatgtcgctgcactgatatcatgtcactgatatgtcactgcactctagtctgggcaacagagtgtgaccgtgtctcaaaaataaatacataaataaataaataaataaaacagttcaaacaatacctcaaagcagtctagtactgaatgagaggtatgtagaataattattaaggcagatagaaggagggaagttagttagttattcagaatatgccaaggtgcagaggcaggaatggacttcagggggtggagtttaattttagaggatttgtgtgagcctggtaataggcaaaagttttgaaaatttgagaagagtcaagcctcttattttgaataaccttgagacctattggctgataggattaaatggtattttgtgaagatttatttggcaaaattgaggtctgtagtatttactatggttggaggcagggagactaggctatggaggtgtcagtgggaatgaaaataaagggggaaaagcttgtataagagacaaaaggttgcattaaagagggccaattttgaaagctttttctctattgacttttgtacaaactgggatatgggaagatactgtgtacaggctatattcctcttttcatgttgtgaatcttgctttatcccttactcagtcccaacagtgtccttgttgatggattacatacgttttcttacgatttcccagcttgcacaagtagaatagaaagaaaaaccaggccaggcatggtggctcacacctgtaatcccagcactttgcgaggctgaggtgggcggatcacttgaggctggagtttgagaccagcctggccaacagggcgaaacctcgtgtctactaaaaatataaaaaattagccgggtgtggtgttacactcctgtagtcctagctacttgggaggctgaggcatgagtattgctggaaacagggaggcggaggttgcaatgagccgagattgaactgctgcactccagcctgggcgacagagcgagaccctgtctcaaaaagaaaaaaccaccaaagtagtgtaattgctcatcacatttcttgtttggggtttttggttatctcggttaacctctggtatatttcattagaccttagtttatacattgaattttcatatttaccaaggtttggaaacaatgacaaatggcttgctcttagaaagatgtagaattttcttgcagaaacttgagataactgatatggctgggcgcggtggcttacacctgtaatcccagcactttgagagtccaaggtgggcagatcgcttgagcccaggtattcaagaccagcctgggcaacatggagaaaccctgtctctacgaaaaacacaaaaaattagttgggcatggtggcgtgtgcacctgtagtcccagctacccaggaggctgaggtgggaggattacctggtcccgggaggtcaagactgcagtgatttacctgtgattgtatcacagtactccagcctaggcaacagagtgagaccctgtctcaaaaaaaaaaaaaaattatgattcagaatgtctgaagaaaccaataaatgtagaaaggtagaatatgttcagcataacctgagaaagtgatttttaggatgttattttctaaataagatttagattttgttctgtttatacttctcatgaaacttttttttttttttaacatacctgggaagttattcctcattcttggccaaatacaaaatgtcattattttagagactatagtctttttcgcaagtaagctgaatagtgtgttaggtatagtctgagtattaagaatatctgagatctgtattaaaaacagatgtaggccgggcacagtggctcacgcctgtaatcccagcactttgggaggccaaggcgggaggatcacctgaggtcaggagttcgagagcagcctggccaacatggtgaaaccccatttgtactaaaaataccaaaaaattagccgggtggggtggtggcgcacctataatcccagatactcggtgggctgaggctggagaattcctgaacccaggaggcagaggttgcagtgagcagagattgcgccattgtactccagcctgggcgatgagcgaaactctgtctcaaaaaaaaaaaaaaaaaaaaaaagatgtaaaaaaaaaaaaagaatatctgagatatagcaaagtttttctcatggatgaataaaaatactgaactgggcctttaaaaaagtacagaaaattgcctgtcatagaaatgcagcagtagggtcaaatgagctaaatctaaatctcatttaatgaaaaaggcactttccttttatttttgaaggatggtctaacctagtttttggaattcatttgttctgcaattaaaagagatttttaggtggttcatttaattatagctgttttggaaatgggaaggaaaataatgtgagagagagattaactgcatttgcttctgtggaaagtcagtagtcaaaaggagagtctggattatttatttatttatctaaaaatatggaacacttggtgaattttaaccttatctttgctcagaggatgtactaatctctgtgttctaattttttagtatatgtgctgctgaagcaaacacacagattatttttttctgttcttaagttttttggaggaaagctatttactataggtcttaattaaaaactatattctgtatatattgaaatgtgcagaaccctgctgctgctgtttttcgttacccagaatgttgcttacatctctctactatcatcttctctccctttgttttagcccttggggtttatgtttttttattcctttatttcatttttttctgaggttttggaagggaatggagaatggggtgtgttcattctgcctggctggttgattttatatagaaattgatgttttcatctctaagggacaaagaaaattaggaaaatatcctagttttatttttattgtggtaaaatacacattacatacagtttaccattttaaatattgttaagtcttcagttcagtgacattaagtacatttaccttgttatgtgaccattaccactatcggtctctagaactttttcatcatccagaactgaaacttgtacctattaaacaataattatccatttcacctcctccctgctctggtaactactattctgttttctgtctctgtgaatttagctattctaggcacctcatcgtaaaagtggagtcatacaatatttgtcctttttttttttttttttttagacggagtctcgctctgtcacccaggctggagtgcagtagtgcgatcttgactcactgcaacctccgcctcctgggttcaccccattctcctgcctcagcctcccaagtagctgggagtacaggcacccgccaccactcccggctaatttctttttgtgtttttagtagagacagggtttcactgtgttagccaggatggtctcaatctcctgacctcgtgatctgcctgccttggcctcccaaagtgctgggattacaggcgtgaaccactgcacccggcccccccccccctttttttttgagacagagtctcgctctgtcaccaagctggaatgcagtggtgcgatgttggctcactgcaacctccgcctcccaggttcaagcaattctcctgcctcagtctcccgagtagctggaactacaggtgtgtgccaccacgcccagctaatttttgtattttttaatagagacagggtttcaccatgttgaccaggatcgtctcaatctcttgaccttcctcagctgggattacagccgtgagccactgcgcctggccaatatttgtccttttgtgtctggtgtatttcacttagcataatgtcttcaggtttcatgttgtaccatatgtcagaattttattcctttttaaatgctgagtaatattccattttatatattttagtaattttttgaaggactgaataggctcaagtacagcaatgacatattttttgttcatttccctgttatcttttttgctgtgaactgtgattttaaatcatgaaattaacattgaactatgctagagatactagttttgggccacatcttctgttctgaccttaggtaatccactttgcttgggttgtttgtcttactcagttgtaagagtttattgtaaattctggatacaactcctttatcagatatgtgttttgcagattttatctcctagcctattgcttgtctttccattttcttaatgatgtcttttttttttttttttttttttgcaaaaatagagatggggtcttgcattgttgcccaggctggtcaaactcctgggctcaggtgattttcctgcctttgcctcctaaggtgctatgattacaggcatgagccaccggccctgcccaagaagttgagtgcaatcaaaattagaaactttgacccttttttaatttatttttgagacagagtctcactctgtcacccaggctggagtgcagtggcacaatcgtggctcactgtaatctccacctcccgggttcaggagattctcctgcctcagcctcctgagtagctgggattacacgtatgtgtcactgcacctgggtaatttttgtatttttagtggagatggagtttcaccatgttggccaggctggtcttgaactcctggtctcaagtaatctacctgcctcagcctttcgaagtgctgggattaccggtgtgagccactgcgcctgtttgaaatttcaactctttagaagacatcattaagtccaggcatggtggcttgcgcctgtaatcccagcagtttgggaagctgaggcgagaggatcgcttgagcccaggagttggagaccagcctggccaacaaagtctacaaaacgaaacaaaacaaaaaaacaactatctggacgtggtggtgtgtgcctgttttttttgtttgtttgttttttgagatggagtcttgttctgttgcccaggctggagtgtggtggcgcaatctcagctcactgcagcctccacctcccaggatcaagtgattctcctgctgggactacaggtgtgtgccaccatgcctggctaatttttttttttttgagatggagtcttgctttgtcgcccaggctggagtgcaatggcgcgatctctgctcaccgcaacctccgcctcctgggttcaagtgattctcctgcctcagactcccgggtagctgggactacaggcgcacgccaccatgcttggctaattttttgtttttttagtagagacggggtttcaccatgttggccagactggtctcaaactccttgcctcgtgatccgccctccttggcctcccaaagtgctgagattacagacgtgagcgaccgcgcctggcgtgtgtgcctgtatgtagtcccagctatttgggggagaatgaggcagtaggatcccttgagcccaggagttccaggctatagtgagccatgatcacaccactgtaccctagctctgtcaacagagcaagtccctgtctctaaaaaaaaaaaaaaaaatggaaagaaatactcaaaacactcaatttctcaattgttttctttaatgaataacgtgtttggtgtcatatctacaaaaatctttgccttactggacaatcagtaaatctttcttagatttccatttgtttacctgtgagaacaaataagatgtatgtggtattttgccttctttggaatagtatttctattctgtttctttttgaatttaatcggaggggctaatcttgggatagaatgctaaggtgaaaatctacagactcaaattggaatgtagaattgactttgctttcataatcctagttgtttcctaataggtaagtggtaatttggttcctctccccttcctagtattgagggctcttggatgtaaactcttatttgtgtcattttattctaggtttttgacacaatctgaataacaatgctttttggctccttttaaggaaaatgcatgaattttgttaataaagtgcatatacatattactcagtgactcagtattgactttcagtttacttgataattcttttttcttttcttgagatggagtctcgccttgtcacccaggctggagtgcagtggcgtgatctcagcatactgcaacctctgcctcctgggttcaagtgattctctgtctcagcctctcaagtggctggaattacaggcgcctgccaccatgcccagctaatttttttgtatttttagtagagatggggtttcaccatgttggccaggctggtcttgaactcctgaccacaagtgatccacctgccttggcctcccaaagtgctgggattataggtgtgagccaccacgctcagccaataattctttttattattactattattattattattattattattattattttgagacagagtcttgccttgtagctcaggctggagtgcactggcatgatctctgttcactgaaacctctgcctcctggcttcaagcaattctcctgccttagcctcctgagtagctgggattacaggcacgcaccgccacgcctggctaatttttgtatttttagtagaaacggagtttcaccatgttggtcaggctggtctcaaactcctgaccttgtgatccgcctgcctcggcctcccaaaatgctgatattacagccatgagccaccgcgcccagtccttttttaaattttttttcagacagggtcctactttgttgctcagccgggaatgcagtggcatgatcatggctcactatagtcttgacctctcgggctctggcgatgctcctgtgtcagtctcctgagtagctgggaccacaggtgcataccaccatgcctgggtagtttatttttattttttgtagagatagtgtcttgctatgttgcccaggctggtgttgaactcctggtctcaagcgaccctcctaccttgacctcccaaggtattgggggtgggattacaggcgtgagccaccatgccagtcttgggcttgatagatttttttttttttttttttttgagacagagttttgctcttgttgctcaggctggagtgcaatggtgcaatcttggctcactgcaacctccgcctccttggttcaagcaattctcctgcctcagcctctcgagtagctgggattacaggtatgcgccaccacgcccagctaattttgtattatcagtagagacagggtttctccatgttagtcaggctggtctcgaactcctgacctcaggtgatctgcctgcctcggcttcccaaagtgctgggattacaggcatgagccactgtcactgtgcctggctgatatatatatgtgtgtatttattattattttttttaatagaaatggggtttcactgggttggccaggttggtctcggaactcctaggctcaagagatcctctcaccttagcctcccaaagtaccaggattacaggcatgagccaccaggactggtctgtaattcttttttttttttttttttttttttgaggtggagttttcactcttgttgtctaggctggagtgcagtggcacaatcttggctcgtcgcaacctctgcctcctgggttcaagctattcttctgtctcagcctcccgagtatctgagattacaggcatgcaccactgcacccggctaattttgtatttatagtagagacgggatttattcatgttggtcaggctgctcttgaactcctgacctcaggtgatccacctgcctcagcctcccaaagtgtttttggattacaggcatgagccactgtgtccggcctcttttttttttttttttttttaagtcaagtgaagcagtgggagtggagaaggaacaaagaaatctgtaactggttgtgatcagttagttgtaaataccagtgcagcagttggaccagccgaggcctgtaattcttttttttttttttttttttgagatagagtcttgctctgtcgcccaggctggagtgcagtggcgtgatcttgtctcactgcaacctccgccttccggcttcaagcaattctcttcctcagcctcctgagtaactgggattacaggcatgcgccaccatgtccagctcatttttgtatttttagtagagacggggtttgaccatcttgggcaggctggtcttgaactcctgaccttgtgatccacccgcctcagcttcccaaagtgctcagattataggcttgagccgccgtgcccagctgcctgtaattctcaaataatgtttagaaatgatctgaggaaagtttgctggaaggatgaggcatggtggatattagggtcttttttttttttttttttttgagacggagtctcgctctgtcgcccaggctggagtgcagtggcatgtcctcagctcactgcaagctctgcctcccgggttcttgccattctcctgcctcagcctcccaagtacctgggactacaggcgcccgccaccacacctggctaattttttttgtatttttagtagaggcggggtttcaccgtgttagccaggttggtcttgatctcctgacctcgtgatccacctgcctcggcctcctaaaatgttgggattacaggcgtgagccaccgcacctggctattagggtcttatattttgagaatgtatagatatttagagatggtcagaaacaagaaaattttttttttttaagaccgagtctcactctgtcgctcaggttggagtgcagtggtgtgatctcagctcactgtaacctctgcctctgagattcaagccattctcctgcctcagcctaccgaggagctgggaccacagtaggcacatgccaccacgtccagctaattttatgtgtgtgtgtgtgtgtgtgtgtgtgtgtgtggttttttttttttttttttttagcagagatagggtgtcactatgttggccaggctggtctcgaactcctgaccttaggtgatccgctcaccttggccttgcaaagtgctgggattacaggcatgaagcatcacctctggccagaaacaaggattccttagagccaggaaattcaacattatatataattagatgtataatttcacacaagcattgtttgcaagagaacaatacttatagtagtacaacaatatttatatttattgtggcaaatgctttaaactctagcagtagtcaaagctagaaacaacttgtaataatagttaattttgaaatgtttgtcagaaagctgtttgtcagaaaggggaagagatcaccttctggaatattaggtacagagttcaaaccagcaaatgaatgctaaaagttagatcctggtgccaatttccttaaattctgtgttcatactgttgaacctcgaaagttgtagcttcctctttttctctttgaacagtataattgtccttttttgcatatgctttagaatccatactgatgtatttggttggaaagtgggaaaggagcttttagtgttctgagatcattgtgtgatgttcagaaccaaagtgtcactgttacatggtagagaatggttcatattctacctccttgttaagtcaattaagtcaatttttcctagtaaatgggaaagcaaccgccttccctatcatgaggggttttgggtttcttcccacttgctttgctgagaaattaaattatggaaatgggtatttaccctctgctccaatctaaataaacttttattccttctaccaataccttcagtagcccatgcaccaaagtcggctcctttgtttttttttttgttttgttttgtttttttgaggcagagtcttgatctctcgtccaggctgtagtgcagtggtgtgatctcagctcatggcagtctctgcctcctgggatcaagcaattctcagcttccaagtagctgggatcacaggtgcctgccaccacacctggctaaggtcctttgtgattattagcagagaatgggatctaaaaatgttcctgtgttccttctagctagtctttgctactgtgcccctagataatgggatctagtttttcacttgagtagtgtttttgggaacatgacagagtagccctgtccaagggagacatactactcggtatgtatttctaatttaccacacatgcttctgtattttatagtaagattgtttgagagtttgacttcattagggtttagttctctgaataccactatatactttagctctttgaactctggactttctgtcacaagcagtttttctccttagtttttttgtgtcttctgaaatgtcattttggtggattcttttaagaaaatatagggctatattaaattacttaaaggttttctaagtcacaatagatgtggcctgtaaaaatatctgattatgttgggtgtgttatttctgaaaataaaccaagcaaatttcacaatatcctgtttaataatttctctataaataagatacatatttaaaataaggctataaatgtttgttgcttaagagacaagatattactgaaattatcttctgaagtatgtctatccctttccacatttttgtttccactgccttttcagtaagatgttaaggttaattttacctctggcagtgttttagcaccttctttctatattgggcattctatctgtcacatttttctagtgtagtagtaaacattactcaaaataaatgatttataggccgggtgtgatggctcatgcctgtaatctcagcactttgggaggccgaggcgggcagatcacctgaggtcaggcattcgagaccagcctggccaacatggcaaaaccccatctctactaaagatacaaaaaaaattagccagatgtcatgcatgcctgtaatcccagctactagggaggctgaggcaggagaattgcttgaacccaggaagcagaggttgcagcgaggggagattgcgcccctgcactccagcctgggcgacacagtgaatgtctgtctcaaaaaaaaaaaaaaaaatttataaagtgctaagtattgacccagctgggcacagtggcttatccttgtaatcccagcactttgggaggccaaggcaggaggacgacttacttgagcccaggagttcgagactagcccgggcaatatagtgagaccctgtctctatctccctgtaaaaaattagatgggcctgtggtatgtggctgttagtctcagttactcaggaggctgaagcaggaggattgtttcagcccaggtggttgaggctgcagtgagctcgatcactctagcataggcaacagagcgagaccctgtctcaaaaaaaaaaaaaaagaccctgttttgagtttctttgtaactgacagactaataggtaatagagttttaaaatattgttactagatttttttttttcttttttgagatggagtctcgctctgtcacccagactggagtgtagtggtatgatcttagctcactgtaacctccgcctcctgggttcaagcggttctcttgcctcagcctcccaagtagctgggattacaggtacctgccatcatgcctggctgatttttgaatttttagtggagatagggtttcaccatgttggacaggatggtcttaatctcttgaccttgtgatccacccgcctcggcctcccaaagtgctgggattacaggcgtgagccacagcacccagccatgatttagattcaaactgtatcttcattggttccagtcacaatggtttacagtgctaagtaaagctatagattgcatactgctgtacttgtgaaggctttttttttttttttgagacacggtctcactgtgttgcccaggctggaatgcagaggtgcagtcacggttcactgctgcctcaacttcctgagttcaagcggtcctcccagtttggcctcccatgtagctgggactataggcatgcaccactgcatctggctaatttttaaattttttgtagagatgggagtctcactgtattgcccaggctggtcttctgaaggcttttagtttgtttgtttgcttgtttgtttttaaatcttgtttgcttgcttttcttttctttcttttctttttttttgagatgaggtcttgctctgtcgcccaagatggattgcagtggccttatcacagctcactgcagcctctacctgctggtctctggcgatctttgtgcctcagcctccccgttaactgggacaacaggcacataccaccacatccagctaatttatttttattttctgtagagacaggattttgctctcacatatctgtccaaccaataaacaaaaaagttatgatactcagggcaaagttttctctaactcctcaaaaggacttgaatttaggacatctttcttactgagacatacaaaggcttaaaagtatgtattacaatccaaaacactcaccactgtctaacatttctcctccaaatgagagcactaatagcctattcaaaagagtctctaattatgaatgtgaagttacaaagaatgtttttttgttcttaggtctatgaagataacacaaaggcaacaagtgaaaacacaatgcataaagtttcactttagtccccttataacagaaaacaagagatgaagataagagcacttttgctgtcctagaacttaaaatgaaaatctaagagagacccataatataaatacaatcatcccttggtatatgtggggattgcttctaggaccaccacatataaccacgtcagtgcatgctctgaagtacgccctgtggaacctgcgtatgtgaaaagtccttcccatagacttgggtttcacatcccatgagtactgtattttcaattggtgttttttatttttattttttattattttttaaaaaattttaattaaatagaaatgaagtctcactatgttgcccacactgctttcaaccttctgggctcaagcaaccctccctgctcagccttccaaagtactgggattacggacgtgagccactgctcctggcctcaatctgtgtgtggttgaaaaaaggctgcatataagtggatctgtgcagttcaaaccagttgttggacaagagccaactgtaattagaattataaaaattgatgccatgctctctgtgtgagtaacaatgcagtaagaatatgcagattttagtcactaattttgacttcctgggaaaggaactgcagactagatgctacaaaagagaaacacttgagggtgaaaaagattaactgtaagaaaatgggaaagagactaagaaatccagtttcttagaaaaacatattcagtagaaacttaggaacagaagtgatgtcttggttggccatgagatagtagatccctacaaccactagaaagtgtccattagggacattatccctttagggtaatgtgcaggtggtcatgtttcagactttattactcaaagtcatgaccactggggaggttagataagcatctttttaaggggttatctatgttacaggcattgtttaaagactctgctgaagaacaccttggtatgcaggaatcaaacattggtcagggccaggcactttgggaggccaaggtgggtggatcatttgaggtcaggagtttgagaccagcctggccagcatgatgaaaccccatctctactaaaaatacaaaaattagctaggtgtggttgtgggtgcctgtagtcccagctactggggaggctaaggcaggagagtcgcttgaacctgggaagtggaggttgcagtgagctaagactgtgccactgcactcagccagggcaacagagtgagactctgtctcaaaaaaaaaaagaaaaaaattggttagcatgatggtttcacttcaagatggcatcactcttgcatgcaacaggcagttttcctacaactgtctttaattctgcagatactctgtcagtctttaaaatgaaactataaattatagattatctacatttatggatgaagaaagtgtggcttagagaaattcagtaatttgctcaagttcacagagtaacagttcaggaatgttgatctagatctgtctgacttcacagttggcatacataattaccatgctataatgtcttctgtaatacatggtatagaattgacaagaataatctttttttttttttttttttttttttgagatgaagtctagctctattgcccaggctggagtgcaatggcacgatgttggttcactgcaatctcagccttccaggttcaacgatcctcccgcctcagcctcccaagtagctgggattacaagcgtgtaccaccatacctggctaatgtttgtatttttagtagagacgaggtttcactatgttggccaggctggtctcgaactcctgacctcaggtgatccacctaccttagcctcccaaagtgctgggattacaggcttgagccactgtgcccagcctagatttaatcttttttttttcttttttgagatggagttttgctcctgttgcccaggctggagtgcaatggcgcaatcttggcttactgcctcccgggttcaagcgattctcctgcctcagacttccgagtagctggaattacaagcatccaccaccacgcccagctaattttttgtatttttaatacagacggggtttcaacgtgttggccaggctggtgttgaactcctgacctcaggtgattcacccgtcttggcctcccagagtgctgggattacaggagtgagtcaccacgcccggcctagatttaatcattttaaccatgtatgcagttgtaaataatagaactaagaatctggcgctcaggggagaggatgggacttgaagtgtggattatctatttttttctactctgttttatgctgtttttaaaattgtacaagtcaacagtgatacatgtcctatttttagaacttcaaacaatacatacaaaactacagttccctatgaccacgtacttgagtacacaggtgccctcctcctgaatggaatgtatactttttctgcgtttatttacaagtatttgtacccataggaatatatagtgttttagtttgcaaaaataatatcatactgtacatactgatggggtgatcattttgtgatctaccccaccccaactcatgcatgttgttctgcagctttaaagatgttcttgggatctctcaatttcagtcattaataagttacttattttgatacctgcatagtaatctgttctgtggtatgaatatgtgatttaatatatgaatatgccaattgataatatacattatttctaatttttttgatattatacaaatagtgatttttattcttttcaagaatttaaaatgcttggtgaattttagttatgtaaaactagtatgtatatgtacataaattattgaaattactaggatgtttttggcagagcacctcacaattctaccataatgattctctgtaattatctggagagtcattgttcttaaaaatgtttgcagtctgtgctttcattaatcttttctacatgaagttaattttagtttttaaaatatacttaatttttgtagagatttaaaattttttgcaactttgtaattaatgttaatttatatttagaataatttatactgtactattagggcattttcttgcaataaattattagtggagatgagcgactgttgatggagatgagtacctttatcatgcagaatatcagcagccagatattggacttttctcactgccccttaatttacttttttaaatattgtcgttctatggcaatcaggcttttggatattgaggaggaagtaataactacataatgtgataatgatgtctttgaggacccttgtccataacaagccatttgaatcagaataatatcttgtgcaatatggtgttaaggcttttaggttacatctcatttctgaatgtattctggatgacttctattgactttatgatgtttacctttcatatttaaaataagagggttcttttagcagattttggttataaaacatctgaaatagtgtaatttaaataaacaaggtaaaggaaaaaaatatatgtattatgccaagaaaatgagctagtccttatggttgagacgaaattttagctttgagcatttttgtatgtaagcacagaatgaagtaggttggattttatagggttcatctcagtaggaattattgttctatttcatttttgcagaattgagaagccatcataattgttttatatttaaacttttaaacagaaacctaaatttgcataaaaactcaagacagcgtttacagtttcaaggcattttgtttgccttattgtatttgtgtacttcttccatagtgcctggcaaacagtaagtgccaagtacatttagtttgattttattttttattgtatcttatttcttcttttttgaggtagggtcttcctctgttgcccaggctggagtacagtggtgtgatcatagctcactgcagacttgacctcctggttggggagtggtggtgtgcaccagtggtcccagctactcaggaggctgaagcagaaggacccccccagcccgggaggcgctccagaacaccccagcttgggtgacagagtgagaatctttctcaaaaaataaataagtaaataaagttgcttgggacatgttatatagatgctatttaaagctatctggataggtaatatcctccagtttataatcatctgtaccccattgcgtgatggggtgatcattttgtgatccaccccaccccaactcatgcatgctaacagttatgtatgccttttctccaatttatctgcctgcgttttgtcagacgattttcagcgaaccttcactgggcaaaggggaagtcttcttttggcccctgtattactaacaagcattgacttctaaatgggtaatttggtcaggtgtggtggctcacgctgtaatccagcactttgggaagtcagggtgggaggatcacttgagcccaggagtttgaaaccagcctgggcaatatagtgagatcctgtctctaccaaaaattaaaaaaattaggcgagcatggtggcacccacttatagtcttacctactggggactgggtaatatcctcaagggaatgagtgtagatagaatagggaaccaagaactaagatctaggatatgttagcgttaagataatggagaaaaggaatcatcagaggatactgagaaggaacaatctgtgtggtaggacacaaacctggagaatatatcttgggaactgaagggaagaaagtaaaacatggaggaggggatgaacagccatgtcagattttgccaataagttaggtaggataaagactagaattgaaaattgtgtttagtaatgtaaaggcctttgttacatggtcttcagtaataaatagccaggttagcactatttatatatgtttttaatgggaatttttgatgtttacagtgtctcctttgccatgttcaggttttccaacctattggtggtatgtctgacagtggatcacaacttggttcaatgggtagcctcaccatgaaatcacagcttcagatcactggtaagttttagaaacatcggctgctttactttatttttccccgtatgattaaaaaataatcctgagagggccaggcatggtggcccatgcctgtaatcccagcactttgggaggctgaggtgggcgggtcacttgaggccaggagtttgagaccagccaagccaacatggagaatacaaaattagttgggcatggtggtgcacacctgctgtcccagctactccggaggctgaggcgtgagaatcacttgactttgggaggtagaggttgcagtgagctgagtttgcgccactgcaccccagcctgggtgatagggtgagactgtctcaaaaaaaaaaaaaaaaaaaaaaacttaagagaacaaaatatttaatggctgttacatgtcaggtgctcaattaatatttgctgaatgaatgaatgaagatatatagatatgtaatttttattgtagaatattcttggatattttacagtttttttttccttcaacatgggtacctgggtagttgctaattatgtttgtttggtattgtattaacagctttattgagatataattcatatcccctacaggttacccatttatttatttacttataacaatgacacaatcatgcagcctcctgctgtggtgactacagtcgtgcaccaccatgcccagcaaattctgcagttttttgtagagatggggtctcactataatgcccaggctggtttcgaacacctgggcttaaatgatcctcccactagggcctgacaaaaggcagataaataggagaaaaggcgtacatcttattagcatgcatgggtaggggtgggatggatcacagaatgattaccccatcatgcaatggggtacaaaatggttatatactcttcttcataggggaaagggagatggggaagtgtggatgattttagagggatggtaaatgatttttaggggaattcagagggctcgaagaatgtacaatggcctgggacaaagtctgtttggcccacagaatagatagtggtttatgacaaaagtctctccaggtccaggtctgttaaaagacttcagtcagccaggcacggtggctcacacctgtaatcctagcactttgggaggtcgaggtgggcagatcacctgagattaggagtttgagaccagcctggccaacatggtgaaaccccgtctctattaaaaataaaaaaaattagctgtgcgtggcggtgcacacctgtaatcccagctacttgggaggctgaggcaggagaatcacttgaacctaggaggcggaggttgcagtgagccgagatcatgccattgcactccagcctgggcgacagagcgagactccatctcaaaaaaaaaaaaaaaagacttcagtttttatattcctgctatacaagtttagttattgaaaactcagggatgggaacaaaggtaattgtaattgttttcttctttggtggatctggacttaggcagataagagaacttcagaaaacaacttcatgctgtactttgagagaaagaagattgagggaggggagctgcaggggtcagagagaccttgagagacttacttagttcagcaagtcaaagcaccatattttgggatatcagtttctgaaccccaaaagtacattcacagagttcagcaaccatcaccacaatcaactttaaaataatttcgtccttccaaaaagaagccctgtactcattagcagtcactctccatttaacccatccatccacaaacccaggcaactcctgatctttctgtctctagatttgcctattctggatctcgcatataaatggaattgtacagtgtgtggccttttgtgtcttctttgggcagactgttttcaaagttcatccatgttgtagcatgtatcattacttaattcctttttttgctaaataatattttattgtatgagtatacgaaattttaaaaatccattcttcagttgagggatgtttgggttgtttccactttttggattttatgaaaaatgctataaacatttgtgtacaagtttttgtgagaatgtatgttttcagttttcttgggtatatacctaagagtgaaattcctaggttatatggaatccatgtttattagcattttgaggaattccaaattattattattattatttttttttttttttggagacagagttttgctttgttgcctaggttggagtgcagtggtgtgatctcggctcactgcaacctccgcctcccgggttcaagtgattctcatgcctcagtcttctgagtagctgggactaccggcacgcacaaccatgtgtagctaatttttgtatttttagtaaagacggggtttcaccatgttggccaggctggtctcgaactcctgacctcaggtgatccacctgcctcggcctaccaatgtgctgggattacaggcgtgagccactgcacgggcccaaattatttttaaaagcagctgcaccgttttgcattcccactagcaatatatgaggattccgatttctctacattcttgccagtgattatcttttttatgatagccattctagtgggtgtgaagtagtattttactctgtgtgtgtgcgcgcgtgcatatgttttatccatttaatttttttttttttgagaccaggtgacagtctgctctgtcacccaggctggagtgtagtggtgcagtcatggctgactgcaatctctaacttctaggctgaagtgatcgtgccacctcagccttctgagtagctgggactacaggcatgcaccaccctacccagctccctattgtggttttggcttgtactcctttgatggctaatgatattgtcttttcatgtgcttattggtcatttttgtatcttttttggagaaatgtctgttcacgtcctttgtttgctattgtaaattaatacctctgtcgctattgttaattaatatctctgtctttatttcttcctctaatcatttcatgtatcactttcagattaatgtttttaatatgccatccaatatgtttcattcctgctcaaaaaccttaggtacttctcttagactatggtatagagtttctttagtatgagctaagacccttcaccctctgtctacatatggtgtctttgtaggttttttgtttttttttgtttgtttttttgagacagagtctctgtcgcccaggctggagtgcagtggtgcaatcttggctcactgcaacctccgcctcccaggttcaagcagttctctgcctcagcctcccaagtagctggggttataggcgcccgccaccaagcctggctaatttttgcatttttaatagagacgaggtttcaccatcttgaccaggctggccttgaactcctgacctcaggatccacccacctcggcctcccaaagtacagggattacaggcgtgagccaccgcgtccggcctgtaagtctttatatgtgaaccatttgtactagctagaatgagtcactggattttcctcagatgtgtatgtatttctatcacacaatgaaaacctcagtctctctccctttaatttgatagcatttattgattatagaacaattatcatcccctgtattttagtttcaactatgcctggcttatagcttcttctggattatgaataggttaggtcacagatcatatcttagcattattattttcctcaaaacctaaaggtgattgaatataaaaataatactgtcttaaggtaaccacatcatagaattttttcggatttccttcactaactctggtatctttccttagcagtatctgtttcttaaagaaagatattactatttcttagttaaggccagattccagttttttttccccacccctcatcctcaatctagcttgagtagctgacttatatcagaccagaattcttatgacttctttttggcagcttaaagttgaaagcttttattagaacagtcctttaaaacattctgtactttttcagattacataagtaatatacattttattttttactgatttaaaaaaatagtaaattattctcagagacaatgattaatagtttttttctttgcataaagtgtcttacttgctatcatcgttattgaattttttttttttttttactgtgatgataaacactaattgcacctcaaaaagtcgtaatccatagccatctcagatttttttctttttgagatggggtctcaccctgtcgtccaggctggtgtgcagcagcgtgatcatggctcactgcaaccttgatctcctggggtcaggtgagcctcccacctcagcctcctgagtagctggaactacaagtgtgcgccaccacacccggctaatttttgtattttttatagagatggcgttttgctctgttgcccaggctggtctcaaactcctgggctcaggtgatccacccacctcagcctcctaaattgcttgtattagaggtgtgagccacctcactcagccacatctcagatttttaaaatcttgggtctaaaatattctttttctttttttttttgagacagtttccctttcgttgcccaggctggagtgcaatggcgtgatctcggctcaccgcaacctccgcttcccagattcaagcaattctcctgcctcagcctcccagatagctgggattacaggcacccgccactatgcctggctaatttttgtatttttagtaaaaacgggttttcaccatgttggtcaggctggtcttgaactcctgacctcaggtgatccacccgcctctgcctcccaaagtgctgggattacagcgtgagccaccgcgcctggccttaaatattctcttttttataaatttttttctttttctttttttaattcattgcttgctaattgggtctaaatattctgagaatgctcaagtgtagggcaaaaaacaaacacaccatgaataatggataatagttcagcaaacattattagatatgaaacagagaacataagataaaagacagaagtgccaagtttaatagaatcaaatgcccttcataattcattgagttacttctttagttttgatgctagaatgcttagaactaagtattttgcacaaatctccttaatgacatcgtgggttttaatctcttaatgggtcagttatagtatttgttttattgtaagctgcctcaatgcctttctagaatcaagtaaggaataaatatgcaagtgtaaaaaatgaatgtcaggctgggcgtggtggctctcacctgtaatcccagcactttgggaggccgaggtgggcggatcacttgaggttgggagttcgagaccagcctgagcaacatggagaaactctgtctctagtaaaaatacaaaattagccgggcatggtggcacatgcctgtaattccagctactcggggggctgaggcaggagaattgcttgaacccgggaggcggagatggcggtgagctgagatcgtgccattacactccaatctgggcaacaacagtgaaactgtctcaaaaaaataaataaataaaataaaaataaacaaatgtcaccatgtattgtaatggcaagaagggataactggtcaggaaaaagagatcagtatttgactagagtcactgggaaagaaggtggtgtttggattgctgctatttatttatttattttaagggacagggttggccgggcatggtggctcatgcctgtaatcccagcactttgggaggctgaggcgggcagatcatccgaggtcaggagttcaggatagcctggccaacatggtgaaaccctgtttctactaaaaaatacaaaaattagccaggtgtggtcatacgtgcctgtaatcccagctactcgggaggctgaggcaggagaatcacttgaacctgggagacagaggttgcagtaagccaagatcgcacccctacactccagtggcacagtcacggttcactgcagccttaacctcctgggctgaagcaatcctctctcctcatcctctatagtggctgggactacaggcgtgtaccacccaccacacttgactaattaaaaaaaattgtgtttttgttttttttttaagacggagtctcgctctgttgccaggctggagtgtggtggcgtgatcttggctcactgcaacctctgactccctggttcaagcaatttttctgcgtcagcctcctgagtagctgggattacagacatgcgccaccaagcccagctgatttttgtatttttagtagagatggaattttatcatgttggccaagatggtcttgatctcctgaccttgtgatctgcccacctcagcctcccaaagtgctggaattataggcgtgagccactgcgcccggccaaaaatttttttttgtagaaacaaggtcttgctatgttgcccaggatggtcttgaactcctggcctcaagtgatgctcccagcctttccataagtgttggaattataggcctgagccactttccctgacctaggattgctgctgtttaaatgcagaaaagtagaaaaggaccctttgaggagacagcatgagcaagacacatgaaagaagagagtacacaaaacttgccctaatacccatgaaagctcctataataggggagccctgagaatgggaatggctgtgtctttcaggtgtgccttaaaaaaaatttattgctaagggagatggagatgggaagtaatcagtgtttgtatcaaagggtggttagatttgtgttttagaaagttagaaagagaaaaaaatttttctttttttttttttttttttgagacagtttcgttctgtcgcccaggctggagtgcagtggcgcgatctcagttgactgcaatctctgcctaccatgcccacccccttacctacttatttatttatttattgaaacagagtctcgctctgtcacccaggctggagtgcagtgacttgatcttggctcactgcaacctccgcctcccaggttcaagcaattctcatgcctcagcctccccagtagctggtattgcaggcatgcaccactgtgcctggctcactttttgtatttttagtagagatgaggctttaccatgttgtccaggctggtctcaaaatcctgacctcaagtgattcacccacctcggcctcccaaagttctcgaattacaggcgtgagccattgttcccagccaatttttaaattttttataaagacacattctcattgtgttgcccaggctggtcttggatgttttgaatcagctcttcgtttcttcttatcatttagccagggtctttaccttggatgtaagtctgttttcttatgtccttccctgtctttatttacctgtttcccatttaattatgcctatatataacctcagctattatactgaactcatctgtgtcttctttttttcttttttttgaccgggaaatttttttttaaattacaagctcaacccatttgttctgtttcaaaggtgcagtacttttcttcatttattagtgaaagaagttaagaaattaactttccaaaaaaatcagcaaatggcaagcaaatgtccttgaaagtcacagtcacatatagtgtctcctagaaaagaggaggggtaagacagcttccacctactttcacaagtttcatcaaatactggatctactcaagggtggagtaaaaaggcaactaactttctaaaaggagtatgttattaaatgaggcatttactatactccttcctaaaagccccagatggggaacatgttttctcaactagacctaggaagtagactgtggaatcaatcggtcctcctcaccttaagggccatccactggttaatgaattaaaaaaaaaaaaaagactgaaaaacaaacctcccccctaaaaaagaggagggggaaaaaaaaccactaagatgtcccagagtggaatcagggagcagcttcaacaattccaattagtctgttacagagtcatccacaagcatgccttgctttaaaaatacatatatatatcttgaaataacaaaactgaaactagtactaatcacttttctgacaatatacaattactcaaaattaactagtactgggctagggatacgggggggcggcgcatagctatgggccttgtctcacatgagtacatgtgggtaggtgcagtgcgtttgtcattatggcaaaaacgaattttaatttttaagctttagtttgacttaaacattgcttttagtatgatgccaacaccagctatgcagaaagggctctggagagatgttcctagcagcacacatatgcagctcttcttcggttctggaggttccagggcagccaatattgcttcgtcaaatacattctttaggcctttctttgtgagtgcagaacactccacgtacttgacagtcttcaggtcatgggccagcttattcagcagtctctggagtgataggcttctgtttgttcttggcaagtttctcaatagtagaggggtcatctttgagatcaatttgggtcccaacaagcaacaaaggagtctttggacagtggcacccacttttctttcacattttcaaatgaaaatggagagatggagagaccactgaaaaatagactagaaatacatctgtttgtggataactcagcagtcataatccctcataatcctcttgctctgcagtatcaaaaagtccaagagtatatggttctctaccagtcataattgttattgcatagttgtcaaaaacagttggtacatattctgatggaaatttgttgtgttgttttaccaacagcaccatcacccacaacaacacacttaattgtctgcattgctgaaatagttttgtatccactttaaatatttcaaatctcatgttgacctcagcttctccaccgggttgttggctcatctgtgttttttatttgatgtttgttgtatgctagcattgggcaaaataaggaaactttggtatttgccagaaatttcttatattctcgtctttactccaaattaagaaagagatgtcatcttgattttagttattattaatcgtaattaaatattactgcatttcccaaatttattacagtgcaatatatttagctctgattgttcagggaccaaaaagatcccttatacttatgttttttttttattcctttaacagtccagcaaactaagaattttatacttgtgatttagagtttagttctccacaggcagggcagagttcttccaaagaggtagctgttgctcaactggattgatctcttacctggttcattattctgcttatttatttagttttggcactgttttttgttgtaccttgttctctgtagcttatccaaagtaggttggataagctacggatccattctttttttgtatgtgtattgtaaaatgtttatgttgtatcagagagatacactgaagaactgaaatcagttcaaagcactgaccttcagaacagaaggatcagaggaacattagtttaagccatgaaaactatttgcattagtatgtgggtatgtgtgagagagagagagcacatgcatgggagagtgagatagccagcaagtgattataataaagcagagagacagagactagaaagcagggaaacttttgttttctaccatgactaataacaatttggttcaacatgtatattaaatacctctcagattaaatcccagagtgctccagaaattgtaaagattggctatatctgtgcaatcaagaggctcacggggtgagttaaatgagtaaaaactagtaagacaaaatgaaaagctgacggagccatacgtaaatatggaaatactctggaagcatggaggtggaaataatttaacttcttaggattaaagaagcctttaatcaaagagaagggggatgtttatctctcaggaaatataattttaatgggtataaaagaaaaaaggatcattctcagtagagggagcagcatgtttagaggaatgaaagtacatggcccatgtgaggaacagcaaataactaagggtggctagaatatagaactttggtaagatttgttttagtaggaggctggaagggtaagttatagctgcatactaagcaaggtaaaatgccccataagagtttaaacttcatttttcaggcaataaagaatcatttaagtaatgacattaatgacatgatcacatctattctaggaaaataattctggtggctgtgaggggttggattggagaagtgagagtaaaaacagttgtttagaggcctctcatagtagcccaggtgtcagatgagactgacatttttctggtcctttttcttccggtttataatgtatagttttttatttttttgtttaatttactgtgggactttagttttcagaaagtagtacattgatttattttatatttgtaatattatgactataacacaaggttttgttcaatctagactttgagatttgaatactgaaataatttctcctgtccaggttttgcagtgtgacccttgggcaaatttttaaatttcacagagcttctgtctttttttttttttttttttttgagatggagtttcacccttgtcacccaggctggagtgcaatggcatgatctcagctcactacaacctctgcctcccgggttgcagtgattctcctgcctcagcctcctgagtagctgggattacaggcgcctgccaccatgtctggctaatttttgtatttttagtagagacagggtttcaccatgtttgtcaagctggctcctgacccccgttgatccttttgactgagacttccaaagtgctgggattacaggtgtgagccaccacgttcggccgcttctctttttatgtgtaaaaattaggacagtaatacctgtttcgcagaataggtattgatattgaaatgacatttacgtgcaggcacatggtaaatactaaaattggtgctcctccacccccatgtaaagtttgttaggccaggcctggtggctcatgcctgtaattccaccactttggtaggcctaggtaagtggatctcttgagcccaggagtacaagaccaacttgggcaacatgtcaaaagcttgtctctaccagaaaaaaaatacaaaaatttcctggatgtggtggcacgcacctgtagtcccagccacttgggaggctgagatgggaggatggcttgagcccaggaggtagaggtggttgcagtgacctgagattgtgccactattctccagcctgggtgacagaaccagaccctgtctcaaaaaaaaaaaaaaaaaaaaaaaggtttcagtggggtttggtaggattatgtagcaaaattgctttcacaaatttgaatccagctgggcacagtggctcacgcctgtaattccaacactttgaggggccgaggcaagtggatcacctgaggtcaggagtttgacaccagcctgaccaacatggtgaaaccccgtttctactaaaaatacaaacattagctgggtgtggcggcgcgtgcctataaccccagctgcttgggaggctgaggcaggagaatcgcttgaacccggcaggcggaggttgcaatgagctaagattgtgccattgcactctagcctgggcaacaagagcgaaactcctatctcaaaaaaaaaaaaaagtttgaatcctagaaagccccaacaggggcagatcatttccttcctgtcagccttgcgttgctctttgttctaggtttaatcagtttcagagtgccacaagaggccctgaaatataatgagtgtatgtataattgtttgggctatttcaccttttcttagaccagaaatgtattaaaagtagaaattttatgtttttctgtgtaatcctgtgattaaatttggctctatattaagcactagagctttgatttaatagtactttttttttattttttattttttaatagagatgaggtctcactgtgttgtccaggctggtcttaaactcctgggctcaagtgatcctcccgcctgggtctcccaaagtgctggtattacgtgcccggcctattacattttaatcagagatagctctggtccccacttgaatattttttattctgaaaaagactttctatttcatgtttccacttagatgtctcagcatctggcatctgaaacaatttttttttttttttaaaagacagttttgctctgttgcccaggctggattgcagtggtgcaatcacagctcactgcagccttgacctcccaggcttaagcgatcctcctgcctcagcctccccccagcagctgggactacaggtgcacgccatcatgcctggctaatttttaaaattatcttttgtagagacgggggtctcactatgttgaccaggctttgttcaaactcctgggcctcaagtgatcttcctgcctcagcctcccaaagtgctgggattacaagtgtgaaccaccatgcttgatcttgtctatttgtctagccttctcttgcaactcttctttttcttcagtcagtcattctgtggctagcttgaatgccagcaaaaaggcacataagcctaaaaggatggaagtatttgatatatgtaaagtcagagtttcagggccaccacctgggactatgcctgcttagatatccagactttggactatatattaagctgctgcttcttttttttttttttttcgagatggagtcttgctctgtcacccaggctggagtgcagtggcgcaatcgcggctcactgcaatctccgcctcccaggttcacaccattctcctgcctcagcctcccgagtagctgggactacaggcgctcgccaccacgcccggctaattttttgtatttttagtagagacagggtttcaccatgttagccaggatggtctcgatctcctgacctcgtgatccgcccgtctcagtctcccaaagtgctgggattacaggcgtgagccaccgcacccggctatattaagcttcttaagtagttactatataaactcctctgacaactccaagggttccttaactttgatgagcattagcattctctgaactttgctgctacagtagataacctgggtggtggagtagataacctgggtggtgggtacttccttggttgtagttacctcatctatgagggagcaatgacttgccacctatggaaatcatggggtgctttgctagatttctacttgttataccctgtaaggggcctggacaaagctattttatggcaaaggtaactaaaaggtgaaggctaaggagtttgtatctcaagatgcacaacataggaagctcttccttagataatatgagatgttaaaaaaaaaatcttagtttgtagttcttattcttccattggctttccaacacacagaataaaatctaaattatcattattattattatttttgatacgtaggctcactctgtcgcccaggctggagtgcagtggcataatctcggctcactgcaacctccacctcccgggttcaagcaattctcctgcctcagcctcctgagtagctgggattacaggcgcctgccaccacacctggctaagttttgaaattttttagtagagacgaggtttcgccatgttggccaggctggtcttaaactcatgacctcaggtgatccacccgcctcagtctcccaaagtgctgggattacagatgtgagccgctgcgcccagctgcagattctttatcttggtttataaagctcccatacaaagcttatctcccttcatttaccattccttcctgtgcttgctatactttccctcagatatgccatactcatttgcctctctctggaatgctgtcttattcccacctccagtcttcccatggctggctccttgtcatttggatggttgcttaaaagtcttctcaaaggccttccttactaccaagtcattttctgtcacatcagcctgtttttcatcataaatactttaattagaatataatctccttgaaagccagatccttttctttactgttaattgctttagggacagagtttagagcagtatctgacacatggtaggcattcagatgtttgttgaccatgtttgtcaatgcatacattttgttttgagatatggtctcgctgtgctgcccaggcaggtcttaaacacctaggctcaagcagtcctcctgcctcagccacctgagtagctgagattacgggtgcaagccaccctgcccagccatatgtgtactttttaaatttttcctcctgttgcccaagctgttgcacaaccatagctcactgaagccttgacctcctggactcaagcgattctcctacctcagcctcccaggtagctgggactggcacacgccactgtgcccagctaatttttttgatttttaggcgagatgaggtctcgctatgttttccagattggtcttcgactactgagcttaggcaatcctcttgcctcagcctcccaaagttctgggattagaggtgtaacccgctgcacctggcccatatgtgtactttttaattgatctgagttctggacttttgataccatggaattctactgatgggaatttgggttgatggtacggggaacctctatatttatttactaggatgggaggaagtacaaaggttatgagtgaataaaattggtaagtattttagagcaaaactgcttctctgagtaaatttagtaaatctgcctaattatgaagttaaattgatttcatgagtgaattaacatctcaactattgaaatgtttttcatttcttttacatagtcatctcagcaaaacttaaggaaaataagaagaattggtttggaccaagtccttacgtagaggtcacagtagatggacagtcaaagaagacagaaaaatgcaacaacacaaacagtcccaagtggaagcaaccccttacagtgtaagcttggaagtatttttctgtagtatgttttgtttagtagatgattggaaatacaatttaaaaaaatgtttctcactttggttttttgttgttgttgttcctcctttctctcttctttttttttttttctttttcctaggactccttctggtttgcttttttgtttctctttagatagctgtttttatagtcactccctttctttaccttctctagtttagttggtgatgatattgctcttgtcactgaacaatagctgaagagagcccatggtcacggacctaaaaagatttctggcagcactttttattaactttgggttgaattaagggattatgagtactccccccccccccggtttttaacttaatttttaaaaatagtgttttagttagttttttctttgttttattttgagatagagcctcaccctgtcacccaagctggagtatagtggcactatcatagctcacagcagccttgaactcctggcctcaagagatcctcctgcctcagcctcccaagtagctgggaccacaggcatgcatcactgtgcctggccagttttttagtattttaaattacggtgccagttatactatagttatttattttttgaatgagatggggtcttgctatgttgtccagagtgctctctctcaaccttcccggctcaagcagtcttcccatctcagcctttttctcaagtagctaggactactactatacattttattctacaactttctttttgtacttaacactaatatcatggtgatctctttacctgagtacatatggatcttgcatcccttatatagctttgtaatattccttaatatgggtggactatattttaatagttctgtattgattctaatgttgcgctattaggcagtattgcagatacatccatgtgcatatatctttgtatgttggtgtttatatctgtagtgtagattcatagaagtaggatatagctcagttttaacacaaagccctaaatgttggcattataatctaagatattgacagccattgaaggttaattttaatttttaaaattaaaatagaagaaaacacatggagccaggtgtggtggctcacacctgtaatctcaactctttgggagactgagccaggaggattgtgtgaggccaggagttcaaaggtgcagtttgatatgattgctcctgtgaattgctactgaactctagcctgggcaatgtagcgagaccctgtctctacaaaaagacaaacaaaaaaaaaaaagaagaaaaagaatgatttggccaggcatggtggctcactcctgtaatcccagcagtttgggaggccaaggtaggaggatcacctgaggtcaggagttcgagaccagcctgaccaacgtggtgaaaccccatctctactaaaaatacaaaaattagctgggtgtggtggtgggtgcctgtaatcccagctactcgggaggctgagacaggagaattggttgaacctggtaggcggaggttgcaggttgcagtgaactgagatcgtgccattgcgttccagccagggtgacaagtgaaactctgtctcaaaaaagagagaaaaaaaaaaaagaatttatggaagatcatcttgaggcccgtatcattcggatgttcctcatctgtgtttatttcaacataaatgtttcttaggctttctgtttttaattaatggctcattgtagattgagtcaaaatgaaacaatgtattaaaaaaatttcaagaaaacacatgaggctgggaatgactgcacatgtttgcaatcccagctacttgggaggataaggggggaggataaggtgctttagcccaggaggagttcgagattaaccagggcaaagtagcgagttcccatctcatatatattttttcctttaccaagtggtatctataaaaggtcgcagcctccatgattaccagagatgttcagttgaattagatggtcacctaatttcctccaactgctttgagtgcgtacttgatatgcacttggaggctcttaagctgttaatgtcatgaacttcttagtgatttaaaagttaagaaaaaaactctctttgtagttctatgtggtagtgctgttcttgattacaaacatttgggaaacttacaattcaagttattttcctgaatttttaagttgcagcaaattggcctggaattttatcacttcccattgtcgtgtagcaggctttccagactgcttttgagaattgaattgaaacaagactgatcatctttgacagtatactttatgtacctttcttccatattaaaaatagtaaagttaaatttatttgccttttatttcatccctattatgatttctaaattgactaatagagaatttcttttttccactctcacccaggctggagtgcagtggcgcgatctctgctcactgcaacctccacctcccgggttcaagcaagtctcatgcctcagcctcctgagtagctgggattacaggcatgcaccaccactctcaactaatttttttgtaattttagtagagacggggtttcaccatgttggccaggctggtctcaagctcctgacctcaaataatcctcccacctcggcctcccaaagtgctgggattacaggcgtgagccattgcgcctggccgagaaatattttcctaatacaatatataatatgagctctcttgaaagtagcatctgagaattttgaaaagaatgaatacattgtatcccctaagaagaggagcagtgtggaatttttagtttgttttatctacccattgccgttgaaatggtgctggttaataggtacaggtagacttcaaaggaggaaagtgtttctttgtcccctcaaacttgatcacattagagagaatgagatatagagaaattcaaacatttctggaatttgtctttatatcattgaaccataggactgtggtagattatatagtgctcctagctttctgatccttgactctaacattgattctacgtgtattgcaaattcaaatttcccagtttactttggaaataccattatagagagtattccttattggcatttagcaaggaatgagtgagtctatatttgatagttggactgggcaacttgcctctagcagtgtgaaacttgatgtatgtaatgtaatcttcaaatcatgtagctgacgtgaggaactttttaatataaagtttaatgtcaggattttattcacattacagttctgctacttactggctatttgaccttaggcaatttgctttatctctgaatgtcagtttctgtatctgaagaaggaagtgataattcccatctcatagggttactataaagataaaataacttcaagctctgtaaactactgacataaggatttaatttgtaaagttactcttctgtactactaaagtaaaactagttttccaatagtttgttgcaggataagcagttttacttttgttgacaatatgtgtatgaatttacttctgtagttcaactgcaagtgaaaatgaccatgtaagcatgtagcattcagataattttcataagattactgaacataggccaatattgattgtatagtaaactgtaaggggtgcagtgagaagactttagactttaaaactgaattgtaatttatttaggatctcattgtgatattcaataaaaataatattttttccctcttttttcacttttagtatcgttacccctgtgagtaaattacattttcgtgtgtggagtcaccagacactgaaatctgatgttttgttgggaactgctgcattagatatttatgaaacattaaagtcaaacaatatgaaacgtatgtatgtaagactaatagaaattgcacttagctgtttgtttttctggaagaaatttatatgtcaaacatgcataatgactcatgttctctcatacttttaagttttacttggttataggatgaacagatagaagaattttacactattgaaagtattctgagtaaccttggtttgaccattcattttggattcagtatttttagtaaatatttatttacttagtaaatagatattagtaaagtaatacatatttaattgtggaaaaactaaaatatagagcagagatgaaagaaaaaaataaaaatcccacttcagagacaaatcaaatgaatatttttacagatttccttttcagatgcttttttttttgggagggacatggggagacaaggactcactctgttttccaggctggagtacagtggctatttacaggtgcagttgcagcacagtgtagttttgaactcctggcctcaagtgattatcctgcctcagcctcctgatatatctgggactataggcaggtaccaccacatccagctttaaatgcttatttttaaaaatgtcctcattttatgaggttgtggttttatttgtatatgtatatttatataatgtagaaatatgtgtagcttgttttaattaatatatcattttaaaacacatttttttctacccctcgactatctaaaacatacttctaaaaattttctcatttaggacttattagatataatttatccttaaattatgtttttactcaatttaattcaggtatatattactaaataatccttattcttatgctagcccattttatactatagtcttacaaggatggaatgaacataataaacgatggagatactattttacatcatgaatatgaaacattagcatattttgtcctttttaaaagatacagtgttttggtgtcaaaagtgttcaaaccttgggtgaaacatagttaaacagtttatatgcacatatagttatattttctcggacatcacatttttaacagttaatttttaacagttaagatgccttaactgggaaaaaagtgaccattttttctgtaactttattttcttccagttgaagaagtagttgtgactttgcagcttggaggtgacaaagagccaacagagacaataggagacttgtcaatttgtcttgatgggctacagttagagtctgaagttgttaccaatggtgaaactacatgttcagaaagtaagtgactacctttttaaggtctttaatgattcttcttaaataaaatagccattgtagtatgctgtatgtaattattttgattttttttttcagattaataaaatgtttttttctggccggtgtggtggctcacgcctctaatcccagcactttgggaggctgaggcagaaagattgcttgagcttggaggttgaggctgctctgagccgtaatcacatcactgcggtccagcctaggtgacagagtgagaccttgtttctttaaaaaaaaaaaaaaagaaatgatttttttctttttaaaaaatagacattgatcactttaaacattttctttttagtgtattatttctgtgaataaaagcatgtatatttttacataagttgaaaaattagccaaatagaagttgaatcacatttgcctccatgagtaatgagttgatttatatagtatttattctgtaggccaactatggcagttaatatgggttagatgccacaccgccaactgtgccaatggcagacagagtttattgtctgtagcagtgtggggctgagtttaaatatgactttaaatccttttttttttttttttttttttttttaagacggagttttgctcttgttatccaggctggagtgcaatggcacgatttcggctcaccgcaacctctgcctcctgggttcaagcgattttcctgtctcagtctcctaagtagctgggattacaggcatgcgccaccacgcccagctaattttgtggggtttttttgtttgttttagtagagatggggtttttccatgttggtcaggctagtctcgaactcttgacctcaggtgatccgcccacctcagccttccaaagtgctgggattacaggcgtgagccactgcatccggcctctaaatccttcttaacactgtaccacccagccattacaagctgagatccatttaccattccccttctacttctgtaggctacacttacagagatatcttttgacaatactaattcattatatgtgtgttagtaaatcttacaatctctgatttactagtgtgtgttaaaggaaaataaactgtggtggcacctgagttagtggctacacagctagcatatttaatagaactttttcctactgttttcccatcagatatttccatcacttcctaatgtgttaagtgtattttcacttgaaacatagattttagaggcctgaagacaatgaaagagcagattaatggatttcttgatgagtttgacgaagatcttttggtttacttaggaactgcattatgaaacattttgcagctgtcaggtgctattctttttctactttgttgaaagacttcctacttcctctttgactcatgacttttaaaaatagcaggacaggctgggcacagtggctcacaccccttgatcccagcactttgggaggctgaggcaggagggttacttgagcccaggagttcgagaccagcctaggcaacataacaaaaccccatctttgcaaaaaataaaaaaatttgccatgtgtgtggcacgtgcctgtagtccaggtacttgggaggctgaggtgggaggatcacttgagcccaggagtcagaggttgcagtgagcgaagatcacaccactgcacttccagcctgggtgacagagtgagactctctctcaaaaaaaataaagtagcaggacctaatatgtcttccagattagttctctggggctagtgaggatggaaagaaatttctgaaatggttatactgatttggagttgacactttgattattgttcacaagaactctataatagtcacatttttctatacataaattggaagtctggaagataaaatacaagttacattgttaaactgccctaaacctcagtatttatagtgtcctaagcttcgcccatagaagatgaaactattactaatgtaaaatatttaataattgctggacgcggtggctcacgcctgtaatcccagcactttgggaggccgaggtgggctgatcacgaggtcaggagtttgagaccagcctggccaacatggtgaaaccccgtctctactaaaaatataaaaattagcctggcctggtggcgagcacccgtaagcccagctgctcgagaggctgaggcaggagaatctcttgaaaccagaaggtggaggttgcagtgagccaagatagtgccactgcactctatcctgggtgacagagcgagactctggccaggcgtggtggctcacgcctgtaatcccagcactctgggaggccgaggcaggcggatcacctaaggttgggagtttgagaccagcctgaccaacatggagaaacctcgtctctactaaaaatacaaaattagctgggcgtggtggcgcatgcctgtaatcccagctactcgggaggctgaggcaggagaatcacttgaacccgggagttagaggttgtggtaagctgagatcatgccattgcactccagcctgggcaacaagagcgaaactgggtctcaaaagaaagaaaagaaaacagttataacaatatactacaataaaagttttatgaatgtcatctctcagtttcactttcactccaaaaatacctcatttttttagctttgtttggacctttggggggaaaaataccttattgtactcacctacttttggaccacagttgactgtgggtaattaaaaccatagctaaggggaggcctactgtacttacagacacatttttggttctttctttttggtggataaattttctaaaaatggcagttatataaataaactttttccaagtgaaacaaagtgtacttgttttttctttttctttaagttgtattttaaaactagctggctttatattcccctactttcaactagtttaatatctcgctacaagtctcggttataatgttttctttacataatttgttatggtgttttccttcaatgaagtacagagttaatctgctttcatgagtctctaggaagaggtcttcctagacctcttcctagctttttttttttttttgagacggagtcttgctcttgtcacccaggctggagtgcagtggcactatctcagctcactgcaacctctgcctcctgggttcaagcgattctcctgcctcagcctccagagtagctaggattacaggcatctgccaccacacctggctaattttaatttgctatttaggtagacttttttttttttttagatggggtttcgctctgtttgcccaggctggagtgcaatagtgcgatctcggctcactgcaacctctgcctcccgggtttaagtgattctcctatctcagcctcccgagtagctgggtttacaggtatgcaccaccacgcctggctaattttgtattttttagtagagacagggtttctccgtgttggccaggctggctttgaactcccgacctcaggtgatccgcctgcctcgacctcccaaagttgctgggattacaggcgtgagccactgcgcccggctgacttttttttttttttttgagacggagtatcgctcttgttgcccaggctggagtgcaatggcacgatctcggctcactacaacctctgcctcccgggttcaagcagttctccttcctcagcctcccgagtagctgggatgacaggcatgcgccaccatgcttggctaagttttgtatttttagtacagatggggttttaccaagttggccagggtggtgtcgaactccggacctcagttgatccgcctgcctaggcctcccaaagtgctgggattataggcatgagccactgcgcctggcccagctttttttttttttttttttttttaaaggttgacttattcttatagcccacagatctgaagtaacaaatcaggtgtgggcagttcatatctgccagaggttctcattcatctttttttttcttttcgtgggatggtttttttggtgagttgtttagtaccagtcttcccatttatgacctctaacaagaaacacagaaaagtattattgccaaagactaatactagttttcctaaagagaaagaaaaatgcattttactttcaactttttttttttttttttgagacagggtatcgttcatttgccaagggtggagtgcaatggtgtcatcttggctcactgcaacctccgcctcctgggctcaagtgatccttccacctcagcctccccagtagctaggactacaggcgcactcagccacacccagctaatttttgtattttttgtagacaggttctcactctgttgcccagggtggtctcaaactcctgagctcaggcaatcctcctgcttcggcctgccaaagtgctgggtttataggcacgaaccaccactcccggccacttttaacttcctgattataaaataggaacatagtcttgtagagatctttactttttatcatgtatactctggatgtgtttaaaattaatttagggagagtttttggaatatgtgacttctggttcttattctatgcattccattccttttaaattttgatgctttgttatgttaggctctagtttttgtagttccgcttaacgttagggtaaaccattttcatatgtgaatatattgataatgtttcttactagaataataaattctaagaaagtagcctaaattttttgctttaccaaatattatttgaagttactagatctcaactggtctgggtaccaactaattttatagagataaactttgctgtaatgttagttttaaaaatttgacttacatttgaacatacgtctatgtatgctcagaatattaaataatttacttccccacaaaaggtagtaaaactcctttctttctttttctttttttcctttttttttttttttttttgtgagacggggtttcgctcttattgcccagactggagtgcaatggcgcgatctcggcttaccgcaacctccatctcctgggttcaagcaattctcctgcctcagcctcccaagtagctgggattacaggcaagcgccaccacgcccgactaattttgtatttttagtacaggtgaagtttctccatgttggtcaggctggtctcaaattcccagcctcaggtggtccatgtgccttggcctcccaaaaagtgctgggattacaggcatgagccaccgcgcccagctgtaaaactcctttcaacatgtatgttatgtttttgtcttactttatgagaggtactgtaaaaattgaagtattgaggctatgatatggtcattgtgaatttcagtgaagactactgtgttcttcatttttacaatttacaaagcccgttgttatatattctcatatttaatatgtgtaagatataaaataaaatgagcatccctgaaactatcacacagcttaagaattagagtattaacaatatcattgcatccacctgtatttttcttcctatattattcctttcctttcctttcgagataatcactattctgaactttgaatttgtcatttctgtggtctttaaaagttttatcctatgtgtgatatataagcattacttgtacgtttctcttgagctctatgaaaatatcagtgttgccttttttttttttttgagacggagtcttccactgttgccccggcttgagtgcagtggcacgatcttggctcactgcaacctccttccgggttcaggcaattctcctgcctcagcctcccgagtagttgggattacaggcgtccacgaccacactcagctaattttcagtgttgcctttttctttttttgagacggagtctcactctgtcgcccaggctggagggcagtggtactatctccgctcgctgcaagctccgccttgccggttcacgccattctcctgccttagcctcccgagtagctgggactacaggccttttaagatttagtcatataattgtgtccgtaggccattcacttttactgctgcatagtaatctgttgagtgaatgtaccgggttttaagatttttatatcaaaggacatttgcttagctttttttttttaaaccatgtgaacagtgatacattgaacatttttgcatatgtttattaataaacagatttaacgtttatgttgggtgtatgcttgagagtagaattgctggggtatgtttattttcagctttacaatattaattgcttcttcaaatatgctattaggatatttaaaactgagatgaaatttacataacatacaattaacggttatataaagtgtacaccttaatggtgtttagtgtattcacagtgatacacatccaccatctgtctctagtttcagatctttcttgtcaccttagaaaaaaaaccccatttctttcttctcccaagccgtgataactgctaatctgctctctgtctctatggatttgcctattcaggatatatcacataaaaggaatcatgtgactttttttgtttggattctttacttagcataatgaatttgaggttcatccaagttgtagaatgtgtcagtacttcctttcttcttatggctgtatgatagttctactgtgtatatttgtgccacaatttgtttatccattcattcattgatagacatttggcttatttccatttggctgttatgaattataaataatgctgctttaagcatttgtgtacaaggttctgtgtagaaatatgttttcatttcttttggatatatacctaggagtagaattgctgatgcttgtttttgatagtttctcatttcttccttgtaattttttttgatacataggaattttttttaaaacattctccatttgataattccagtgtctgaaatccttgggtatataaatggttttttgtctcttcctcattgaggtttgttttcatttgcgtttgttcttcgattgcaagtttatatttgatcttaatctgttggaatcttaagggcctaaattggggattctttgccccagagaacatttcttttgcttctgctagttgctagggtgtaccactgaactgggaacgcttcaactcctttcctacctgtgtatttgtaaaatggatcagacccttgccagcctaatgtggcaggctctggttcagcaccacaggtttgctgctggcccaaggctttctaatccatctgaggattgaaaatggccctctggataacccagtttttcacatttgctcactgcatacttgtgtctgttcactttgtttttttatttttgagacaggatctcgctgtgttgccagactagagctcagtggctattcacaggaacggtcatagcacactgcacctttgaactcctggcctcaagcagtcctcctgcctcagctttttgagtagctgggacttcaggtgctcaccaccatacctggcttcagttcacttttttgtttttgagattgctagacacccaagaaataggaacgatgtgttaaaacgctttatctaggagctagttattttgtggtgggagggcaggtcattttgacgagcttactgagtagaagagatctttgtagatcttccaaagtttcttgtgggtaaaacatgtgcatttagcaatctgacaaattttcttgaggaaatttggattgggaatacctttaaagggcaatacgtttgtaaaatgcagtggttaagaacaaccattgttctcttcttggacgttcattgtataagtgttagatttttgttgttgttgttgttgttgttgttaactattctctggttgtaagcagaggataagatctaaataatttatgccatacatttcatagttatggcttcactttatattggagtgaaataaaagagtgaatattccaggcatggtggctcacacctgtaatcccagcactctgggaagccaaggcgggaggatcacttgagtccgggagtttgagaccagcatggacaacatggtgagactccatgtattcaaaaaaatctttaaaaaatgtagctgattttgtggtggcatgcatccatgcatcctcccactttgggaggctgaggtgggaggattgcttgagcctgagaagttgaggctgcagtgagctatgaccatgccactgtactccagcctggacaatgcatcaagaccctttgtcaagaaaaaatatgtatattgaaaaatggcccttgtttagactttcctaatgagatgtaaattttgagaaataatagttattatttatggactgcttatatgtgctagcactgtgctaaatgtttacatgtttaattcttataaatactctatgaagtaggtgtcatccccattttatatatgcaggaaaagtacaggaagtcaagtgtacttttgtaaggtcacaaagtacatgataaagctaggatacaaacctaggcagtctgccctcagaactcatgtgattaaaatactgttctttgtcactgtagtgagaaggttttagaagtagcaaataatggtagacttaaatggattattcctaatgattttcttaattttgagaaaagtgaaatactaatagacacattttagtaacttatgctggatattttgttgtggttttctgatttcatttatgtcccattcataagccattttaggggactatattccatattaaaacattcttaaactgaaatttaccctttatagccaaaatgtatttcattgtaccattttttttttaccacattaacatctttattgagttgtattttatacaacataaaatttacccatttcaagtgtacagcttaatgaattttagtaacttaagtgagggattcaactatcactgtaatttaggtttaaaacatttttatcccctcagtaaaatccctcttgcctgtttacaggagcttcccttctcactgtcagccacaggcaaccaccactaatctgtatttttttttttttgagacggagtttcactctgtcgcccagggtggagtgcagtggtgtgatctctgctcactgcaacctctgcctcccaggttcaagtgattctcttgcctcagactcctgagtggttgggactacaggcgcccgccaccacactcagctaatttttgtatttttagtagagatgaagtttcgccatgttggccaggctggtctcaagttcctgacctcaggcaatctgcccaccttggcctcccaaagtgctgggattacaggtgtgagccaccacgcccggcctctattttttatctctaaaaattcgtctttttctggacatttgtataaatggaatcataaaatatctgttttttgtgtctggcttctttcacttagcataatgtttttgaggttcatccatgatatagcgtgtttcattagtttgttctcttttattaccaaatagtaataattccattgtatagacaacattttattcacatactatttaaagataatatatttctagactggatgagacatttaccaactttgctaagtatggtatagtatagtggtgactcagtattttttaaattaatccaccaattatgcttttttgtaatatggtaataatttccctgtttaaactatgattctatccagggcctattgttcctttactaaatggacctaggtggtcgaacttgagttcttgtttctacatgtgatcatttttctttctctttccctgtttaccatttgttttgcttctttaaatgtacctacctttagcaccctccctccaacacttttcttttttttgagacgggagttttgctcttgttgcccagactggagtgcaatggcgcgatcttggctcactgaaatttctgcctcccgggttctagcgattctcctgcctcagcctcccaagtagctgggattgcaggtgcctgccaccactcttggctaatttttgtatttttagtagagacaggttttaccatgtaggccaggctggtcttgaactcctgacctgaggtgattcgcccaccttggcctcccaaaatgctgggattacaggtgtaagctgttgcacctggctcctccaacactgttacagtaaaaagatctggactgaatcctaaggatattttccatcaataaagcaagaagaaaataagaatattgtggcattaatttttggcaacttggattcccatttgtggctttcctaatttttaagctgttttccaggcccctgcaataagagagacgttatgggtttttctgtttctggaatcgattttattctgctggcgatcagcacttttttatgaggtatttgggatacaaagatggttaaaacactaggtttaaattagagttagacatatttcaaaaaaaaggcaggaatagtagtgcatgagtaatatacctttagtaattaacatcccgtatccattaattattaagcatttgcacaaaattttggcagactttttttgcagtcatgaaaatcacatttttccttttaaagtcatgttggaatttaagttatagtatgttctttattacaaagatttaataaaaggctttgcttacatggcatgtttagaaaagaaaaaacatgaaaactactctcttgaaactcattttctgtttaaactttgatgttaaaggtgcttctcagaatgatgatggctccagatccaaggatgaaacaaggtaagcattcactgattgcttaccacagaatgcggagagatagatttcctaaatattcattttagtgtaaacttcaggttcatgatataagaataaatgagtgtcagaaagaattcagaactcaagaagggaaatatttgcaaaagattgaagactcttagcttatcggattagagctatctggagtgggctagggataaccaaattgttgatacttcttcagcttgtagaaaataaatatactggcaccttttcagaggcagggtgttctaaactccagagccatcattgggctgttaagtttcttttccagaaaaactgagataggagctttacacatatgtgaaggtcaccactagctatggtatcatctgggccttcattagaaggggcagagctttgtaccagctgtttgctgttagcccaggtttagcactttcatgtgcctatctgcgttcaagtttggacctaaatgtggggaaaagaaagaaagatcagtttgttactgtgtctatgtagaaaaggaagacgtaagaaactccattttgatctgtactaagaaaaattgttctgctttgagatgctgttaatctgtaactttagccccaaccctgtgctcacagaaacatgtgctgtattgattcaaggtttaatggatttaggtctgtgcagaatgtgccttgttaacaatatgtttgcaggcagtatgcctggtaaaagtcatcgccattctccattctcgattaaccacggacacaatgcactgcagaaagccgcagggacctctgcccaagaaagcctgggtattgtccaaggtttccccccactgagacagcctgagatatggcctcgtgggaaaggaaaaaccttacatcctccagcccaacacctgtgaagggtctgtgctgaggaggagtagtgaaagagggaggcctctttgcagttgagataagaggaaggtttctatctcctgctcgtccctgggaatggaatgtcggggtgtaaagccaaccattcgttctattctgagataggagaaaaccgccccgtggctggaggtgagatatgctggcagcaatactgctctgttactctttgctacagtgagatgtttgtgtaaagtgaaacataaatctagcctctgtgcacatccagacatagtacctttccttgaacgtattcatgatacagattcctttgctcacatttttccctgctgaccttctccccaccatcaccctgttgccctgccacactcccctcgccaagatagtaaaaatagtgatcaataaatactaagggaaatcagagaccagcgctggtgtgggtcctcacacgttgagcgccggtctcctgggcccactgttctttctctgtactttgtgtctgtgtcttatttcttttctcagtctctcgtctccacctgacgagaaatacccacaggtatggaggggcaggcccccttcatctaaaaggtgttgaaagccttggactatgtgaattaacttagactgcttattggttatcctggaaatcggtaacagcagataaaattaggaaaggagatgattctgcttttaaagtagtgagtggcatgtcttaaccacagagtgcagtgattataaaattccatttgattctttgtttttctcaaattgcataagcagtgagtaggaagaagatgatgaaccacaggaggagtagtcagaaggggagaagaacgagaaaagtaatgtcacagactgtgagggaaaattatccacaaagatgggatgttacagtgtcagatgctgcagaggaggataggtgaagaaagtagaacaaaatactgatggttgttgaagctgtgctgttaggtacatgggagtttattgtattagtctatctgcatttgtcatctatgggttgttttttttttgttttgtttttttgtttttttagatggagattcactctttcacccaggctgaagtgcagtggcgcgatctcagctcactgcaacctccatctcccgggttcaagcgattctcttgccttagcctcttgtgtagctgggactactcaagacaggcatacaccaccatgcccggctgtttgtatttttagtaagagatggggttttgccatattggccaggctggtcttgaactcctgatctcaagtgatctgcctgccttagcctcccaaagtgctgggattataggcataagctgccatgcctggccgatagatatatggaagttttttggtttttttttttgttttttgaggtgttgtctcactctgtcacccaggctggagtgcagtgacacaattttggctctctacaacctccacctcacaggttcaagcaattctcctggctcagcctcccgagtagctgggattacaggcacccgccacgatgcccagctaattttttgtatttttagtagagacggggtttcaccatgttggccactatggtctcattcttctgacttcgtgatctgcctgcctcagccttccaaagtgctgggattacaggcatgagccactgcacctggccaatatatgaaggttttcataataaaaagttaaagacaactcatcaagatctttaggaaaatcaaagtttataaagctgttgtgtcttacctaataggtatctgctttcacattcttatgatgaagaatcatctatactaatctcacgagatgtagaatattaaggagcagtaacttcttgcctagaaaatagcagatacttttattctttactgtgattaaaatcaatggggccggtcatggtagctcacacctgtaatcccagcattttgggaggccaagacaggaggatcacttgagcctaggagtttgagaccagcctgggcaattgagtgagacctcatctctacagaaaacaaaacaaaacagaaaaattaaaattaaaaaacggtagttaggcctggtggcacgtgcctgtagtcccagctgttggagtggggagggtgcccaaagtgggaggatcacttgagctggggagatcagtgagctgagatcgtgccactgtactcagagtgatgacagttagaccctgtgtcaaaaaaaaagaaaagcaataggacaggtttaaaaaattacataaatatctgtagactgaatactattatgtctcttttgtctttttttagtattattatatttagtagaagatttcttgaattcctgaaagttcccgcataaaatgttttagtatttcagtttgctttggtcatttacctcttcttttacacaataaacctgtatctttgtataataagtgggtatgtaaaaggttctgttatgccagtgtgttgttgcttgtttgttttctgcaagtctctttcttaacagtattttcatcaaaccacttgtactctggacatctttaaatttattataaaggcattgctggatcccctacttaatgctatttaatcaatgctttttatcttcctaagtgaatcattgtcataaataatttggggaacaatgtcttctgggtttctgagactgcctgacaaatctttgagtatgtcttttgtgttaagcataagttcctgtgcatcagcttttattccagagcacacacacctttgagatgacaggtttgaaaagcattttgtaaactgtcaaaagctgtttaaatgttactacacaataatgagtagtagtcatagctgtgactgccttttctcctttgcttttgtttgcagatttcatgactataaaactaaaaggcagggaagtatatatgtagtggacaggtgcttcgcatccttccctccatcctcatagttatcgtttaggaagtttactaatagccttaggttattttagcttttgatcttaattcaagcactgtctgtatcataaatgtgtttattgatctgttttccccacagcatgtctggatgttttatgtttctcagtgttgtcttctgtttatttgtttatttttatgaagtaccaagattattggtgcctgattttcaagattttgtcgttagatgtgcgttctttttttttgtttttaagtttattattatattttaaagacaggctctcgctctgttgcccaggctggtctcaaacttttcacctgaagcatttgccctatctcggcctcccgaagtgttgggattacagacatgagccaccacgcccagcacatgtgccttcttgattgttactctttgatttgaacatttatgacctgattgtactataatagcattttggttgtctgaggttctctatcctgtccataacttatgaacttatttataggtcagatgtatatgtatgttgaaattagcagatgtttgtaagattgtggaataggggaacaaagttatagtagcacataattagcagctaattgcttttctttttttacttttttgtttgagaccgtgtctcgttctgttgcccaggctggagtgcagtggcgtgatctcagctcactgcaacctccacctcccggattcaagtgattctcctgcttcagcctttcaagtagctgggattataggcatgcaccaccacgcccagctaattttttgtatttttagtagagatgaggtttcaccatgttggccaggttggtctcgaacttctgacctcaagtgatctgcccacctcggacctcccaaagtgctgggattataggtgtgagccaccatgcccagccagctaattgcttttcaaagccaattggtggtgttggttccactgacaattctgtatactgtatagatttccggattgattttcaaaatctatttttagttttagcctcacactttactaaaataacttaaacttattaaaataaataaaataaaccgccagtactattttagtatggccctgcttctcaaactttagagcacattagaatcacctggttcattagatttggggtgggactcaagatttgcatttctaacacatttccatgtgatgctgatgctgctagaccagggtctacattttgagaacacaatggttagacacacacgtttttgcaaattataactattctgggaaataataacagatagtaaaaacagacttcttatataatttttcattatataagaagtctgtttccccaaagtccgagcgtgcagaatttgctagaactgtcaatctgtcttaatttcatacccttttgagagctgctttgaatcttgttttttttgaactgttgtttttatgtttattattagaaaataatacgattgttttaaaagatgtaaattaaatagtgtgtaaagtaaaatgtataaagccttaatagaagaaataatatttgacctaagaccttaaaacagagctataaactgtatatgcatgtcttagaggaattggagggaagaaggaattctaaatggaaagaagaaaaacaaaggtggtgagaaacacaggttgttttgtaggaaatctttaatcataatatttggctaaaggtgcagtaatttcaagggagaaatggcatttggtgattagaaagtagaatcagtcaatatatatttatttgcctttatatgatagacactatgctcaacatgtctattcttccttcagttagtccttaaacgtttatgagttaggtactattgtctcatttttataggtgatgagaaaacaagcttagaaagggaaaggaacttgcttgagttaatagcgttaagtgggacagttgaacctggaacagccttaccttcagagcctgagctcgtaactatcatgctttactgccacctgaagttgggatgatatacaagtaagtgcttagccattaataaatgttatttttattgttagataggttgggaccagatggaggtttgcaagtaaagacttacggaattttttttttttaaaggaaaggaatgtcttttaaaataatttgattttgttctgttttgttttgttttaagactgagttttgctctgtcgcccagatgggaatgcagtgacgcgatctcggctcactgcaacctctgcctcctgggttcaagcagttttcctgcctcagcctccgagtagctgggattacatgcgtgcaccactagacttggctaattttttgtatttttagtagagatggggtttcaccatgttggccaggcttgtgtcgaactcctgacctcaggtgatcttcttggccttcttggcctcccaaagtgctgggattacaggcgtgagtcaccacgcccagcctaaaatatttgaacaggagattgtatgatcagaactctgtaggaaaaaatattttgacagtggtatatagtttggattatgtggtggtgagtgaaggttgaaagtcctatatggaaatttgttacaataatctattgagaggtaacgaaggctagaactgaggcaatgatggtggaagagtagagggagaatgtgaaagtgggatcaacaggacttagatactgagtgtcaagaggcacagggaggaaaaatgtaaaattgcctgggaaagacagcagtatcgttcatagaaccaaaacctaagaaggaaggaagaccataggaagagaatgtttagagggacgggaggacctggcagggcatggtggctaacacctataatcccagtgctttttgggaggcccaaggggaagattgcctcagcccaggagtttgagaccagcctgagggacaaagcgagaccccatctctacataaaataaaaaattagccaggtgaggtagcatgctcctgtagtcccagctactcaggaggctaaggcgggaggatcccttgagcccaggagttcaaagttgcagtgaactgtgattgcgccattgcactccagcttgagtgacagagcaagactcttgtctttaaaaaaaggaagaaagggagggccttgggatgggagagttattctagatctcctgcatttagttgataatttgatactagaggatgggagtgagataaagagtagagattgatttgggaatcattctctgagataaccttagaaatcatggaatttgagatcctagggaaaaatctgtggagaaagaaaaggagaacaagaacacaatcatagagacctatatttagtggatggtaggaagaggacaaaccaaaaaagggatgatgagaagtgggagtacaagattacaaaagcactgtcacagaaattaagagaaaaatgttctttaaaagatgggacatttggccggtggcggtggctcactcctgtaatcccagcactttgggaggccaaggtgggcggatcacttgaggttaggagttcaagaccagcctggccaacatggtgaaaccccatctctactaaaaatacagaaaaaagttagctgggtgtggtggcatgcgcctgtaattccagctactcaggaggctgaggcaggagaattgcttgaacccgggaggtggagattgcagtgagctgagatcatgccactgcactccagcctgggcgacagagcaagattagattctatgtcaaaaaaaaaaaaaaaaaaaagatgggacatttaacactatcaaacgctgcaaaagagaattaagtcttagattaataagctagggaaaactggctgtttggaaaaagaaaagaaaaatcaggttaacgccttagcttatcccaagatgagagtagattcgatgttgacttttaaattgattttaaaaaattaaactaaaacctctagaagaaaatatgaatagttaattcattgctgaataaatttagctatatagaaatataaaactcttataatttaaaaatgtattatcaaaagcaaaggaaatatttaaccaatatgagatgctcagtattctcaggttgtaaagatctcttaaaaataggcaaaattattcccttgtaatagataaatgtacaaaaaacatatatatagttcatgaaagaagaaactgtaatgacctgtaattatatgaaatattgttcatctttaattttaaaaagcattaacatttttgcttaccaaattggcaaagattttaaaactttatggtgaaatgggtgtttttattttgcggtacataatttgaaaatgtccagcaaatgggagaacaggtcaattattacctttaaaactattttttagggccaggcacagtggctcatgcctgtaatcccagtacctttgggaggccaaggcaggtggattgcttgaatccaggagttcgagaccagcctgggtgacatggcgaaaccctgtctctactaaaaatacaaaaaataagtccagaatggtagcctgcacctgtagtcccaactacacaaaaggctgagtcaggagaatctgtggaacctgggagatggaggttgcagtgagctgaaatcatgccactgcgttccaggctgggtgacagagcgagaatctgtctcagaaaccaaaaacaaacaaacaaaaaaacactattaaaaagaaacaatttaggccgggcgcagtggctcatgcctgtaatcccagcactttaggaggctgaggcaggtggatcacctgaagtcaggagtttgagaccagcctggccaacatggtgaaaccccgtctctactgaaaatacaaaaattggccgggcatggtggcaggtgcctgtattcccagctacttgggaggctgaggctggagaatcgcttgaacccgggaggcggaggttgcagtgagccgagatcgtgccattgcactccaccctgggggacaagagcgagacttcgtctcaaaaaaacaaacaaacaagcaaccagtatttttcagctttcaaaatatttgcatgttttgacttggttgttctattctgcagtctgtctaaaagaaataagaaatccaggcagggcatggtggctcacgcctgtaatcacactttgggaggccgaggtgggtggatcacttgagcccaggaatttgagaccaccctggtcaccatggataaaccctgtgtctacaaaaaatacaaaaattagccaggtgtggttgggtgtgcctgtggaataggaggatcacgtgagcctggggaggtcagggctgcagcgagcagtgattgtgcctatgcactccagcctgggcaacagagtgaaacaatgtctcaaaaaaaaaaaaaaaacccaaaaagaccaatgaaaagaaagcgattaaattgtagtatgtctatatataattttctgcagtcattcaaaatgattttcagtaatttgggggaaatgcccaatatgtattgagtaactaaccaaataaaaacccacccagaatatgaaaccattatacagtgtgtgattgcagtcacatccaatgagaaggactgacaagagatagtcctatgtcttggtggtaattatctccaggatgtaggatggcagataatttttattttataattagaagttacttttgttctttgaaagtctgttttaaaaattaaaatgggggctaggcgcagtggctcatgcctataatcacagcactttgggaggctgaagtgggcagatagcctgaaccctggagtttgaaactagcatgggcaacatggcaggaccttgtctctacaaaaacatacaaaaattagctgggtatggtggtgcatgcctgtattcccagctactcaggagactgaggcgggaggatcatatgagcctgggaggtgaggcgggaggatcatgtgagtctgggaggctgaggctgtggtaaaccatggttgtgccacggcactccagcctgggtgacagaggaaaaccctaagggaaaaataaaataaaatgcactaactatattaactgcattttaaaaaagagtatagtgaaggaaaggggaatgggaagacagcttgaggaacagataggattgaggaaacattttaggtttgggtgcttgattatatttgtagagtaagacaaaaggtctataagaaaggaatataatgaagatgcaagaaagcattaaaagatgttgggcagtcctagaggatatagtctgccatccaggacatgataggcaaatcatccttgaagaaggggagagagactttttcagacatgggaaacagatggagatggttagtggcacagagaaattttaaggtatgggagaaagttgagggatagcagataatcattatttttagggaagaggaagagtcagggatagctacagattggtattagcaatttgaggagatggaaaaggtttgcaaggggcactggggatgggtccaggagtggattagagatgtagaaactgattgatttctaaacaatatagataacccaattaaagttgttgaataatgtcagctgtagccaatgttggcttggtctctttgacataatccagttttaggtatttgaatactctataaatacaaatacatagactgaagcacaattttaatttttttctatcttttgcctaggtctgtatgattgtataggacttagagctttttgtcctaccaaattattaatttctttattcccattaattttaataccagcacactaatctcattaaacccatggttttactactaggttgtcaaagtcatccgtcatttataattccctagctcccaggagtcttgagctgtgattttttggtttgtttgtttttgggttttttttttttgagacagagtcttgctctgttgcccaggctggagtgcagtagcacaatctccgcttaccacaacctcagcctcttgggttcaagcgatcctcccagctcagcctcccgagtagctgggactataggcgcatgccaccatacccagctaatttttgtatttttagtagagatggggtttcgccatataagccaggctagtctcaaactcctgacctcaagtgatctgtccaccttggcctccttaagtgctgggattacaggcgtgagccactgcagccggccgatttcttctttttaataagaggggagaaaagagtttttgtctttaataattggtagtgaaaacctctgaccttttctttactgggcccagtggaaaatttattagaattgtttgtagagcagcctgccctttaatatgctactttacttagtttatttactccactaaaatacacctgacttctcaactggaacattctccagcattacttgttggtctgaggaatagtagtgtaaaaagtagatgaggggttagttgtggtggaagaatttctgggaggggaagcagttgggcaagggtgaaggaattgaaactactagggaaagtagcctatgatgaagcccaagtgaggcgtgaagtgagctgatgaactgtaaagattctggaaggagttgaaggttgtgatgagactgaataaaagatactgtaggaggcaggtagaataaataggaagttgtagttagagggattttagagttcaagatctaggaagaggaacaattctaagtatcaaggaaatttaaggagttgtacgggttatcagatgactccattgaaaaattgagatcaaaatgttataagggtgtacagcattgatgttaaaattccccaaattttaatccccagcaacaaatcatagcatttttggaatcctgtttctgctgtacctttatcatagtaggtttatctcatgcactgaatgttccttctccctcacatatccctaaaacttgtctagcactgaatgtgcaatttagtatgaattttctagctgaaagatttttaggcatcttgtagtcaagataatacattttaggatgcattcttgggtcacataactcatcagtagcagagtcagagctagaaaccttaatttcccaatttttggtctattctactcattgttatctgttatttaaaaagcagcaggaactcttctttcaaactagttaggaacgtcttaaaatagcatggagaggcaatacgcagtcttaaaatggttttggaaacctcacttagaagaagagaagcagtgtcaaagctgactcttcctgcattcagaccatgttctgcaggtagtcaacactaatcaggtgctgactgccaattactgaggtgttccctctattataagcatttggggaacccccaaagtagtgcttgtcataccttactgtccacatatataatctggggatcttgttaaaatgctagctctgatatagtaggtctagaatagttttgaagattgtgcatttctgacaagctcctgtatagtgctcgtccgtttggtttaaagaccacactttgaatagaaaggccctaaaggatttctgtggtacacagtttgaaaatgtcttttaaaatatgaggactggtacgcagtggctcgtgcctgtaattgtagcactttgggaggccaaggagggaggattgcttgaggtcaggagttcaagaccagcctgggcaacatggcgaaaccctgtctctacgaaatacacaaaagaattagctgcgcgtggtggcaggtgcctgtagtcctacctactcgggaggctgaggcatgagaactgctagaacctggtaggtgaaggttgcagtgagccgagatcacaccactgcactccagcctgggcgatggaatgagacgctgtctcaaaaaaaaaaggaaaaagaaaaaaactatgtgaggagagagagatgttaattagcttgactgtagtactttttttcactatgtatatcaaaacatcatgttatactgtttttattaaaaataaatcattgcaatacatgttttacagaaaaaaaatttaatacatggtactgcctctctgtttctttgtttgtttgagacagggtctcactctgtctcccaggttggagtgcagtggcgcaagctcagctcactgcaacctccacttcccagactcaaacaatcctcccacctcagcctcctgagtagcttcgactacaggcgtgccctgccatgcccagctactttttaaatttttttgtacagacagggccttgtcatgttgcccaggctgatctgtcactcctgcgcttaagtgatcctttcacctcagcttcccaaagtgctgcaattacaagcgtgagccacagcacccggcctctgttagttgaatctattagattttattttgttcaggcttattctgaaattcctaggagtatgggttagtactgtgtagtggtttggaggtagtacataccagagccttggctgagacatctgcagactggctacttatgcccttgtttctaatctatgactagagcccctctggaaggaaaaggaatcagctatatttagccaacagtagcagtagctttcagtctgacatttcctgttagtgttcttccctcctttctatccctccagttgatgtcattgctttgaagaaatgacagctcctttaaaaaaagtctgtggttacttctactctaaatcactagctttgaacattttgtgtaccattgtactgagctgggggatatcagggcctagtccctgggaaatacgtgcactttgttctcctagcatgggaaaaccagacctgcctcaaacttgaattaatagccagtggaaatcaagaaacaacaatggtaaagttatctgtgcttgtgataaaatagtgccctaaggattttgagaacttgactttgttcctgttcatatagggccttctgaaggcttatttgaaatatgaaccagcatacctaatagttctgaatggccacaagtgttcctatgcccttggacaacccatcactctatctctagatgaactctgggggttatataggattctacccaaaggctctttatgtatttaataaggctgaccagaaattaaaaagcttttttgaagctcttaaaaacttagaagttttcatcctcctgctgttttttttcttaaattcaaggagtattcattatttccctctcccccttccttttcccctcttcttacccagagtgagcacaaatggatcagatgaccctgaagatgcaggagctggtgaaaataggagagtcagtgggaataattctccatcactctcaaatggtggttttaaaccttctagacctccaagaccttcacgaccaccaccacccaccccacgtagaccaggtttgtattccagctctcaatactcttggaaataatgtcctggttggcaattaatcctcaggtaagtgtcaggaaattcttttaggtgaattttctgcgtgtatttttacatttaagattttggaaaagaatgatctttctgtaggtaaccaaaagtgcctttttcctaagtttttgttcaaggtgacgttactgaggcagtgctctactgagaatgaaaatgacatgtgcgtaatataaagtataggcggtgcagataacatggcaataacattgtacctttcttaaatggtttgtaactataacataaatgtattaaatactcaaggatttggttgcttattcctagtatatcctttaaaaagttagtaaacgaaaacccaacaatgctaaatgacccagattttaaataaaaagtacacaacaaacaagcatattttaggtagtaaaaatgtgaacacctataagactatccacttctctgatagccagaacaaatctttaatcttaccttttattgtttctctctgctaatatgtgggcagggaatgcagtgtagttaaaccaaatattactagaaaagtacattagttctctgcaaataattttaagtgaatttctattcaattatacatcttctcctttttatttttttattttttgagacagggtctcactctgtcacccagactggaatgtggtgacatctcagctcactgccacctctacttcccaggctcaagtgattgtctagcctcagcctcccgagtagctggtaccacagtcatgagccaccaatgcctggctaaatatttatattttttgtagagatggagttttgccatgttgcgcaggctggtctggagctcctgagctgaaagtgatccttctgcctcggcctcccaaagtgtgggagttacgggcgtaagccactgcagccacatcttccccttttatagataatttgattaattgtatattctgagtctttaagatgtctttattataatcttggtgacttcctctagacattgttttgtccacaagtatttcttaaaggtgtaatgtatgactactaactatctgtaagaatgttatttcttatcagaccttccatattataaccaacatcaaaaattggtctgtaatctgcacggtttcacaggaaagcagttttaaggagctggaaaattaataaatgaacttaaaataccaaggaatattaataatttcctattctaaaagtttttatttccagtgacatcagaagatcagagaacctgtacatgcttcgtgattagtaatgggacataggggtagacaggaccgaaaaagtaaacaagcctattaactggcagcgttggttatttcccattacttatttctttaagtaattttcacctgtgcatctacatcttaagttttatatttatcatctgccttttattttttacagttaaaattctatcctgaattttagaaaatgaaagattcttttcctattttccccaaatcttttatagcatctgtcaatggttcaccatctgccacttctgaaagtgatgggtctagtacaggctctctgccgccgacaaatacaaatacaaatacatctgaaggagcaacatctggattaataattcctcttactatatctggaggctcaggccctaggccattaaatcctgtaactcaagctcccttgccacctgggtgagtaactttttaaattaacatatgttgtctttaggattcttcataagcctacttattaataaggaaaataacagtaaacaacagtaaactccattgttttgatgactgttttttaatttcttttttttttgagatggagtgctctgtctcccagactggagtgcagtggtgtgatcttggctcactgcgacctccgccccctgggttcaagtaattctcctgccttagcctccctagtagctaggattacaggtgtgcactaccaagcccggctaatttttgtatttttagtaggggatttcaccatgttggccaggctggtctcgaactcctgacctcaagtgatccgaccacctcaacctctgaaagtgctgggattacaggcatgagcacccagccaactgtttttatgttattgtaactgattttgggggatctggagtcaaaatgaacaaggaaaacacaccatatttgaaatcttcagggcaaagtggaaaaatatattttttcatcaaaggaccctgaaagttaaccaaggccaattaataaaataatcacctaattccaattgcctttttctttaagggggaaaaaatccctttttaatatcaaactatttttttcatcagaagatcattataggctgggcatggtggctcacgcctgtaataccagcattttgggaggccgaggcgggctgatcacctgaggtcaggagttcgagaccagcctggccaacatgctgaaaccccatctctactaaaaatacaaaaaattagctgggtgtggtggcaggcgcctgtaatcccagctactcgggaggctgaggcaggagaattgcttgaacctgggaggcagaggttgcattgagccaagatcttgccactgcactccagcctgggcaacaagagcaaaactccatcttggggaaaaaagaaaaatcatagcaaagtgatagataattcagaaaactgagaaaatttgtgctcataatcccattttaatctctcctgattattttaagattattttcatagattgtttttaagatactcaggtgtaattttttcttgtttattttttgtttgtttgtttgagatgaaatcttgctctgttgcccaagctgtagtgcagtggtgggatcttagctctctgtaacctccgtcttccgggttcaagtgattctcttgccttagcatcctgagtagctgggattacaggtacctgccaccatgcccagctaattttttttttttgagatggagtctcactctattgtccaggctggagtgcaatgatgcaatcttggcttactgcaaccactgcctcccaggttaaagtgattctcctgcctcagcctcctgagtagttgggactacaggtgcccaccatcatgcccagctaatttttgaattttcagtagaaacggggtttcaccatgttggccaggctggtcttgaactcctgacctcaagtaatccacccgtctcagcctcccaaagtgttgggattacaggtgagagccactgcgcctggccatttctttccactcaaatcctgattataccctgattgagagtgacttcggtatcctaggtagacggacctcaagcctcttcaggaatatgttttctcctagagcagatacttgcatagaagaaattgaattcactgtgtgccactgcctgaagattacatttcttcactttattcctaaattgtatttgtatcatctttctaaactgatgtccttatttgccttagttcaataatggtcatttaatggaaatgcaaagacaggattaaaaagccaggtaactcatgcaagtattttaccagccttttaattttgtatttaagttgggagcagagagtggaccagcacgggcgagtttactatgtagatcatgttgagaaaagaacaacatgggatagaccagaacctctacctcctgggtaagtatctaaatttaaaaagaataattttatttagtcagaattgtggattacaactgtataatcttccctacatttctgttttactttttcttgtcagccctttctctgtccactttgttttgtggtaagtacaaattaaaaagaagagagctagacaactgattaattcagagcctgataaacaatttttgttttcacgcatatttctttcttcttttctttattttatagaaacaacatctcgctatgtcgcccaggctggtttttaactcctgagctcaagccatcctcccgcgttggcctcccaaagtgctgggattacaggcgtgagctatcatgcctggccctattttcactcatttctgacctaaagattccttaggtgggctgggcgcagtggctcacgcctgtaatcccagcactttgggagggcgaggtgggaggatcacgagctcaggagattgagaccatcctggctaacgtggtgaaaccccgtttctactaaaaatacaaaaaaaaaaaagccaggcatggtggcgggcacctatagtcccagctacttgggaggctgaggcaggagaatggcatgaacccaggaggcggagcttgcagtgagccgagatctcgccactgcactccagcctgggcgacagagcaagactctgtctcaaaaaaaaaaaaaaaatttccttaacttttcttgtctaagctgtttacctgtttactaatactgtagtttaagtattagtttcttcaagagtaattatttaaatgaataagaattagagcccagtcatatattaaaatgaagttcttattatatttaaaaaactataatagcaaaatcatttcaaattaattggggaagttaaggatatattaatacatggtgttaagcctttaacattaacattaacattacagtccaggcacggtggctcgcgcctgtaatcccagcaccttgggaggctgaggtggggggatcatgaggtcaagagatcgagaccatcctagccaacatgttgaaaccccgtctctactaaaaatacaaaaattagctgggtgttgtggcgcgcctgtagtcccagctactccggaggctgaggcaggagaatgacttgaacctgggaggtggaggtgcagtgagctgagattgtgccactgtactccagcctggcgacagatcaagactccgtcaaaaaaaaaaaatcatataaaataattgaagaaaaaatattttttaatccagaggaaagtcagtaacaaacatggaaaaatacttaaccttgttagtaatctgaaggaaatataccctgaaaaggtactgttttagttattaaattagcagataatatcaagtgttggtgaggaactttacgttgttagttgctgccggggctgggcacagtggctgatgcctgaaatcctagcactttggggggacaaggtaggatgggcgcttgaggccaggagtttgagaccagcctgggcagcatagtgagaccccatcactatagaaagaaaaagaaattagctgggcatggtggcatgtacctgtagtcctagttaatcaggagtctgaagtgggaggatctgttgagcccaggagttcaagattacagtgagctgtgatcatgccactgtactcctgggcaacagagccagcccctgtcatcctccctgcatctgcccaccataattatgtattaatacatacccttcataatcctctctgtgaaatttatcctaaagaaacaattcaaaggaagaaacagtttgctacattaagaatattcattattttattatttatataacatcagaatattggaaaccaccctaaataaccaagcaggtagaaatcgtgaagtcattcgattcatttatgaattatgttcataatcaacacaatcaattctttcaaatgttttatttagaacatttgtatcaatgtttacttacatattttgtacccatttaaaatgataggaagtgggctgggcgtggtggttcacgcctgtaatcccagcactttgggaggccgaggtgggcggatcacctgaggtcgggagttcgagggccgcctgaccaacatggagaaaccctgtctctactaaaaatacaaaattagccaagtgtgatgacgcatgcctgtaatcacagctactcaggaggctgaggcaggagaatcgcttgaacctgagaggcagaggttgcggtgagccaagatcgcgccattgcactccatccagtctgggcaacaagagggaaactctgtctccaaaaaaaaaagataggaagttagttgtgttcttgcgaaaaattgtgtgtgtgtgttttgttttgttttttcgagatggagactcactctgttgcccaggctggagtgtattggcatgatctcggctcactgcagcccccacctcataggttcaagcagttctcctgctcagcgtcccgcgtagctgggactacagatctgcgccaccacacctggctaattttttgtatttttagtagagatggggcttcaccctggtggccaggctggtcttgaactactgacctcaagtgatccgcctgctttggcctcccaaagtgctaggatcacaggtgtgtgagccactgcacctggccaaaaagtgctttttgatatctgtccaaagctatatatttaatttgtgtccctgttatgattgaaacagtaaaaacaacattgaaaagaaactcaaaacttaatgactgtttgagacttactcactaaatatgtattgcattttaagaacctgactaatgcatcttatgaactttcaagaaataaatttttagaaacatttctcttaagttcacttacaaactatttaaaaatacataaaagactccagataaatcaaaagtagtttctcaaggtaaaatattctatctgtttcacaagtatttgttgaattagcttgtttttttttttttttttctgatttagctgggaacggcgggttgacaacatgggacgtatttattatgttgaccatttcacaagaacaacaacgtggcagaggccaacactggaatccgtccggaactatgaacaatggcagctacagcgtagtcagcttcaaggagcaatgcagcagtttaaccagagattcatttatggggtgagcagcctgttgtttaataaactaataagagtattttgtttctagccccttccagcatatgtcatggaaagcactaaaaagaaggtgcaagtagcatggcaacccagttgttgctgttagtaggtattatttttagaccttgtctggggtattctgtgtgtgatctagtttttcctttttgtaatttgcttaagtccaacttcctcttctttttaatgtcaaaaataagcaaaaaataagttaggacaacttaaaattcatgaacaaaagagtagtaaaaataaacccaagcagcttgaaaataattaaaacatttctaaatttactagtgccttgggtctaagagcatctgactctaaagtggttgtgcaaaactgatgataagagtttaaccactttttaccatttggagataaggcttacctaataaattatttggtactctgggagactgaagaaatttgatcctttataggagtatgcttactatattattctggctttaaatctttattatctttgatataaaatcatttcccttctagaaacaaatggtttaaattttacatattttcctgtagagcaatattgcattaatagtgtaagtactccaaaatcttcctttgctatgcagtctttggtgctaggaattttataatctctcaagtcatacagtatcattgatcttttgtctggaggaaaaggaaaataatccattgagaaatttgattctctatgccaaacaagatggatttgttatatagaacctaaacgaagaaaatcaagccttaaggagctcaggagaaaatgccccctccatcaccatctcttcccctccactgccattggtatcatccctgttagaattcatcagagtaaaacagcacctttcgtattcctttcctaactaggcatagttttatcccttttcttcatattcttgtctattccttatacctcatcatcataatagcactcactgctgtagacaaattcacctttatcagcagccttccctttgttccttggttatgactcaggtacttttctttcatataacaattttttcctgccactttctctaaacagttgctaactatatttcccctcccagtggttttaaagctgaaatgaattttgtctcttgtgtactttacccttcttttcatttttttttctatgctgttttacatcttccttcctttctaaattataatcacctgtggtatgcctggccaaatttcttctaggtttgaatacctagcttgcctgccttctttaaaactagtttccacatgggtgttcagtggaaagagcatgggctttggagttagacacatctgggttcgaatcctggttccacagttactttctccatatgactttgagtaagttacttaacctcatcaagacttatttcctttatctgtaaaataaatacagatataaaattgcctcagagtttttctgaggattctttaaaataaagttccaatatatttggcatgtactgaatgcttagaaatgttagttcccatctcttctctccttcatattcacctctgtatatgtaccctttatctcatttttgcattacacaatctttcaaagcattcttttaaaagagagatttagcagatttctggagcaccaacggtgtgttttgactactgtaatcctgaccgatttagtactcagagtctttggaatttttttttttttttttaagtacagcttctccttcatcatcctgtccccccgcccaatccaatataatctgaacaattttctgaaatttttactctttgtacttgatgtggagtggtttgaaattacatagaatctaaacagcctattttagttaacatagccaaagatataagctgaagtgaattaatttaacatccttaataacatttactttaaaaatgatggggtgttgctgagaaatagtctgtttattgagtatatgaagtggcctttgtccaccattgttgttgtgactcttactagcatacagaaactgtcatacacccagcattttaagtctcagagtggatatggttgacagtaaaacactgtgaaatggttcttcctggtccatggcttaattgtgcatgtccctagtttatccgtccagggagagccagtggggttggcttcagtcttaaaattgtcagtacagtatgtcacgtgccaaacttttcagacctcatctgtaacttgggctcagaccttttgtagtgtttcccgctggcctccctgttctcacatcttctcataatcatgtctgtcaggaggagcaaggcagttctcgacagcactaaatccaagagttattatatcagtagtgtaatgtagctcatatcctttaaaacctcatcaatcaaccaggtttctgtagtaggccggtgacatggggttgtaggggtgggtaaagaaacaagaagagatagcaggggagctgctctatattgagatttaagagaaacaaccaaatgtaacgtaaggactttgtttgggtcctgattttaacaaataagcaatcatgcatttaattacagattaggtattggatgataaaattaacattgattctttaccacatgtcataatgacattgtgattatgtaagaaaatgtcagcctggcgcggtggctcacacctgtactcccagcactttgggaggccgaggcgggtggatcacgaacaaggtcaggagtttgaggccagcctgaccaacatggtgaaacccggtctctactaaaaatacaaaaagttagctgggcgtggtggcgcgtgcctgtgatcccagctactcaggaggctgaggcaggagaatcacttgaacctgggagccggaggctacagtgagccgagatcgtgccactgtactccagcctgggcgacagagtgagactccatctcaaaaaaaaaaagaaaagaaaatgtccacaaattttagagagacatactaaaatatgtagtagaggtgaaataatgtttgattttcgcttcaacaaagaacaggagaaaagagataaagaaacttggcaaagtcttgataagtgttgaatcctggtgctgggtatgtgggaatgtgggattcattgccctgttttacttgttttttttttcttccccatagtgaaattatttttaatgcagttagactcttgtttatcttactgaagaagaaagggtttaaccaaatcttactgggtgaccatgtaattatctctacttaattatacatttaaatcaaaacagacttaatatctctacacagagtcggtgtgacttttgttttctttttccaaaggttgactcttactttgctttcatcttatctagccaaatctttctctccaccaatgtgatcattggaaacagaacttttaagaagtcttccatacagttctaggctcattaacactttccagctggaaacctttccttccactcatctggcagcccactcttcctgttcccccaactctcttctcataattctttgtatgtcacatgttctgtatttgatcttctgtttttgagttacacatataatatttttcatagtcatatgatgattctgggtactggtattgtaaatgacttttgggggggttatatatttttctaatttttatattattgatgtaaaatttgtagcacaaaggaaaaatggtcattttggggatgaggattacatatatgtgtagtattttaattttaaataattttaaatgttaggtaatgtttgcaccggttttttttaaaccaaaccaaagtatattggcatttatccataaccatgtgacacttctttaagatacaaactctctgtgttatacattgccagggaagggaaatcagaactcataagcttgctgtcagataagttgttaagttgttaatagtttcatcactttttggttctttttagaatcaagatttatttgctacatcacaaagtaaagaatttgatcctcttggtccattgccacctggatggggtaagtcacatgagtttcttcatggagttctgtcatttcatttttgttctcttccaattgtgtcattttaaaacagatatttatgtctgatactgtgctcttgcttgagtgaatgtctgggaagtttttttttaatatatatatcagtttaattcacaaataggcattaaattccccaaacattaagtggactctttataaacttttattgacgctcataattattttactcttctacagtttaaagatactgatcacccagcaataaaaaaggaatgggctattgatacaccagtaggtctgggtggacttcaagagtaatttgcttgatgaagaaagtcagtctcaaaagatcacaacctgtgtgattcaattcatataacattctcaaaatgacaaaactagagatggagaacatattagtacttgtcaggaaacagggtaggtgggaagtggattcaaatattaaaaggtaacataagggggttttacgtgatgatgatgattccatcatcttgattccatcaagatccacaagatgattctgtatcttgattttggtaataggtgattacattaataatgtatacatgagataatgcatagaactatatatttacagaaatgaattcagcttttaaacatggtgaaaatttaacaatgtttgtggttaacaataatgtaccaatgccacttctgtggttttgatgctgtacgtagttatataagatgtcaccatcggagaaaaatgaagtatatgtgagactttttgtgcaattttttacatcctgtgagtaataattaattcaaaataaaaagctttttaaaaaattgtaatcacattggttctcctaaaacaaggttcagagtttggttaagttggcattatctgatagaagagtggaaggagcacatgtgaaggtgtcaacttcatgccctacaccatggagctcaagagcatgtgctgttattgagtatatctgataccttagttattaaaatagaccttaatagactttaagctggacctaccctactaggttctattttatagtgttatgtaatactcacagcattatatagcaaggtttcagaataaagatggcagtatagaaagttttgcatagaagcaagataataatatattataatagaaagtggaaaacaacataaagcccattgtggaaccagagttttgtcttcaagagctgaagatacttcataatattgggataaattcagaaagtgatatttctagattgggaaaagttggtccccaagatacattgttctagcagtactgagttatggagaaaaaatgttggtgtgtcaagatcacatgagtctggttaataaatgctactgggggtataagcttttctttgagaaatctcattgctcttatttaaaggtatctattctcaaaacacttctgtgagtcaaaaaggtaaaaaatgtattaggctatacatataactgttactgttattagcttataacaacaggaggacatatgaaagttgtgggcccgatgcagtgacttacacttataatcctaacactttaggaggctgaggcaggtgaatcgcttcagttcaggagttcaagaccagcctgaccaacatggtgaaaccctgtctctactaaaaatacaaaaaaattaggtgggcttggtggcccgtgcctgtaatcccagctgctcaggaggctgaggcaggagagtcacttgaacccgggaggcggaggttgcagtgagccaagatcgcgccattgcactccagcataggcgacagagcgagactccgtctcaaaaaaaaaaaaaaaaagaaattagccaggcatggtggtgcttgcctatagtcccagctactcttgaggctgacgtgggaggatcgcttgagcttgggagtttgaggcttcagagagtcgagatcacactattgcactccagcccgggtgagagagcaagaccctgtctcaaaaaaaagaagaaagcaagttgtgaatttctgtctttaccaaagcttggcagcctggagttaaggagtcctctgtctctactgaagcctaagagtggtcagtgaatggttagtatgaagtactttagaagaggggatgttgcccttacaaggcatattaaacttaacctgtcagattgcattcccagacatggatggttttatttctagagtttcccagctttatttctagagttgtatgtcttatgttagagaaggagaaaaaaactcatgcactaaaatgatatatccaaaggatatgtatttatcctcttaattttattgcaggccaggcatggtggctcacacctgtcatctcagcgctttgggaggctgaagtgggaacattgcttgagcccgggagttggagatcagcctgggcaacatagcgaaaacctgtctctataaaaaaatacaaaaaataatctgggtgtggtggaacacctcctaatcccagtttcttgggaggctgaggtgggaggatcacctgagcctgggaagtcaaggctgcaagtaggccaagattttgccactgtgcttcagcctgggcaacagagtgagaccctgtctcaaaaaaaaaaaaaaaaaaaaaaagttgcagaaaaactatgacctgcttcatggttatggtcagaaacaaaactgttttactccttctctagggcaggtgtagaaaaaaatgcctcttgcttatagaaagctgaattgtgagctgcgtttcctttatcagaaaagtctttcctgcaagttggtccttgccttctgtattcatcattttctttatcatccagatctttctcatttttactttagccaacaacactttgctaaaatactgtgttaaagatccagcttagccaggttattagagtcttgttctgctattttacagtctgcttatttttaggtttcacattcctcatgttgaagtagtgctacagatgtttatgattatcctactcagactgagcactgctttatgacttgctgcctttggggcatataccttacttgtagaaccagtgacagcactggtagtatatcagatgaagcaacccacccaacataccttcaggattgacccaggttgatagaatcccatcttacagcttgcaccctttcagacttttatatgctgggactagacattcctacctcataggctcagtgaataattggttttttagagatgggggtctccctgtgttgcccaggctggggtgcagtggctgttctccagcatagtaattgcacactacagctttgaactcctggcctcaagcaatgcctcagcctcctgagtagctggaattacagttttgtgccacgatgcctagctaggcagtgaagaatttttaacacatgaacatactatagaggataaagaacaaagaatacttttggttcaccagtattatttaatagggctttgtataggtgcttcgccaatcaagtatgaagatattctctcattttcctagttactgtgaaagaatacatagaatgacaagaagtgtctgttttttactgttttattcatcaagtcaggaagtgttctaatctgcatttggatttgatgttcagtaatttcagtattgtttattatgtgatttttcaacaaagtcagaaatccgttctacagccacagcacttcctctcattaagtagatgagccttcagttcacaaatgtgtcaaggctgatctcagcagcatatacttagaatatatatgagaaaaatgtttgctattaattttctcttgcctcatgttatcttctgaaaggaaaatcttggcctgaaatctgaactttgctgacagataaaagatgaatggccattacagtggctcacgcctgtaatcccagtactttgggaggccaaggcttgtgtccaggagttcgataccaggctggggcaacatggtgaaaccccatctttacaaaaaatacaaaaattagttgggtgtggcatgcctgtagttccagctacttgggtggctgaagtgggagggttgcttgagccccggaggtcaaggctatagtgcgctgtgattgtatcactgcactccagcctggacaacagagtgatactctttcaaaaaaccaaaagagagagaaaaaagttgagtatgtgctcagctatatacttagggtattatttttaggttataaaaattatttggatatatatttttaaacaagaaagagaattctggctgggtacggtggctcatgcctgtaattccagcactttgggaggtcgaggcgggtgaatcacctgaggtcaggagttcgtgatcagcctggccaacatggtgaaatgctgtctccacaaaaaatacaaaaattagctgggagtggtggtggacgtctgtagtaccagctatttgggaggctgaggcaggagaattgcttaaacctgagaggtcgaggctgcagtgagctgagatcgcgccactgcactccagtccagcctgggtgacagagcaaggctccgtctcaaaaaagaagaagaagaacaaagagagaattctggattctgcaaataaatttttaaaatttaatgcgactgccaagacatgaacttatcttgctgttatgttaacaagagcaagctgtaacactgtgggtgattatgtttttcttttttttttttttgagacggagtctcgctctgtcgcccaggctggagtgcagtggcgcgatctcggctcactgcaacctccgcctcccgggttcacgccattctcctgcctcagcctcccgagtagctgggactacaggcgcccgctaccacgcccggctaattttttgtatttttagtagagacggggtttcattgtgttagccaggatggtctcgatctcctgacctcgtgatccgcccgcctcggcctcccaaagtgctgggattacaggtgtgagccaccgcgcccggcctatgtttttctttagagacagcctttgagttggtgataagcttatgcactgaagatgccttgaccagcaaaacctgtgtcatgagaggcagagtcccacttttctgtatattatgcacattggaattctattttcattttaagctaagctgacatagaaagtagctttaaatgtcagaagcaggtttgtgatactcactagttacatccattttaacctctgttatcactactacttgaaatcatggaattatattggaaataaaattaaatattaccaaatacgaacttgacaagactataatttggcctaaaactgatccagatgatctcaagtgttaatttgaaaaatagttaccaatttttcttttttcttttcctgtttttttttttttttttttttttttttttgagatggagttttgctcttgtcgcccaggctggagtgcaatggcatgatcttggctcactgcaacctctgcctcccgggttcaagcgattctcctgcctcagtctccctagtagctgggattacagatgcccaccaccatgcccagctaatttttgtatttttagtagagacggggtttcgacctgttggccacgctggtctcaaactcgtgacctcaggccatccgcctgccttataactcccagagtcctgggattacaggcgtgagccacagcgcaggaccaatagttaaccaatttttcaaaccacaggaaataaaaattagccatgtcaacatggattaaacttaaatttttgtttaaaatgctgatttttagaaactaagctttttaaaaagtttcagttcattctatgatctttaatacatcagttcattctatgatctttaatacatcagttattcattttgagacatgttgaacaaataaattaggatacagcaggaatcccatcttttgaagaattcattggtaatgggacagagaagtcagtaattcaaaaacagcagaactgttaaaatttcaagtctacttaatttgtttactaaaagagaaaatgatatccacattttttttttttttttgagacggagtcttgctctgtcgccaggctgtaatccatctcggcacactgtaacctctgcgtcccgggttcaagcagttctcctgcctcagcctctcgagttgctgggactacaggtgcacaccgccatgcctggctaattttttttttttttcttttttgtattttagtagagacggggtttcaccatgttgcccaggttggtcttgaactcctgagctcaggcagtccgcccgcctctgcctcccaacgtgctagaattacaggcatgagctactgcgcccggccaatatccacatcttctaaaccttaatggggagatttcaggaaagcaggtaaaattttgtagactgggaacacgaaaacagggagaatcctaaagcaagaggcagttggggaacaagcagcagctttagatgcagtaattagagaactgagttctgcttcctatcccttgtatagaaagttactgtagatatttaggattttggaactgggtatattaaggaacgagatatgttaagtgtattaagaaaggaagtattttttagttgaataatgcctagcatataccttatattatattccttattttgtatatatatgtatgtatatatacacactctcaaattacattatattccttattttatatatatttttatatattgtgtgtgtgtgtgtgtgtgtgtgtgtatatatatatatatatatatatatatatattttttttttttttttttttttttttttgagacagggcctcactttgtcacccaggctagagtgcagtggcatgatctcagctcactgcagtcttgacctcccaggttcaggtgaccctcctgccttagccccggaagttgcttctctgtcccattaccaattaattcttcaaaagatgggactcttctggtatcctaatttttttatttgttcaacatgtctcaaaatgaataactgatgtattaaagatcacagaatggattcaaactttttaaaaagcttagtttctaaaaatcaagttgtacaagttgtggggctaaggcaggaggatcacctgaacctgggaggtcaaggctgtagtgagctgagatcacgccactgcactccagccagggtgacaaagtgagaccttgtctccaaaaaaaaaaatatatatatatatatgtgtgtgtgtgtgtatttatatatacaaatgtatatttaatatatatcaaatatatatattagtgggctgccagcacggcccactaatttttttgtattttttgtagagatgagggttcaccatatggcccaggctggtctcaaactcctgagctcaagcaatctacttgccttggcctcccaaagtgctgggattacaggcctgagccaccccgcctggcaccttactatattttaatgaatgaaatgatgtagtatggaaaaaaaaaaaatccctaaatggagacctgagtttccatctcatctctgctacttaattctgaggtttcaggtagattatttaacctatctgagttttcttatcttaaggataaagatgaattcacctaccctatgggactattaagaataaaatgaaggtcctgtgtaaaaaactaaataactgttcattattcttgctgctgttggttggattgagtagaaaggtcctatggttaggacattataaagtacgtctacttagcttctaagatgtaatatttctataacttcagtaaggatgtgcatttaatagtcaataaattaaaccttttaaagctgtgatttaaaaactataaaataaacaatgaaatgagaaatgggcaaattcaaataattttattttaccttgagcaagaagactatgccaatgctaatgctttgctttcccctgcccctgcccttcccaaagagaagagaacagacagcaatggcagagtatatttcgtcaaccacaacacacgaattacacaatgggaagaccccagaagtcaagggtaagaatagttacttgtgtatatttaatctcttaaagattataccttatttctaacaactgaagaagatcaaagttcatattcttttgccaaagacctaaaacgttaatcacctacatactttggaaagagaaaattatactattattttcatctaatggaaagtttgaagatttcttcaaagtgcaggaaaaaactttaactgggcatggtggctcatgcccattatcccagcactttgggaggccaaggagggaggattgtttgaggccaggaagacctgcgtaatgcagtgagaccctgtctctacaaaaaaaatccccaaaattgggtgtgttggcatgtatacctgtagtcccagctactcgggagactgaggtgggaggatcacctgagcccaggaagtcgagactgcagtgaactatgattgtgccagtacactccaacctggaggacaggttgagggctgtttcaaaaaaaaagaaaacaatagaaaagcaaaaaaaattatctggcacatgagaatatacttattaacatatatattatttttaattactaagaacagattagtgattctaaatcagggtttcttaacctgagatcactggttaagaatctagggtatgtggtttcaaggaggaagaaaatacatactcagtttcattactctttactggaaatttagtatcttcttccattatgaatgtaggctactaccatgtaggattaagaatgcctaggagtttgccatcagtagaagtcaaagggtgttaaaaaatattctgttgttgttgcagatatctctaaatacttgtttacacacataattacaaggacttgctaatttattaataaagagatatatgtacattatcacaaaggtctccctttgttgcccaggctgttctcaaactcctgtctttaagcgatcctcctgccttagcctcctgagtagctgggattacagaaataatgttttgacaattatgtatatataatggtttatctttgtaacatgttataatagtatgcatattagtttgctagggcgccttaacaaagtaccacagaggaggttgcttaaaccatagaaatgtatgtctcagggttctggaggctagaagcttgagatcacgatgtcagcagggccatgctcactcagaagatactaggaagagatctgttccaggtctttctcctggcttcttgtagctccttggcttgtggcagcatgaatccagtcttcacatggcactcttcctgtctgtatgtctatctgtacccaaatttcctgtttataaggacgtcagtcctataggattagtggcccacagtacttcagtatgacctcatcttgatacatctgcagtaactctgtttccaaataaggtcacattctgagttattgagggccaggatataaacgtgcatttggagggaggacacagttcaacccataacagtctgtaatactatgcatttatcagactgccagagggttccattctgcaaggaatttggcagactgtacagtcggagggcacagtcctccacaaaactgctgccctcacttcagacatcagcgacaatattgggggtccacaggatgactccagaccaactgtctacaaatttgggggcccccaccaccactcttaggtatgataagttactagaagtactgagaactcattgaaacctcttatagtcacatttattctagagaaagaatgcaaaataaaatcagcagaaggaataggtgcacagggcagagtctgggaggctctgaacatccagcattattgtgggacagtacacattgaggtcgagtatcaccaaccagggaagtctctggtatctagggtttttattggggcttgatcacgtactgccctcttggctgaccttttgtctccagtccttactggagatttgagctaatgccctttagtctctagttcctccagaggtcggaactgatgctccatgtcccacagccttgactgtccagtgatcaaagcctccaggcaaacaaagatattcccaatacgcagtgcattccaagggcctaaacatcactaccaagttgctgagggcaaaggccagacctctcttttggtataattataatttgagaacagatattccatggctcaaaagttttaaaaacttttgttctgaaggtatggtttaggttgcactgagctgagatcataccactgcattccagcttgggcgacagagtgtgactctgcctcaaaaaactaaaactaaaaataaataaaaaaagatatgctttcaacttaaaatagttttttctgcctaccaacaaatgaccattttctttttaaatggagttactgcatttacttaaatttattcagtttccataaaggaagaatgaagaatttcatagataacattttcttcctctttagaattttctaagaatagaattgaagaagtcacctttctataatttgctgccatttttttgtttcctcttagatgtttaaagttttatagctaaagttagaattctgctttaacaacacagatgacctagttctatctaatttattttcaagacaacaacttgttactgagcctatcttgcaagtataacaattgagaatcctcttttttacatttttggtagtctgttttatctgacatttgtattcagttaagtgaatacaggtttgttgttgttgttgttgttgttgtttgagacaaggtctcagtctgtcacccaggctggagtgaagtgacatgatcatggcttgctgcagccttgacctcctgggctcaagcaatcctcctgcctcagcctcccaagtagcttggactataggcatgggccaccacacccagctttttttttttttttttttttgggtagagacggtgtctctatgttgcccaggctggtgggaagttgttgccaaacacacaaactgaaatacttgattaaaagatgtcctggcagtatgtaggaaatacttttggaagacctaaagagaacgatcaatctatagttgtagtaggagtaataacaattacaacttgggctcactgtcactttttacctgtctcatttgttcctcatctagtctcatagacattgttgtctctgttttatggacaaagaacctaaagtttagagagattaagcagcttgtctagggtcacaagagttttcaaggtataaagataggtattaaggaggtggcatggaatacttcataaataacatattaggccttgtgtagtgtctcaacatctgtaatcccagtgctttgagaggccaaaataggaggatcacttccggtcaggagttcaagaccagcctggggaacatagtgagaccagtctctacataaaattttataatttaaccgggtgtggtggtatacaactgtagtcctagctactagggaggctgaggtgggaggattgcttgaacccaggagtttgaggctgcagtgaactatgatcatgccactgcactccaccctgggcagcagagtgagattctttctcttaaaagaatctttttttgagttgccttagtagaaaaacagtagatagataatatgggacaaaaggaaaggcttcatttggaggtgtggcagatcatatcttatttaaggaagtgctgagtggcctacactgtgaaatcatgggattcatgaaagggagttagaggtttgggtgcaaagggaacattgaggccagcgtatagaggctgagtgaatgccatatgaagaactttagatcttaatcattggtaatggtggaacagtgatagtactttacagagataactaatttaaataagatctctgttttaggatgatactctgttagcagtatcagtataagagcaggcctagagtgagatcagataaggaaaacgagttaggtggctgttcaaaaaatgcagaagatggctgggcgcagtggctcacgcctgtaattccagcaccttggaaggctgaggtgggaggatcacaaggtcaggagttcaaacccagcctggccaacatggtgaaaccctgtctctactaaaaatacaaaaattagctgggcgtgggcgtggtggcaggcgcctgtagtcccagctgaggctgaggcaggagaatcgcttgaacctgggaggtggaggttgcagtgagccaagatatcgtgcccctgcactccagcctgggcgacagtgagactccatctataaaaaaaaaaaaaaaaaaaaaaaagcaggagagaaacaaagccagagaaaggatggtgttggggattggaaatagagatgaacgtgaagatttctaaggcagaatggttagaacttggttaacaaaatgtttaggatgagtcattagctaatggggaacataagccaagtagacggcagaagacttgagttgtgtttgatggactttgagtttaacctgtttgtaggatgtccacatagagatgtctagtatacaactgaattactgaactgaatggttttctaaaagatttctgctatgtttattgacatttgtagcttctgtacttggcaaacaagcaactctttaatatttttgtttatgttttttcctgtgtttcgtagtcaattaaatgaaaagcccttacctgaaggttgggaaatgagattcacagtggatggaattccatattttgtggaccacaatagaagaactaccacctatatagatccccgcacaggaaaatctgccctgtaagttttctaaacattgtagattaagagtaaaatactagtccttcagattttgatataaagatttgtattagcaaggagtggaagtcttagtatttcttgagttagcttgacaataggtttctgttcattaagtattttgcatttccatctccctcttggatattttatcctagagattttcatatttgttaccatttgttcacacagcactaaatgaaactatttagaatttataggtattgtactgcttaccaattagtctctgatttctgattttcagcttctttcattcccttaactttttgacgttaaaaaagctctcattacttatcccccaccccatttctgagaaagtaaccttttgatttgcttatgtgctttatgacttcttttgtgggaaaatatataacctaaagtttcttgttttatgtgtacagttcagtggcattaagcacattcatattgtggcataatcattaccaccatccatctccagaatgttttcatcattccacactgaaacactgtaccctttaaacaataactttagcagacctggtaaccagccttctactgtctttctctatgaatttgactagtcgaagtacctcatattattggagtcatacaatatttatgcttatgtttctggattatttcactaaggtcatatcttcaagatttatccgtgttgtaatatgtatcaacattttcattccttattgaagctgaataatattccagtgtatgtatatatcacattttgtttattcacagatatttgcattgtttctgttttttggggggtattgtaaataatgctgctctgaacattggtatataattttctgcttgaggccgggcgcagtggctcatgcctgtaatcccagcgctttgggaggccaaggcaggcggatcacctgatatcaggagttggagaccagtctggtcaacatggcaaaaccccatctctactaaaaatacaaaaattagctgggcatggtggcgcacacctgtaatcccggctactcgggagtgtgaggcaggagaatcgcttgaacccaggaggcagaggttgcagtgagtcaagatcatgccacagcactccagcctgggtgacagagtgagactccgtctcaaaaaaacaccaaaaaccaagtatctgtttgagttcctacttcgatgacttttgtatctgtacccaaaagttagggttagggttagggttaggatgacttttgtatctattgctggattaaatattaattctgtatttaattttttgaagaaccaccatactgtttttcagtgtctgtgccagtttacatttccaccctagtgcagaagaattccaatttctgtacgttctcatcaactcttctgttttttttttcttcatcatcatcatatttttttttaaatagtcatccttaatgtcgtatttcattgtggtttttctttgtatttttctaatggtttgtgatgttgagtatcttttcatatgcttcttggctatttgtgtatcttctttggaaaaatgtctcttcaagtcctttgcccatttgttgttgttttttttttcttttgcgattgagttttaggtgttctctatatattctgggtgttaatcccttatcaaatacatgatttgcaattattttctcccattctgtggtttcctttttactgtagatagtgccctttgatgtataaaacattttagattttgatgtctgatttgtcaattttttcttttcttttcttttttgagacagtctctctctctgtcacccaggctggagtgcagtggcacaatctcggctcactgcaagctatgcctcccgggttcacgccattctcctgcctcagcctccgaagtagctgggcctacaggcgcccgccaccatgcccagctaatttttttttttttttttgtattttgtttaatagagacggggtttcaccacattagccaggatggtcttgatctcctgacctcgtgatccacccacctcagtctcccaaagtgctgggattacaggcgtgagccaccgtgcccggcctgttttttctttttttttttttctttctttctttcttttttttttttgagacggagcttcactctttttgcccactctttttgcccaggagtgcaatggtgcgatctcggctcaccacaacttctgcctcctgggttcaagctattctcctgcttcagcctcccgagtcgctgggattataggcatgcaccaccacgctgagctaattttgtatttttagtagaagacagggtttctccttgttggtcaggctgatctcgaactcccgacctcaggtgatccgcccgcctcagcctcctgaagtgttgggattacagatgtgaagctccgcgcccagcctgtcagttttttctttgtcacctgtacctttggtgtcatatccaagaaatcatttccaaatccagtgtcataaagctttgccctaagttctttttttttttgtagatagagtctcactctgtcgcccaggctggagtgcagtggcaagatctcagctcactgcaacctctaccgcctgggttgaagcgattcttttgcctcagcctcctgagtagctggggttttagctacgcaccaacacgcctggctaattttcgtatttttagtagagacggggtttcaccatgttggtcaggctggtctcaaactcctgacctcgtgatccacaccccctcagcctcccaaagagtagggattacaggcatgagccaccgcgcctggcctgagagttctttaattttagctcttacatttagatcttttatccattttaagttaaattttgtatatggtgttgggtaagggtccaacttcatctttttgaatgtgaatgtccaattttcccaagcaccatttgttgaaaagactgtcctttccccattgcatgactgtggcaccattgtcaatagcattttaccatatatgcaagggattatttctgggctgtttattctgttggtctgtatgtctgatttgccaataccacgctatagctttgtagcaagttttcaaatcaggaaggtatgtgtcctccaactttgttctttttttcaagctgcttttgactattcagggtcctttgagattccatatgaattttaggatggatttttttatttctgaaaaaaagaagtcatttggattttgataggggattttattgaatgtacagaatcaataaaatccatattgatcaatacagattcaatatctgtatcaatctggggtagtgtggtcatcttaacaatattaagtcttccaatccatgaatgtggatatctttgtgttttctttgatttctttcagcagtgttttgtggttttcagtgtacgagtcttttgccttcttgattaattcctaagtattttttattctttgtgatgctattgtaaatggaattgttatcttaattttctttttatattgtttattcttagtatatagaaatggaactattttgtgttgactttgtatgctgctactttcctgaattcacttactctggcagggtttttcgttgtggaatatttagtgttttcttcgtaaaagatcttagcttctgaaaacagataagttttcttcttcccaatttgggtatcttttatttatttatttatttttcttgcttaattcctctggctagagcttctggatactatgttgactacaagtggtgaaaataggcattcttatattgttcctcatcttaaagaaaaaacttctaaccattgaatgtgatgtttgctgttagatttttatatgtgccttttattatattgaggtagtttccctctattcctagtgtttcctatccctgttgtggagtgttttatcatgaaagtgtattaaattttgtaaaatccttttttggtatcaattgagatgatcatgtgattttttccccccctcattctgttaatgtggtatattatgttgatttttcataggttgaaccttttttgcattccaggaataaatcctacttagtcaaaaggattaaagtgtgcttttaatatgctgctgagatttttttgctgatttttttttagtatttttccatcagtgttcataaggaatgttgctctgtagttttcttatagtgtggctttcttagagcaaagatggttccctattactttctaattttatacttctacacattaacaacttttatatttaaagcagaaactggaaaatcaggccaatttggtattaatgaaattacagaggtaatttagatatgggaataaattaccgataatattattctatcattcattttagttacaataagtttgggtgcatataatagaaaacactaaaataatagtggtttatgtaagatagaagtgtatttgtccccattatttaaaaatagtccagcaggacttacaccacatcattaccattgctcaaaaaagaagttacaagaaaaatcaggaaatattttattttgaataataattaaaacaccacatatcacaatttgtgggatttaactaaagtagtcttcagcgggaaacttttgttttaaagaagtagatgagaatataggaaagataaaatcagtgatctctgcttttacattcagatgctagaaaaaggcaagttattaaacctaaagtaagtacaagaaaggaaataaataaaagcagaactcagtgaagtggaaaagaaacaatggagcgcccaaagctagaagataaatttttggtaaacattaataatattaacaacccttagtaattaaacctatagagaaaaaaagagggacatcactgtatattttatagacattaaaaggataataaagggtatatttatgccaataactttaacattttagatcaaatggacaaattctttgaaagatatgtcaccaaaatggacacaagaacagatagtaagtctaaatatccctatagctgataaatcaaatgcataattaaataatttttaagggcaggcccagtggctcatgccagtaatctcagcactttgggaggccaaggtgggcagatcacttgagctcaagagttcaagaccagcctaggcaacatggtgaaacccatgtctacaaaaaatacaaaatattagctgggtgtggtggtgcatgcctgtagtcccagttacttaggagggtgagatgggaagattgcttgagcccaggaagctgtggtgaaccgagatcgcgccactgtacttgagcctgggtggcagagtgtgaccctgtctcaaaaaaaaaaaaaaagaaaaaaaagatttctcatgaagaaaattctggcctagatggtgtcactggtaaggttcatcaaacttataagttataaattaatcagtcctattcaaattcattcataaaatacaagtgatggaaatgttttctttttcattttttttttttttttttttttttgagacggagtttcactcttgttgcccaggctggagtgcaatagcccaatctcggctcaccgcaacctcggcctccctggttcaagcaattctcctgcctcagcctcctgattagctgggattataggcatgcgccaccatgcctggctaattttgtatttttagtagagatgaggtttcaggccactgcattccaccctgggtgacagagtgacattccatgtcaaaacaaacaaaattggttaaaggagaaaaatcatacgataatttcaggaaaagcttgtgacataatacaatgcaaatttatgagaaactctcagctaccttggaaacttttttttttttttttttgagacggagtctcactttgtcgcccaggctggagtgcagtggcacaatctcagctcactgcaagctctgcctcccgggttcacgccattctcttgccttagcctcctgagtagctgggactacagacgcccgccaccacacctggctaattttttgtatttttagtagagacggggtttcactgtgttagccaggatgttctcaatctcctgacctcatgatccacctgccttggcctcccaaagtgctgggattacaggcgtgagctgctgcgccctgccggaaacatttttattggaaaaaaaaaatgtaacaaaagcttacagccaacatcacaattaatgatgaaataccgtagaacatcaagagtaagacaaggatatctactgtcattacttcattcaacattgtgtcagtattcctacccagtgcagtgagatgagaaaaagaaatacaggccgggcatggtggctcacgcctgtaatcccagcactttgggaggcccaggcaggcagatcacttgaggccaggagtttgagaccagcctggccaacatggctaaaccccgtctctactaaaaatacaaaaattagtcagtcatggtggtgggcacctgtaatcccagctactcaggaggcggaggcaggagaatcgcttgaacctctgggtcagaggttacagtgagcagagattgcgccactgcactccagcctgggagacagagcaagactccatctcaaaaaaaaaaagaaagaaaagaaaagaaatataagatgtataaattggaaaggaagaagtaaaactgtctcttttcccctcacacaaataacgtttgtatacagaaaatcatgaagaatctagaaaaaattactagaactagtaagtgaatttaacagcgtaacagaatataaagtcaatgtacaaaatcagttgtatttctacactgatatacattgaatttttaagagggagataatgcagtggtattaagtccaaggctagctgagaaaccccatggtgtcatagtgatctaaaattcttctgtcttttctaccatcctagagtatggtctcattcttcaaagtgacctcatggtctgtgacagctgctgaaacttaagctatcagggtcacactccaggctggaatttggaggaagggcaaattataaacacacacacacacacacacacacacactcacacactttttagctattttagctgtcttttagaaaatccttcctttttttttttagacggagtctagctttgtcacccttgctggagtgcagtggtgcaatctcagctcactgcagccttgacctctgaggttcaagtgattctcctgcctcagcctcccaagtagatgggattagaggcacctgccaccacacccggctaatttttataatttttagtagagacagagtttcaacatgttggtcaggctggtctcaaactcctgacctcagatgatccacccgcctcagcctcccaaagtgctgggatttataggtgtgaaccactgcacctggccaaaaagatccttcttgaacgtttcatatgccactttcacttagagacttaagtcacatggccatatagagaaatgtagtctttattatatgtagcattctacttagttaaatagcaagggttttacttaaagataaaggagggaattgatgttgggatagacagcattctcagatagaaacccctttacttagccctcttagatttggcagcatagaaaagaaaatcccacaacagtagtttcaacaaaatcaaagttttttgtttgttttttctgttacttaaaagtattcttggggaaatatctctcaaaaagcaaagaatggttttgttaggaatatgctatatttttgaatttggttagtaagtgctgagagagggtgggatattttgctttccttcagcattatcttttacaagcagctatatatgtcctgttaacccttgttcttcctcagagacaatggacctcagatagcctatgttcgggacttcaaagcaaaggttcagtatttccggttctggtgtcaggttagtattggaactgtatctctgtactgccttaactttgttgtgttgctttatattacacagtgattgtgaaaatacttaactcacagaaaaacaggtaaaatgggaagcattagaatctctttcatctatttttagagcaaataaatagatttatcaattagatcatttgtgactttggttattcagaaaattaaacctcatgtaatcccagcacttggggaggccgaggtgggcagatcacttgagctcaggagttcaggaccagtctgggcaacatattgaggccttacctctgtaaatatatatatatatatatttcttttttttaaagaagaaaattaaacttgaaaccatctgaataagcaaacattgtcactttttcctcagtagccattactttcagattgcaggaatcttcaaatgtaagtaaaagcattttctgatataattttaaccagctactttatttttatgtgttattttttctgagacaggatctcactctgtcacccaggctggagtgcagtggtgccatcatggcttactgcagccttgacctcctgggctcaagtgatcctcttgcctcagccttctcgctagctgacactacagatgcacttcaccacacctggctaatttttagtagagacagggtccccttatgttgcccaggctggttttgaactcctggattcaaatgatcctcctgcctcatcttccccaagtgctgggattacaggcataaaccagcatgcccggacaccagccatttttatatctatcgtttgatataactgactttgatagataaatacatgttcatacatacatgaacatgtccatacatagatgttatattcagtgtttttttcagatgtgatcaactatttcttatgtatagatatttactggaattaatgattttttatgggttctaaatcaaatgaatgccctagtcaaagttactgtgatgaatatttttacacttgaaactcttgtaattaactggacccatggaagcaagaagaatctggattaactgttggaaaataagattaagtaaagatttatttgacacattattaagtaagcagtgtgcatatgagatcaatcttgtggttcttctgtttgcatatattaatctgtaattagcatgaatactcacagatgcattggtaaacattattgaatataaatttatattcatagtctacttgtttctgtaaggaaagataaaagtaaataaaactttccccttttgatttttttgataggctattttaatgatgagagttgacttaagtcattcttctatttcagcaactggccatgccacagcacataaagattacagtgacaagaaaaacattgtttgaggattcctttcaacaggtactgtttcattctctcaataatttcccccctggctgctagcttaggacccgcttttggtgctgtcagtttaatctgaatggtttggaacttcttgagttgaagtccttgaatttttcaagtgcgatctcattgccagccaccttagggcttaaggggtgtgtgtgtgtgtgtgtgtgtgtgtgtgtgtgtgtgtgtgtttcaggtttccatttctaaactggtatgatttgaaataaatgcataggtaagataataggtttgtgtgtgtgtgtgtgtgtttcaggtttccatttctaaactggtatgatttgaaataaatgcataggtaagataataggtttttggtagccaaaggtctggaaatacccatatgaacattatcagattgtagaaaggagaggggaagacttgttttaacacttcagtattacttggatttttacaataagcgtatgttactcttaacaggaaaaaaagtggtcattggtgacagtatctaaaaaaagatatatatgagttttcagaagtagtcagcagattttttcacttgtcttcagaacttgagttaatttactcgctgggcacggtggctcatgcctgtaatcccagcactttgggaggctgaggcgggtacatcacctgaggtcaggagtttgagaccagcctggccaagatggtgaaaccttgtctctattaaaaatataaaaattagctgggcctggtggctgatgcctgtaatcctgtaaagctactcaggagagtcacctgaacctgggaggtggaggttgcagtgacccgagatcgtgccattgcattccagcctgggcaataagagcaaaactccatctcaatttaaaaaaaaaaaaaaaaaaaaaaaaacttgagttagtctactattcgcctttatcttgcagatattactaataacctactgcaactaaatgttaaaatgattgtgttatgtagaagattaaaataactagtgaaaaaatgtcttaaaatgaaaacatctggttagtccttgttttatagccagatgtggaagtgattattttcaagcaccagtggtattgtagcaactacagcttcaagaagtacggaattgaatgcaaagggaaaagaggttgagacagttggtggtagctggctacttgctttcagaatcagtttttttcatttcctaatggaacgtcagttattgacattaaaggaaaaagccagttggcatcctgctatgtaggagcagaaaactttttagtgggaagtggagctttactgaggccatttagagaattatgagtcatccccttgatctgatgtaagtgtcacaggccattccccaccctagtccttgcccatttctaattttatgttcataaccacccttttatcactctgttggacgagtttcttgaagcaacttgcttacctcttaccagtcctggaaagatgcaaaacatgattaaactgttcctttatcttttgactttgaaacctaaagtcttttgcaaaataactgactagatggttctaaaacagtttttaaagctgtcaccctagatttgacatccatcaaataactggttaataaaaatataagagaacaatttgattgcttaaaggtaacaaaactaattgcaaaattagcatcagattttctttggatagttgttggataaaattgctctgggatagtgtttcttctgttaacacagcacaactggttatgggggaaagtacaggagaaaacaattttttttccttcatattagacatttgttaaaaggaatttttttttaacttttatggatttatttatagtaaagataaggatacaaatgtcttccacacatatgtggtaatctgtggtgctcgccactccctccctcctgggactgacacactgcagcccacgctgctcaccctggagccccatccttgcatgagagaatggcgccacctggggctgtgcgacctgtcagcctgctcattcccttctccagctcaggacagagaaacacaattcattcataaggtttccattctgttataggcagagatttagaaatcagcattgtttttcaaagagtacaaagttaaaccattctgcttagaaaagaataaacccatccaatcatttttcctctagttgagtcaaaacagagatcaaacttctttgatagtgttatgtctgtgttcagacttagacttcagaatcaaaattttgaaatatttatgaggttaataactatctttgaagttaagcagtttactgagcaattaaatatttttgtccatacacattcagatttaactactgctataaattgtcgtaatttctccagtttcagtctgaacataatagcttatagtaataagacacaggttctagtacagattttccaattagtggtatggccctaaacaagccaggttagatctctgccttcacctacatcaaacaggaataataatatatttccttaacctatcttctaggtaaacagatgagattatatgaaaacattttgctaaagtcgctaaacaaacataagaaaaaatatgtaaggtttttctatcacattaactattttttaatatctgactgacatttttgtaatataaccaaaataaaaattgcatactttcttttttttttcttttattgatcattcttgggtgtttctcgcagagggggatttggcagggtcataggacaatagtggagggaaggtcagcagataaacaagtgaacaaaggtccctagttctcctaggcagaggaccctgcggccttccgcagtgtttgtgtccctgggtacttgagattagggagtggtgatgactcttaacgagcatgctgtcttcaagcatctgtttaacaaagcacatcttgcaccgcccttaatccatttaaccatgagtggacgcagcacatgtttcagagagcacagggttgggggtaaggtcacagatcaacaggatcccaaggcagaagaattattcttagtacagaacaaaatgaaaagtctcccatgtatacttctttctgcacagacacggcaaccatccgatttctcaatcctttacccacccttccccgctttctattccacaaaaccgccattgtcatcatggcccgttctcaatgagctgttgggtacacctcccagacggggtggtggcctggcagaggggctcctcacttcccagtaggggcggccgggcagaggcaccccgcacctccaggacagggcggctggccgggcgggggggctgacccccccacctccctcccggacagggtggctgccgggtggagacgctcctcacttcccagacggggcggctgccgggcggaggggctcctcacttctcagacggggcggttgccaggcagagggtctcctcacttctcagacggggtggctgggcagagatgctcctcacctcccagacggggtcgcggctgggcagaggcgctcctcacatcccagacggggcggcggggcagaggcgctccccacatcccagaccatgggcggccgggcagagacgctcctcacttcctagatgtgatggcggccgggaagaggcgctcctcactcctagatgggatggcggccgggcagagacgctcctcactttccagactgggcagccaggcagaggggctcctcacatcccagacgatgggcggccaggcagagatgctcctcacttcccagacgtggtggcggccgggcagaggctgcaatctcggcactttgggaggccaaggcaggcggctgggaggtggaggttgtagctagccgagatcacgccactgcactccagcctgggcaccattgagcactgagtgaacgagactccgtctgcaatcccggcacctcgggaggccaaggctggcggatcactcgcggttaggagctggagaccggcccggccaacacatcgaaatcccgtctccaccaaaaaaatacgaaaaccagtcaggcgtggcggcgcgtgcctgcaatcgtaggcactgggcaggctgaggcaggagaatcaggcagggaggttgcagtgagccgagatggcagcagtacagtccagcttcggctcggcatcagagggagaccgtggaaagagagggagagcgagaccgtggggagagggagacgggagaggcagaggcaggggcaggggcaggggcaggggcaggggcaggcagaggcaggcagaggcagaggcagagctgcatactttcaagaatgacaaaatttagtagttatacaaggtgaattaaaatagtaaagctagtcataatacagaatccactcatccatgtactcattttatcacttaaataataattataaaaataggtaaaattccatgaaaatattcctatttgttctagttcaggaggtcttgcccacatcaatggattgtctggcatcagccactgtttcaggcactcgaacagtcatattgtccatagattttgtcaaacagatttggcagcccaactgtgatctgttagtccatatgccagatcgagcatgtgattctcctcatcagtgattgcatctaacttctcatatatgtgatcttcaaagatgagatgacaggttaaacaagccagagttccctcacatgcaccaaagccatcaatatctggattattttcaaccacaacgtctagcagagaatcaccaacttttcctttggttgttaatgtttcaccatcacagtttataaagtggactgtcactttatcttctgagctgctccgcgcccctgccgacacgctcagcggccggctcgcctccgcgctccggcccggtccccggctcctcagcaggccgctggctccagcgcgggacccggcgtggtgcagccaccggccggccgggtcgccgaggaccgcagaagcggcgcgcagcagccgggcgcccccagcggcagccatcgcccgcggtcgggaactcaaaaggaattatttaaagatagttttaaccttgtgacatttctcatttgcgttgctgtatacctagcctatactatttgtagaatacttggcataaacgtacatatgtcataagcattgaagttttttgttacatctgggattttctggcttgagtgggatgtgaattcataaatgtgatggttttgtgggggaactgagagaacttggcataaacaggtatacttactgatcctctctggatatttaagtgtggtaattcattcttatcactcaataaagtataggcattatatcaacttctccctttccatgttcttctgtatttttttgtaagagtaattgatatatgcagtgctatacacacacaattttggtcaaataatttgttttacgtggcaggaaaccaaatgacctattgattgtagctcagtaatgtactgtccttcaaatatgaagatgatcctattaaccacctatagtgggacacaaaatttgagtagtttttgtaggtagttatcggttgccgctgagaatgagtttccaaagttaactgggtctctctgcagctactggttttcatttctcggttagccagttagctgttacgtgtacctttggctatgagtcaaaaccaaacctaataaccaaaccacaaaaaccccacccaacctctgaccatgcccatctatgttctaagtaattgatacaggcaacattataagtcaatagtagcatcattaaaaataaaatcacggccgggcatgatggctcacgtctgtaatcccagcactttgggaggccaaggccggtggatcacctgaggtcaggagtttgagaccagcctggccaacatggcaaaaccccgtctctactaaaaatacaaaattagccgggcgtggtggcgcacacctgtagttccagctacttgggaggctaaggcaagagaatcgcttgaacctgggaggtggaggtgtggtaagccgagattgtgccattgcactccagcctgggcaacgagggagagactgtctaaaagtaaataaataaataaaatcacgtgtataaggtatataaaaatatagatgtatataataaaatattattaaacgttactataatgtattttctgtatgtgtggttttgactagaccatgaacacctttctgtgtcatgggagatttcagttacctataacgaaggagatgtcaaacctagaagtggtagacagtgtttcaatagcttttttcaccaattattttactttatttttttttagataatgagcttcagtccccaagatctgcgaagacgtttgtgggtgatttttccaggagaagaaggtttagattatggaggtgtagcaaggtagtgataatatgaatactcagaacttagttcctttcctccaaaggtaccattgcacttcgcttgcaagtattattttctcaatcttatattttaggaaaatgaaatatgtcaaattattatacctttattatgctgtagctacagaatttcaaaaaacatttaattcagcactttctatgtcatgtacagctgattgatttcacccacatcactcatttaatcttcagggtaaccttgtgatacagaattttataggatgatgaagaggcttagagactcacctaaggcacataataaattgtagagcctggatgcaagctttgtatcatttaaccagtagccagtgttaagtctaccacctcttatatctgttccacagaaaacacaaggccttatagtgatcaggtcattttccccaccacagattactgatacaggtaatagttactcagtttccaactgagattagtatatttgtcatgaaaatatagaaggttgtacaaaataggagttgaaagtcttaattctgctttcttcatattggagcttaatattggaccctagaagatagtctctaatgagaattgctttgcttattccatgataatatatcacaccaggttaaaaatttgcgtagagctggcattgtgcaaagacaaggactttggggtcaagacgggatttgaatctttttctgctctcaatagtgtgatgttgggcaaatattttcatctgtaaaataagaatattaatatctacatttctaggattattgtgaagagtagaaatattgtttattaatgacctagttcagagcctgtgtctttgtgtgcacgctaattggtggctacattttagtagttcttatttatattatgtttctgagtttaaataaaattatttcaaaatatatgatataatcatagataaataacaaatatgagtagaaacatgtaattttgtataagttaaaggcaattgaagaggagagcaatcattcattcctaataagaaaataaactagcaatattaaagtgtgtcatgagatacacttatcacaagaggccatgaactaacaggaaaagagatccagattacaggcttatgccacatgtattaccccagatcacccatgttacgtagttttagtaaccataatcttatgttaatattggttcatattttcacaatatttgacttagagtctcagcatttttctaatatgtgagtggctggaattaagaactttactgcctctgtgaaattggaagaattttcatattgatttaacgtgtagggagtagtggcacttgatggggattattatgggacttagtaatagatggaatattagattgatttcagccactttactcacatgggtaaatagtgaattttaaatttgcctatgaatagtatttcattgattctaagactaatattttcattttataatatctctgaaattacgatgtatctcaggtaaaattggaaaatacaatttagtcgttcatcaaataaaggtgcaatgttgtcttagattttttgaaatgtaataatgtatatattaccatctaccaaagatggtgtatactaccaactctgtgaaacagatgtgagtttgaacagaagcaataaaaatcaacatgagattagaaaactatcactagctgaggggtatagatccctgagaactttatagcactgttctttgatttcttggtaacctacaagatttttcatcgtaaattttcttttgatttcagagaatggttctttcttttgtcacatgaagtgttgaacccaatgtattgcctgtttgaatatgcagggaaggataactactgcttgcagataaaccccgcttcttacatcaatccagatcacctgaaatattttcgttttattggcagatttattgccatggtaagtgcaggtcaagaattatgtttactttgcttattcagcaatactaaattttctcttaggtgccataacagatcatatgagagaaagggaagtggttttttgttttgttttgttttttatttttgagacagagtcttgctctgtcacccaggctggagtacagtgacacgatcttggctcactgcaacctctgcttcctggactcagtcagttctcccgcctcagcctcccaagtagctaggattacaggtgtgcgccaccatgcctggctaatttttgtatttttagtagagaaggggttttgctatgttggccaggctggtcttgaactcctgacctcaggtaatccacctgcctcagccttccaaagtgctgggattacaggtataagtcaccgtgcccagccagggaagtgtttttttgagacaaagtttcacttttgttgcccaggctagagtgcaatggcgtgatctcggcccaccacaacctctgcctcccaggttcgagcaattctcctgcctcagcctcccgagtagctgggattacaaacaagcatgtgccaccatgtccggctaatttttgtgtttttagtagagatggggtttctccatgttggtcagtctggtctcgaactcctgacctcaggtgatccacccacctcggcctcccagattgctgggattacaggcgtgagccaccatgcctgacccagggaagtgtttttaaatgaagagtacatctaatatattgaaataaaatgattattgtacagttattttaagcggtcttgtttccttttttcataggctctgttccatgggaaattcatagacacgggtttttctttaccattctataagcgtatcttgaacaaaccagttggactcaaggatttagaatctattgatccagaattttacaattctctcatctgggttaagtaagtttctttttccatgtaatttattaaaatatagttatatgcattccgtgtagtattgataacttatccaaactgtaggcacataattggtttattgtatttaaatgatctatatatcaaacctgtctttttattcaatatgataaattttacaaaaatacacccaagatcttcggcaataatatgaccttagaacagaatcttatttcttcttattttgatgttatagcttaatattaattatttaagaacatgggcctttcgttaaaaacttataaattatgattgaattggtggatataacaaatagtgctaatttcatttgtgcagggaaaacaatattgaggaatgtgatttggaaatgtacttctccgttgacaaagaaattctaggtgaaattaagagtcatgatctgaaacctaatggtggcaatattcttgtaacagaagaaaataaagaggaatacatcaggtgagagtgctccttttcacatttcactttttgtttgactacagcacattgataattgcttactaatactaatggagagtatctccaaaaatagtatttgtctctgtactaatcaatatcctatgtaggcagtcatttttcatttctaaaaagtttttttttaagtgtttttaaaagagttttaaggataaaagtcatgcaggatcactcttttaaacatcaactctgtaatcactatgctgtataacatgtcattaaaaagaatctcaaatatatatgcagatattttcatggggaatattgtaaggtgtattaatccactttcctgctgctgataaagacatatccaagactgggcaatttataaaaaaaagaggtttaatggacttacagttccacgagggtggggaggcctcaccctcatggtggaaggcaaggaggggcaagtcacatcttacatggatggcagcaggcaaagagagagcttgtacagggaaaactcctgtttttaaaacctcatcatcggccaggcatggtggctcatgcctgtaatcctagcactttggaaggccaaggcaggcagatcacaaggtcaggagattgagaccatcctggccaacatggtgaaaccccatctctactaaaaatacaaaaattagctgggtgtggtggcatgtgcctgtaatcccagctactagggaggctgaggcaggagaatggcttgaacctgggaggcggggattgcagtgagccaggatagcaccactgcactccagcctggtaacagagcaagactctgtctcaaaacaaacaaacgaatgaacaaaacacttcatcatatcttgtgagacatattcactgtcatgcaaacagcaggggaaagacccacccccgtgatcccatgattcagttatctcactgattctctcttacaacacatgggaattatgggagctacaaggtgagatttgggtgaggacacagagccaaaccatatcattctgcccctagcccctcccaaatctcatgtcttcacatttcaaaaccaatcatgccttctcaacagtccccaaagtcttaacttatttcagcattaactcaaaagtccacagtccaaagtctcatctgggacaagggaagtcccttccgcctatgagcctgtaaaattaaaagcaacttagttacttcctacatacactcagggatacaggcattgggtaaatacagccattcaagatgggagaaattggccaaaacaaaggagctacaggccccatgcaagtttgaaatccagcagggcagtcaaatcttcaagttccaaaatgatctcttttgactccatgtctcatatgcaagtcaccctgatgtaagaggtggcctcccatggccttgggcaacactgcccttggggctttgcagggtatagccccccaccggctgctttcatgggctggcgttgagtgtctatggcttttccagtctcatgctgcaagctgttggtggatctaccattctggggtctagaggacggttgccctcttctcacagctccactaggcagtgccccagtagggactctgtatgggcctccaacttcacatttcccctccacactgacctagcagaggttctctgtgagtgccctgcccctgcaagcagacttttgcctgggcatctaggcatttccatacgtcttctgaaatctagagggaggttcccaagcctcaatttttgccttctgtgcaccctcaggctcaacagcacgtggaagctgccaactcctggggcttccaccttctgaagcaacaacccgggctgtaccttggccacttttagtcatgctggagcagctaggaaacagggcaccaagtccctagagtgcacacagcgtggggaccctgggcccggcccatgaaaccatttttagctcctaggcctgcctacaggcttgtgataggaggggcttccatgaagacctctgacgtgccctgtagacattttccacattgtcttggggattaacattcgggtcctcattacttatgcaaatttctgtagccagcttgaatttctcctcagaaaatgagattttcttgtctattgcattgttgggctgcaaattttccaaacttttatgctctgcttcccttacaaaactgaatgcctttaacagcacgcaagtctcctcttgaatgctttgctacgtagaaatttattccaccagataccctaaatcatctctctcaagtacaatcgtctctctcaagtacaaatccaccagtctctagcacaggggcaaaatgctgccagtctctttgctaaaacatacaaagagtcacctttgctgcatttcccaaaaagtttctcatttccatctgagaacacctcagcctggactttattgtccatattgctgtcagcattttggtcaaagccattcaacaagtctataggaagttccaaactttcccacattttcctgtcttcttctgagccctccaaactgttccaacgtctgcctgttacccagttctaaagttgcatccacattttcagttatcttcagcagcaccccactcctggtaacaatttactgttttcacactgctgctaagacatacttgagagtggacaatttacaaaagaaagaggtttaatggacttacagttccacatggctggggaggcctcacaatcatggtggaaggcaaggaggagcaaggcatgtcttacatgaatggcagccggcaaagagagagcttgtgctgggaaactcccattttaaaaccatcagatcttgtgagacttattcactataatgagaacaacatgagaaaggcccgcccccatgattcagttatctcccactggttctctcccataacacataggaattatgggagctacaagatgtgatttgggtggggacacagagccaaactatatcataaggttgggtaaaatttataactaaaatgatgttttatagtatatcctttctgattatttccattggttcatgctactagtctcaagagctaatagttcattcataccttctcaatagcaattctttccagccagggttaaattttgcatatttacttcttaagttccaggttctgcatttcttgcctggtttttccctccataattgaaagtatactatttaacacagtgagctgtcattatttcttggacaacaatctatccttttaaaagtttattttgaaatctgcttttaaaatgtagtcaattcgtttttgtcaattctccagtttttttgttatgatatgtctagattttcttatgacatatatagcattccagagaggtaatgtttcgagattccaagagatgtactacgtttctcaatagttttgttgctggtaagataacattttaagataatgggcagctaaaaaggtttttagtatctacttcaataatggcttgcttaaaatttcagagtttggggggtttttagtattattttaagaagtataatttccttagaataaaatgcactgatcttaagtgtagaagttgaaatttgacaaatatatatatcagcccaaatgtgagcattttatggagagaagttgtgctagatcactcatttaattaccaattctgtaaacactgttccatatagcatcatgtccatgtaaatatgacccaaattgtggaacttttttttctattctggaccccataaggggccaatgcacacctcccttctcccagccccagaggtaggtaaccatttctgtttagttctatttctataactgtttctgatcttaaacttcctaaaatgaaatcatagagtatgtactcttatatctagcttttagtgtctgattttttcttttatttggtgtttgtgagattcagccatattgtttatatcagtattttattcctttttattgctgagaaatattccatgctgtgtatatctcaaaatttgtttatccattctcttggtgataaatgttttggttgtttctcagtctggggcttttatgagtaaagctgctataaacattcttgtgatatctttttgtggacatatttttcttgagtaaatacctaggagtgaaatcgctgggaaggtgtttgactttattagaaactgccagtttcccaaagtgtttttgccattttgcagtcctactagtagtatttgagagttgcttcacgttcttgccaattcagcattgtcagtaatatctcgtggttttaatttccatttcttccttgactaatggtgtcaagtacgtttttctatgcatattgatcatttgtagctcttcttttgtgatgtgtgtatccaaatcttttatccattctaaaattgggttgtctttttatttgtgattgttggagttcttaaatatttcagatcattgattttagaaactcttctctttcccttcttccctccctcttcttaccttttcttacgatacgtctagatttcgttcttctttgacggagtcttgctctgttgccgaggctgaaatacagtggcacgatcagagctcactgcagtcttaaactcctgggatcaaaggatccccctgcctcatccttctgagtagctgggactgtaggcacaagccactgtgcccagcaaattttttggttgtttttatttttgtagagatgtggtcttgctattttgcacaggctggtctcagactccttgccttaagctatcctcccacattctgttttctaatataaggatttaaagctgcatatttccaactaagtatttctttagctatatcccacaattttttgttgttttttttgagatagagtctcactctgaggttgcccaggttggagcgtagtggtagagtcatggttcactgtagcctcaacctcctgagctccagatagcctcccacctcagccttccaggtagctggaaccacaggcatgtactaccatgcctggcttacttatttatttatttattgtaggagatgggtcttactatgttacccaggctggtctccaaactcctggatccaaacgatactcccactttggtctcccaaagtgctggaattataggcatgagccgccgcatccagtccacacctttttttttttttcccccgagacagagtcttgctctgtcgcccaggctggagtgcagcggtacaatcttggctcactgcaacttccatctcctgggttcaagtgattcttctgcctcagcctcccgagcagctgggattataggcacccgccaccacgcctggctaatttttgtatttttagtagagacggggttttgccatgttggccgggcttgtcttgaactcttgacctcaggtgatccgcctgcctcagcgtcccaaagtgcctggattacaggcatgagccaccacgcccagccacaaattttggaatgttgtgtttttcactattttatttattttatttatttatttatttattatgttttatttttattattaatatttttgagacagggtctcactttgtcacccaggctggagtgcagtggtgaaatcttgcctcacggcagcgtccaattccagaagttcaagcgatcctctagcctcagccaccaagcagctgggactacaggcatgtgccaccacacccacatgacgagatggggtttcaccgtgttgcccaggctggtcttgaactcctgtgctcaagggatccacccacctcagcctcccaaagtgctgggattacagatgtcagccaccacatccagccactctcattgtatttaaaagtatttgttaggtttttttttttttttttttgagacgtagtctctctgtcacccaggctggagtgcagtggtgccatcttggctcactctaagctccgctccctgggttcacgtcattctcctgcctcagcctccggagtagctgggactacaggcgcctgccaccacacctggctaatttttttgtatttttagtagagacagggtttcaccgtgttagccaggaaagtctcaatctcctgacctcgtgatcccctcacctcagcctcccgaagtgctgggattacaggcatgagccgccgtgcccagccaggtcttatttttatcctgataatctctactttataattggagtgttcagtacatttatgtttaattttattactgatttggttggacttttgtctaaccattgctatttgttttgctatttgtctcgccttgctatttgtttcttatttttcccaactttctttgttctttcttgccttctttgaataaagcaatttttactttcttttttagctcttctgttggttttttagctatacctctttgtttaactttagtggcaactctaatgattatgataatatgcatctttaacatccctgttgacccaaacactacttcttgtacaatataagaagctcataggccaggtgcggtggctcacacctgtaattccagcactttgggaggctgaggtgggcagattgcctgaggtcaggagttcgagaccagcctggccaacatgatgaaaccccgtctctactaaaaatacaaaaatcaactaggcatggtggcaggcacctgtaatcccagctacttgggaggctgaggcatgagaatcgcttgaacccaggtggcggaggttgcagtaagtcgagatcacgccattgcgcttcagcctaggggacaagagcgagacttcgtctcaaaaaaaaagaaaagaagctcataataatataattccatttacctcactccagctctttgtggtgttgttgtcatatattatttctacgtgtcacaaatataatactttgttactgttattcttgctttaatttttaactattttcaaaaataatcttatatttactcacattactatttctggttctccttatttctttcctcagattcatttttttttttaaatctaagataatttccctttggctttaaaaaaaaaaacctttctttaccatttcacttagtgtgcatctcttggtgatgcattttctcagcttttatatgaaaacatctttatttcaccttcattttttgaaggatattgtcactagatttagaattctaggtttataaaataatgatgcggtcatgtttttatgatttatgttttaaaaaataatcctcatgtcgtagagacaaatactgaagtatttgttcaaaatgaaattatctgggctgggcgtggtggttcgtgcctgtaatcccagcactttgggagaaggcaggcagaacacttaaggtcaggagttcaagaccagcctggccaacatgatgaaacccccgtctctactaaaaacacaaaaatcagttgggtgtggtggcgcacgcctgtaatgccagctactcgggaggctgatgcacaagaactgactgaacctggaaggtggaggctgcagtgagcccagattgtatcattgcactccagcctgagtgacagagcgcgaccctgtctcaaaaaacaaaaacaaaataaaagaaaaaaaaagaaattatatggcttggcaatggtggcacacgcttgtaatcgtagcactttggatggcggaggcaggaagatcacttgaggccagatatttaaaaccagccttggcatcacagagagacaccatctctacatacaaaaccaaaaatcagccaggcgtggtgttgcacacctatattcccagctactcgggaggccgaggtaggaggattgcttgagcccaggaggtcgagactgcagtgagccaagattgtgccactgtgcttcagctcaggtgacagagtgagacctcatctcaaataaataaagaaatgaaattatatgatatctagggtatgagtaggggcatagatgaaatagatgggcattgtgatgaagcttggacatgtgtacagggggttcattatgttctatttttgaatatattttaagttttttataattttttaaaatttatttttatactcagaatttaaagataagatctaaacttcctgataggttttttcatatttgtttgccagaatggtagctgagtggaggttgtctcgaggtgttgaagaacagacacaagctttctttgaaggctttaatgaaattcttccccagcaatatttgcaatactttgatgcaaaggaattagaggtaatgaattttccttcattcccctgtaccatgctagtaaataatgccttaagttgtctgcttttaactcactttcccatctttcctgttactgtaatatttttatactggggcaaaatgttttgaaacatccccaatggttaaagaaaatcataatttatccaaagataaaacaatagtattaccccctccaaagtacaaatattagagcttctctacaattgagtgacttacttccctgaatatgtatatgtatgacaccgtgcatggaaccttgccttcatgagcaatgtagatataattcttgatgtatagttgataagtcaaagcctactgattgttattctaaagctttgcttaatcttagtctttcctatgtccagctgtttttgtacagttaccttaggaaacaatttgtctttttcatccctaaaggtccttttatgtggaatgcaagagattgatttgaatgactggcaaagacatgccatctaccgtcattatgcaaggaccagcaaacaaatcatgtggttttggcaggtttgtttttaaatttatttctattagttgacacagcataattttttagaatttgcttaccacatatggaaatgagtcacaggtcaaaatgtaccagtgtatatagaccccttagtccatgcattataataaatgaatacagattataacagcatccttttaagactattgccaagtaagccacacataccttgcatctttgtccaaagtagagtgtaagacaattcgagatgataaaatttacctacatttgatttaaatggttttggggttttataggactgtctgtagtatgttttttatcatttatacttcattaattatataatgttcagaaggcaaaatttaagagacttggtttagaatcataacggtatctctctaaaaatgtctgccttaagcatggtatatgatgttcaacatcattagtcattagagaaatgcaaatcaaaaccacagtgaggctgggtgcggtggctcacacctgtaatcccagcactttgggaggctgaggcgggtggatcacgacatcaggagatcaagaccgtcctggctaacacggtgaaattagccgggcatggtggcacatgcctgtaatcccagctacttgggaggctgaggcaggagaatcacttgaacctggaaggcagaggttgcagtaagccaagttcgcactactgcactccagcctgggtgacagagcaagactctgtctcaaaaacaaaaacaacacaatgagataccacatcacacttagtattatttttgaagtggagaagaacaaccattgccaagggcgcattgctggtgatagtgtgaaataccacaccactgtggaaatagtttggtggttcctcaaaatttaagcatagaattaacataagatccaggaattccaatccttggtatacagcccaaaaaattgaaagcagagacttaaacagatacttgtacaccagtattcatcattcatttaccgacacaaaatgtggtatatgcatatacagatgctcctggacttggagttttatcctttatatccatcataagtcaaaaatatcttgagttgaaaatgcatttaatacccttatcataacttacccattgtaaagttacattgtaaagtcacaacttacccattgtaaagttgaaaaatcataaatcgaaccatcataagtctaggtgctcctcaacttatgatggagtaataaacccaataaacccatcataaagtcaaaaatttgtaagccagggactgtctgtgttggaatattattcagtgctaaaaagtaatgagatttttggtatgtgctacaacatgaacaaaccttaaaaacattatgaattttaagataagcgaagtaagccagacacaaacggacaaatactgtataattccacttacatgaggttactagaatgggcagcttcatagaggcaaaagtagaatatgggttaccagaagttgcagggagcaaaaatgggaagttgtgtttaatgtgtacataggttttacttgggatgatgaaaaagttggaaatagtggcgatggttgcacaacagtgtgaatgtacttaatgtcattgaattacactcaaaatggttaaaatcgagaatttatgttgtgtatattttacaaaaatttaaaaaattaaaaaaatctggtatacatgtaaaaaaattcatatgagaaacttaaactgagcttctataacaagtaggattacaattgtaggataattaataatactacaataggataaaaattattccttataaaaaagtttttggctgaggcaaaacagttatactacaggctagaaacattctctagaaacctattgttttgagtcagaattgtatgaaataaaaaccacataattctagctatgtgtagctataccaaaacctaaagaacattgagaagaggaggttattgggatatatcctgcatcagaattctgtgagtttgattaaagttgtttattaaaccaaaaagtctgtactgactcaaggtctgtatcctgtgtagccacatgaatatcctataggacgggcaaatctggggctggggggtggtggtgggatggggagtcacaggaagggctgccctagaagagctaatcttaaaactgcgtgagtacggagctcttggtctcagtccatcttactttttatatatccctttaagtatattgtcctaagatttatataaggaaaggttgatggggctttgataaacatggaaatggccctccatccatagtgttaagtaattatctaatgcagtggacaccagagtttcctttaagatttgaaatgagctagatacagtggcttgctcctatagtcccagctactctggaggccgaggcaggaggactgcctgctgcccaggagttagaggctgcaatcagctatgattgcatcactgcaccccagcctgggccacagagcctgggacacctcacctctaaaaaaaataaaagatttgaaatcattatttttctttcttgtttagtgtgctgaatgtaacatatgacatatatatctctttaaatatacttttaacagtttgttaaagaaattgataatgagaagagaatgagacttctgcagtttgttactggaacctgccgattgccagtaggaggatttgctgatctcatgggtatgtatacaggatcacttttcctatacagaaaattgtttatcatgctgctttacgtaaatgtgtatacagcctattagaaacaacaaagacagggatagccattttcttaactattcccagttagcatggatttgtataacctttaaaatagtttttagtacttacctttgtagaaatttttaaccctcaagctagaacccacagctaactcattaggacagcagtcttctgtatgtaaatctgttcatttagtcatttgccaaacatgtgtgtcttaagagtcaatcactattggttgtattatttaacgatgtgagaagatcattatataatacaatagtggattgtagttttagtattgtgtttaaaaccactcttccctgggagactgggagttctttgagaaatggattcatatcttcatctttttatttcttgcccctggcaaagtgcctgttacacagcaatctgctgcttaaaatgaatattaagatgaatgactatggcaatattcactttgttactaaacagtaaattatttaagtaaattcaagtatttccttaataccaacattatcccaagtatcataggaggatacacagagaagttaagatcccaaagcctgcttcagactgaagcagagagtcaaaattagaactaagcaggtaattttgaatacagaacatggaaccagtttagaaagtactttaaaagccagaaaaagaatttggatattaccgtgagggtattggaagctgtggaactttttgaagagaggaaaacttgctcaagctgcatttaggaagatttgataggaagatacagtgtggattaaaagatggtgaggacctagagataagaagaaatcattgcagcaatgatgagaacctgatctcaggagatgaaagtagaaatagaaaagagggggtagatactaggtaaagttccaaaggagaaacaggtagagagcttaatagaaaatgaagtataagagaggggtatcagcaataattgtcatgttatggaacatggagcaatggagaagttaggaagtataaagagtatgcatcgttgtagatgttgggggaggatgctgagcagcttagaacctgctgaatttaaggtaactgctggacaaccaagtagaaaaccccagggaagcagctgtagaggtaacaatatatgagttagagttaagaggaaacagaagaagttgaatcatcagagcagtgacatttgatgctgtgagaatgtgtggtcttaggcagaaatagaatacagagaggagtagaaggctaatgcctagaaccatctgcatgtagggataagacagaaggagatagcctaggccaggcacagcctcacgcctataattccagcactttaggaggctgagctgggtggatcgcttgagctcaggagtttgagaacagctgggacgacatggtgagaccccgtctctactaaaaatacaaaaattagccgggcgtgttgacgcacacttgtagccctggctactgggaaggctgaggcagggagaatcgcttgaacccgggaggcagaggttgcagtgagctgagatcgtgccactgcactccagcctgggaaacagagtgagactccatctcaaaggaaaagaaaagatggaattagtctggaagccaatttaaaggagagaccagagagtgaaaagaagaaagaaatagtatactgtctgagaagcaattagaaggaatttttttcttcagtgctacagagaggtctcagaagggtgatttctaggaaagtttttgttaggagacagaaacagtgagattgtggtttggagaattttagaggctatctagtttattttgtttgttttagtttcaaatctttattcttttttactttttaaattattcttaattgacataattgtacacatttaggggtacagtttttattttgatacatgtatacaatatataatgatcaaattggggtaattaggatatccatcacctcaaacatttatcaattctttgtgttgggaacattcaaaactcacttttctaactatttataaacatacagtccaggtgcagtggttcacacctgtaatcccagcactttgggaggctgaggcaggaggaacacacgagcccaggggtttgagacaagcctgggcaatatagggaaaccctgtctctacagaaaatttagaagttagctgagcgtggtggtacatgcctgtagtccctgctattcaggaggttgaggtgggaggatcacttgagccttggaggtgaaggttgcagtgagccaaggtcatgccactgcactacagtctcagtgacagagtgagaccctatcttaaaaatacatacactgggcgcggtggctcacgcctgtaatcccagcacgttgggaggccgaggcaggcggatcacctgaggtcaggagttcgagaccagcctggccatcgtggtaaatccccttctctacgaaaaatacaaaaaaaaaaaaaaaaaattagccaggtgaggtggtgggagcctgtaatcccagctacttgggaggctgaggcaggagaatcacttgaacctgggaggcagaggttgcagtgagtcgagattatgccactacattccagcctgggcgacaagaacaaaactccaactcaaaaataaataaataaataaataaataaaatatatatatatatatatatatacacacgcacacacacacacggtaaattgttgttgattatagtcattgtatagtgctatagaacactagaacttattcttcctgccgatctgtacttgtgcatctattaaccaacctttggctctcccctcattcctgccacccttctgtagtaaccactgttgcactttgtacttctatgagatcggctttcttagctttcacgagtgacagcatgtagtatttatctttttgtgcttggcttatgtcacttaaaacgtcctccatgttcatctatgttgtcataaatgacagaattttgcttttttaaaaaatgtctgaagtattccagtttgtttatacaccacattttctttatccgtttacctgattatggacacataagttgattccctatcttggcccttgtgaatggtgctgcagtagacatgggagtgcagatgtctgttcgacatactgatttccttttctttagatgaatgccccatagtgggattgctggatcatatggttgttgggcggctgagatgggtggatctcttaaggccaggagtttgagatcagcctggtcaacatagtgaaaccctgtctctactgaaaatactaaaaaaaaaaaaaaaaaaaaaaaaaaattagctgagagtggtggtacacgcctgtaatcccagctgcttgggaggctgaggcacaacaattgcttgaaactgggaggcagaggttgcactctagcctgggtgacagagcaatactctgtctcaagaagttaagaagaagaatttacatccctgccaacagtatataagagttcctctttttccacatccttgccagcatttgttattttttaatctgtaacagttattctaactgaggtgagatgatagttcattgtggttttgatttgcatctccctgatgattagttatgtttaacattgttattttgagagatatctatttagctcatatcccattttttaatgcattgtttttcttcttttttgctgttgagttcttgtatattctggatattctttgttggatgaattgtttgcatatactttctcccattctgcagattgtctctacactgtgttgattgtttcctttgctatgccaaagctttttagtttcatataacccaatttgtctatttttatttttgttgcctgtgctttttatgtcctctttataaaatcttggctcagggccaggtgtggtggctcgtgcctgtaggcccagcactttgggaggccgagacgggtggatcacctgaggtcgggagttcaagaccagcctgaccatggagaaaccctgtctctactaaaaatacaaaaattagctgggcgtggtggcgcgtgcctgtcatcccaactactcaggaggctgaggcaggagaatcacttgaacccaggaggcggaggttgaggtgagccgagatcgtgccattgcactccagcctgggcaagaagagcaacactccatctcaaaaaaaaaaaaaaaaaagaaaagagaaaagaaaaatctttgctcagacctgtgccctgaagcatttttcctgtttaatccattttgagttgatttttgtacgttatgagagaaaggggtctactttcatttttagcatatagatttctgttattccagtaccatttattgaagagagtgtcctttcccccaatgattgttctttttttttgagacagagtctcactccgttgcccaggctggagtacagtggcgagatctcggctccccacaacctccgcctcccaggatcaagcaattctcttgccttagcctcctgagtagctgggattgcaggcacgcaccaccacacctggctagtttttttatttttaatagagatagggtttctctatgttggtcaggctggtcttgaactcctaaccttgtgatctgcctgcctcagcctcccaaagtgctgggattacaggcatgagccactgtgcccagccaatgattgttcttagtgtctttattgaaaatcagttggatgtaaatatgtgggtttgtttctgggttctctcttctgttccactggtctatgtgtctgctattatgccagtaccatgctgtattggttactatagctttgttgtatatcttgaagtccagtagtgtgatgcctccagctttttgttcagaatggctttggctattcaggatcctttgtagttcagtatgagttttaggattgttttttctatttctgtgaagaatgtcattggttgtttttgtttttgtttttgttttttgagatggaatgtatcactctgtcacccaggctggagtgcagtggcacattctcagttcactgcaacctctgcctcccgggttcaagtgattcttgtgcctcagcctcccaagtagctgggattacaggcatatgccaccacacccagccactttctgtatttttagtagagatggcatttcgccatgtgactggtctggtcttgcactcctgaactccggtgatccgcccaccttggcctcccaaagtgatgggattacaggcatgagccactacacccagccgtcattggtatttctgtagggattgcattgaatctgtagaaatttttaatagtacggttattagtggagtattaatttttcaacccatgaacatgggatgtctttacattttttgtgtgttttcttcagtttcttttgtcagtgttttatagtttttgctgtagagatcgttcacctccttggttaaatttatttctaggtttttgttgtttgtagctattgtaagtaggattgctttcttgatttctttttcttctagtttgttgttttatagaaacgctgctgatttttgtatgttgattttgtatcctacaactttacttaatgtgtttatcagttccaataattttttattggtggagtttttaaggttttctgtatataaggtcatgttgtctgcgaacaggtatagttcaacttcttcctaattctgatgccctttatttctttctcttatctaattgctttggctgggacttccagcagtttgttgaataaatgtggtgaaagtgggcacccttgtcttgttccatatcttggaggaaaagcttttagttttctctgttcagtatgatgttggctgtggatttgtaatatatagcctttattatgttcaggtacattccttctgtgcctaacttgttgagagtttttcttatgaagtgatgttggattttattaaatattttttctgcatctattgagaagatcatatggtttagcccatcattctgttgatatactttgttatgttcattgatttgtatatgttgaaccatccttgcaacctttggatctttttaatgtgttgctgaatttgatttgcttgtatttcattgaggatttttgcatctgtgttcatcaaggatattggcctatagttttcttttcttttcttttcctcctttttttttgtttttgtttcttgtatccttgtctagttttggtatcagggtaacgctggccttgtagaatgagtttcaaaaaattctctcttctattttctggaagagcttgaaaagaattggtattagttcttctttaaatgtttgttagaattccattggttcctagacttttgttttctttgatgggagactttttttttttttcttgagacagagtcttgctctttcacccaggctggaacgcagtggcacgatctcggctcactgcaacctccgcctcacaggttcacaccattctcctgcctcagcctcccgagtaactgggactacaggcgcctgccaccatgctcggctaattttttgtctttttagtagagacggggtttcaccgcgttagccaggatggtctcgatgtcctgaccttgtgatccgcccgccttggactcccaaagtgctgggattacaggcgtgagccactgtgcccagcttttttttttttttttttttttttttttttttttgagacagtcttgctctgacacccaggctggagtgcaaatgggagactttttattacagattcagtcatgttacttataattgatcttttcagcttttctgctttttcttggttcagtcttggtaggttgtatgtgtccaggaatgtatcaatttccataggttttctaagttggtgtgtagttcataataatttctaaaggtcctttgtatttctgtggtgtcagttgtaatgtctcccttttcgtttctgatttcatttatttgggtcttttcttggttagtttagctaatggtttgtcaattttgtttatcctttcagaaaaaaaaaacaacttttcatttcatctatcttttgtcttcatttttagcctcatttttgtttatttctgttttgatctttattatttctttccttctagtaattttgggtttgctttgttcttttctggtttctcaaagtgtatcattaggtcatttgtttaaaatctttccacttttttgatgtaggcatttattgctataacattaccttttaatattggttttgctatattttataattttcaatatattgtgtttccatttgcatttgtttcatggaatttttaaatttccttttacatttccccattggtcattctggagcacgtttaattaccatgtatttatacaattttgaaagttcctctttttattgatttctagtcttactccattgtgttcagaaaatatatttgacattatgacttcagttcttttaaatttgttgagacttgttttgggtcttaatatgtggtttccccaggagaatgttccatgtgctgatgacaagaatgtgtattctgaagctgttggatgaaatgttctatgaatgactgttaggttcatttggtctgaagtacagtttaaatccaatgtttctttgttgattttctgtctagatgatctatccagtgctaagagtggatattgaagtccccaactagtattggagtctgtctttcccttttaatataataatatttcctttttatatctgggttctttggtgttgggtgcatatataactctcatatcctcttgttgaattggtccctttatcattatagaatgccctttgtctctttttatagtttttgatttaaagtctgtttgcctgatatatgtatagctactcctgctcactttggatttccatttccatgaaatatctttttcatcccttccttttcagtctgtatgtgtctttacgggtaaagcaagtttcttggaggcagcatatgatagttgggtcatttttctttttaaatctattcagccagtctatatctttttagtagggaatttatccacttatattcaaggttattactgatagatcaggacttactcctgtcatttttaaaattactttctggttgctttatatatccgtcgttcctttctttctctcattgtttatcattatggtttttgtggttttctatagtgctaaggtttggttcttttttcccttagtgtatctgctctaccagagtgttatattaatactttttgtgtattttcatgagagtgattatcatcttttcacttccagatgtgggagtccgttgagcatttttcataaggtgatgaattccttctatttccccatgtctgggaaatactgtatttctcctgtatgtctgaaggatggttttgctgggtatagtaatcttggctgccaatttttttcttgcagtactttgaatattatctcattctctcctggtctgtaaggtttctgcagaggcagccatctagtttaaacttccacccagcacaggaagagaaagttttagaggtggtgtatgtaattctttaatgggatgcttcttgaccttggggatggatccaacatcccacttttattaatatatattcataatatcccctttaatacactgatttatggatgaaataacctattgacaatccctagaaaatacttatacatagccttaactgtaatataagggattaaattttttaggtaatttataatgaaataatatgtgttttaatacatgtctatttggggacaactatgttagaagatatacctaagaagtcaaatatttgttcctacttataagaaaaggtttaagacaagatcaaaagccattctctataagaagtactggaagggctgagtgcggtggctcacgcctgtaatcccagcactttgggaggctgaggcgggcggatcacctgaggttgggagttcgagaccagcctgaccaacatggagaaaccgtatctctactgaaaatacaaaattagccaggcgtggtggcacatgcctgtaatcccagctactcaggaggctgaggcaggagaatcgcttgaacctgggaggcagaggttgcagtgagccaagatcgtaccattgcactccagcctgggcaacaagagcgaaactccatctctcaaaaaaaaaaaaaaaaagacaagtagtactggaaaataaaagaacagatgagaaagataaataatagacttaagtatatgtgataacaaaaggagggaagtaacctaaataaagtatgaataatacacctgcaaaaataaattatagatggtcaaggtggagaaaaatgaggtagatcttaaaagcatagtatcagaatatatctcctgtcatgaaattctactataggccaaggctctaacatgtaaaaaagcctcggagaccataacatttgaaaggtggctgaaaataggaacataggtacaaaagtctacacagaagttgtatggtttagggacagtgtcagagtttttaatatttgattttaaatctattaaaagcaattcagaatcctttctgttacatactaatgtgcattattaaatgaaactcctttccatctatgtagttaaatatgctgctaggtatggtgggcacacatctgtagtcccagttatttggaggctgaggcaggagaattgctggagcccaagatttcaagcctgtagtgcactataactgcttctgtgaacagccactgcacttaagcatgggcaacatagtgataccctgtgtcttaaaaaaaaaaaaaatttataaaaaatgaaatgtgaccaggtacagtgactcacacctgtaatcccagcactttgggaggccgagacggttgggtcacttgaggtcaggagttcaagaccagcctggccaacatagtgaaaccccatctctactaaaaatacaaaattagccgggtgtggtagtgggcacctgtaatcccagctactcgggaggctgaggcaggagaatcacttgaacctgggaggcggaggttgtggtgagccaagattgctccactgcactccagcctgggagactccgcctcaaaaaaaaaaagaaaatgctataaaatattgagtagagggtggacatgatggctcatgcctgtaatcccaacactttgggaggccaaggtgggttgatcacttgaggccaggagttcaagaccagcctggccaacatggtaaaaccccatctttactaaaaatacaaaaattagttgggtgtggtggtgcacatctgtaatcacagctactctaaggcatgagaattgcttgaacccaggaggcggaggttgcattgagccaagattgtgccactgccatccagccagggtgacagagtgagactctgtctcaaaaaatatatatattgagtagagagaacatgcagagtgagttaattttaatttatgtgttgaacaccacagaataattttaactgtgtttttttataacgtttcctatattactggactttttacataactacttgtgaaaacaattcagtgttattaaatacaaaagcactaacaatttatattgggtatacttagtatacagggtttagtcaggtgggacatgagaaagttctttgtgtctgacagtgtcacacattacagaacagttagcgttcctgcccccttctaattaaaatatctagtagcattaccagtcattgagaccaacaataaatgcttcctagggaaaagtaatgatcttttaaaaaactggtgtttttatgatcacttttcacagctatctccagcagcaggtaaatgaggggcaagtattttatgtttatacttgtatctgtttttgtaagggtatgccctacaggacctgtaagttccagcattaataatatggaattcactaggatatttacatttcacaaagttttattaattctgtatttaaatcaagttttattgtagtttcgttattgtctttcaaactactaaaattaagctttttgtgtgttcttgtgtaagcttttattaatcataacaatgtgttattccggctaaagaatgctagatgaaactgcattttctcctttgggacttatattaacaaactatagtcttcaaacttttacacttaccagaatcacccggaagcttgttaaagcacatattgctgagcctgacccctagagtttcttttttgtttgttggttgcttttgggttttttgggtttttttttttttttggtttttttttttttggttttttttttttttgagatagggtctcgttctgtcacccgggcgagagtgtagtggcgcaatcttgagtcactgcaactttgctgcacagattcaagcaattctcctgcctcagtctcctgagtagctgggattacaggcatacgccaccacacttggctagtttttgtatttttagtagagatcaagattcaccatattggccaggctgatcttgaactcctgacctcaagtgagctgcccacctttgcctctcaaagtactgggataacagacatgagccaccacacctaacccagagtttctgaattagtaagatgatgtgtggggcctgaggatttatggttctaacaagttccctcatgatgctgatgcttgttggattggggaacacagtttgagatccactatactaacaaactgtttatgatttcattatgttttagggagcaatggaccacagaaattctgcattgaaaaagttgggaaagaaaattggctacccagaagtcatacctggtaagtacaatcagaatggatagagaaaacagcttttgtccagttatctgtagctatttaaagccagctagaaattaaaaatgatatttagtagatttacagaatagcacagccatcatagcaatccagtttaagagcattttgttcacccctgtatgattccttacaactatttgcaatcaattccttttttcacatctgaattttttttctaatgtgggatttagagttattttaacttttctctgagggcagcaaaagaaagttaggagacctactttctaacatcatgaccacaaatattctcatttgaaatctaattacatttctaaaaatgtagaaaactaaatctaatcctaatctgacagcaaatatattaatattttggaattcaacctaatgtcaacaatatttgaaccttattttgtgggatatattttagtggtcacatatggtccttcctggatatctgacctctttactgttttactaatgtctattcctttttgtttttatacataatgttttgtacatgcatgtagtgtttaagtaacaattttattgatatataatttacagattataaaactcaccttcttaaattatgcagttcggttcagtggggtttttttgtttgtttgtttgtttgtttgtttttgagacagggtctcactttgtagaccaggctggagtgcagtggtttgatctcagctcactgcaacctccgcctcccaggttcaagcaattctcttgcctcagcctcccaagcagctgggattacaggcgcccgtgaccacgcccagctaatttttgtatttttagtacagatggggtttcgccatgttggtcaggccggtctcaaactcctgatctcaggtgatccacccacctcggcctcccaaagtgttgggattacaggtgtgagctgccgcatctggcctgttcagtgattttagcatatttatgaggttatgtaagcatcattactgtctaattccagaattttttcaccctcccaaaaatccatgtacccattagcagtcactccctttttaccccgtgtagcccttggtaaccactaatctactttctgtctctatgaattttcctgttctggacatttcatataaaatgaatcatacgataaatatataacttttttttttttggagacagtctctctctgtcacccaggctggagtgcagtggcgtgatctcagctcattgcaacctctgcctcctgggttcaagtgattctcctgcctcagcctcccgagtagctgggactataggcagcatgcaccaccacgcatggctaatttttgtatttttagtagagacggggtttcaccatgttcgccaggctgttcttgaactcctgacctcgtgatccacccactttggcctcccaaagtcctgggattacaggcgtgagccactgcccccagccaaaatatacaaccttttgtgtgtagcttcttttacttagcatgttttcaaggttcatccatggtctagcatatacagtatttcattcctttttaaaattaattgttgggtttaatatacataacatagaatttaccatttttaagtgtgtacagttcagtggcattaagtgcattcatatcattatgcagtcatcaccatcacctatctccaaaaattgtttcttttgttgagacatgtctcagtctgtcacccaggctggagtgctgtagctcaatctccactcatgcaccctccacctcccgggctcaaactgtcctcctaccttagcctcccaagtagctgggacgacaggcatgtgctaccacacctggccaatttctaaactttttgtagagacagagtcttactttgttgctcaggctggtctcgacctcttgagctcaagcaatactcctgctttgacctcccaaagtgctggaattacaggccatcatgccagacctaaaacatttttcatcttgtaaaattgaaatggtacccattaaagcaggggtccccaactcctggtccccagcctgttaggaactgggctgcacagcaggaggtaagtggagggtgaatgagcattacctgctgagctccaccacttgtcagatcagcagaggcattagattctcataggagcaataactattgtgaactgtgcatgtgagggatctagattgtgcattccttacgagaatctaacctgaggtggaacagtttcatcctgaaaccatccccctctccactcctgtccatggaaaaattgtcttccacaaaaccattgcctggtgccaaaaaggctggagactgctgctttaaacaatgactccccatgactccctttccccaggtcctggcaaacatcattctactactgtttctatgattctttagtacttcgtaagtgtagaatcgtaccttatttgtcctttcctggctggcttatttcacttagaataatatctttaattttcatccatgttgtagcatgtgtcagcatttcctcctttttaatgctgaataatatttgatagtctggatatactacattttgtttatacattcatctgtccatggacacttagattatttccaccttttggctgtttatgctgctataaacataggtatactgtggtagaatatagatatatctgtccatggccctgctttcagttgttttgggtatatacccagaggtggaattccttgatcatgtagtaattctatttttaattttttgggggaatctcgccatactgttttccatagtgactacactgcgttatattcctacctgtagtgcagaggggctccaatttctccacatcctcacatccttttcaactcttgttttcttctgttttttttttttttttttttttttttggttgttgttgttgttgttttggtgttttaaataatagccatcccaacaggtgtgaagtggtatctcattgtggtttttatttgcatggtaaaggatgttgagcatttttttaatgtgcttattggtcatttgtatgtctttggagaaatctctatcctttgttcatttttaaatattgttgagttttaagttttttatatattttggataccagtcctttatcagatatatgatttacaaatattttttcccatttttgggttatttcactttcttgatggtatcctttgaagcacagtagtatatttttgtgcttctatagtagtgtataaagtagtatactacactactcatttgattctttgcatatttccttttctcaaactaacaattcttgcttttagttttaatcgcctggacctgccaccatacaagagctatgagcaactgaaggaaaagctgttgtttgccatagaagaaacagaaggatttggacaagagtaacttctgagaacttgcaccatgaatgggcaagaacttatttgcaatgtttgtccttctctgcctgttgcacatcttgtaaaattggacaatggctctttagagagttatctgagtgtaagtaaattaatgttctcatttagatttatctcccagtgatttctactcagcgtttccagaaatcaggtctgcaaatgactagtcagaaccttgcttaacatgagattttaacacaacaatgaaatttgccttgtcttattccactagtttattcctttaacaacaatattttatgtgtgtcaaaagtctcacttgggagtagtgtttttttcttttagacattctgcagacatgcagggaagtcctttggtaactgcaatatacaagattttcctattaagcctcttggtaagaggcatttgttaaaagtgcaagcttactcctgcttctggggatgtgagcaaaattcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactttacaaacaatgttaacactgtgattccttcattgttttaagaagttaacctagggccgggcatggtggctcatacctgtaatcctagcactctgggaggccgaggcaggaggatccctttagcccaggagttaaagaccagcctgggcaacatagggagaccctgtcttttttttgggcagcgtggtgggggataaataaataaaaggaaaaaaaacttagcctagaattagaattaatttaattgaattcatctaaagatgtctctggtgatttttatatgttccgctatataattgatgctttatagttttatcataatccaacaacttcagttatatttaattattgttaaggagtttaagactagaaagactagagtgctttctagtccaaatagaggtcagtgaaacagcttttgacatcagattttcatttgagagggagagctgtggtactggctaaaaagaaaggaagataacatccagtaaccacaggaatatattctctgtgaattaaaagtcttcaaagttatcatttctctgacatatgttggagtagtcatttccattctttacattgtcatgaactggattgataaccctcatctgcaatattttcacccctaaaatttttaacagggtttcctttttttctcacgactatttaagtttagattgctccattattaactgattaatgcactttgaagttctctggaattaattattttaacttggcctagcttcgactgtcaaggtggctgttataaatttgacttcattggcagtggatgaagcctaagccagctgagtctctatcatagctgaaccctgaggacagcctcatagctcatgtatcagggacttttgccacatttcagaggcatagcatgaacaagtaatattaagccaagaataagcagcagaaccctgttccatatggaaaaaagaaaaacaattttttgtccctaatgttcttccttttacatcctggaacaacaataaaaacatttttttaaacttgtctactgtaagatactgccatcataaagcagagacttacatgagtgaaagggttgcctcatcaagcagctcagtgtaaatggggaggctaggctctccccagccctatggtttttttatttcatgtaccccaggaaatactgtgtggtttctaaaagccctggttgttaaaagtagggactctgcctttttgttggtagggagaaaaaacgctattgctttgtcttacagagcgaatgtctgccaactacccgttcattatataagtctgaacttggtaatatatggctaatgaagattaagccctctataaagacttcctgttgaggtgaattctcatactgaaatgtagttacctacaatatttactagagatttatgaaattaaattaagagataatgtaagaaaatacatttttttggttctatataatgcttcatgattcatttagggacctagaaatattgtgtgaaaatatataaatatcacccaaaaggctttctgccctatatttttaaaatacagaatagttatatttgaagtagccctggccctagttctatagggcttggctatttaatatttttatggaagaagtgtttagttctggaaaaggtaaatgcttgtatatatttttgcagcctgggatctccctactccattttttcctttaatttaagtggccacatgtatatgtcttccctgctgtgttaggaaaatgggggctggatatcccaagaatcagaggttatataaaaatactgcaaatagaccgcagacataaatatctaccaaatgctatcttaaattttggtccaaactgaacatatggaaatagatttattgtaagtatttacttagagctttttcttaaatctgaactaacttgcttttagaagtctttttctttgtaagcattgtaaatgctaataaatcctgttaatttttttttttttttttttttttttttactgcatgttacattgaaataaaaacaaagtaaaatgagcaattgccttattgttctgctcttttgcagggggtgggggttggggaagacagcattccacagcctggtcaggagggaaggacctcacttgtttcatcaaatggagtggtttaaaactgatcaagcagctcataataatgaattcctgctctgtcttttattatcttatgtcagagtgcagcaaaatctcatttcataagacttacaataactctatttaaaattcaggtattgtactcgggaggctgaggtgggaggatcccaggagttcaaatcctgcctgggcaacatagcaagaccctgtctcttaaaaaaacaaaaagacatattcaggtactgatttttcatcaagagattgacataccaatgatcagaaattttagtgaaacttgactcaactatacacaaagttctcatcctaaatgaactatttcagtcaagcccactctaccactttttacttatctggttaataatccgaaatgttaccggggttgactcacggaattaaatttttcctctatttttatatcctttcctgttgtggatgtaacttacctttctaaactcctttagagttaacgacttctatttagtattgttggtatctccagcccccctcctttttttgtttttcttttagttatttactttgtttgtataatttgctttcattaactaaaaatggaattggcagcactggattgtatattactgtattaagagtacctttgttttcttgatctgttacttttaatactcaggtaatgctacaaatattacagggagtcaaatgcttttataaagttccttcagtggttgcctcacttgcgttttcctacaagatgtaagactgtttataattaaacttttttggtccttca

SEQ ID NO: 2545 - DNA, 148158 bp, Homo sapiens; identical to SEQ ID NO: 2544
  source 1..148158: mol_type = genomic DNA

SEQ ID NO: 2546 - DNA, 148158 bp, Homo sapiens; identical to SEQ ID NO: 2544
  source 1..148158: mol_type = genomic DNA

SEQ ID NO: 2547 - DNA, 72926 bp, Homo sapiens
  source 1..72926: mol_type = genomic DNA
ttttctgcccttctttgctttggtggcttccttgtggttcctcagtggtgcctgcaacccctggttcacctccttccaggttctggctccttccagccatggctctcagagtccttctgttaacaggtgcatgggggtggggtgggggactctgggtggggaggagggtaacttttgggtctgtcataaatagagggcccagaatatgtaggagtcagtctggggagaggcaaaggggatttggggaaggagaaagggttcaagaagaagcagggagaacagctagacccagacaggctggccagggaagcctggatgaatgaccacattcatggactgtgcaaggctgcttgccggtccccttgcttcacacatgaggagacggaggcccagggaggagaagtgacatggctcagggtgcgcagcaggtgtgagacccctttcctgagtgcttcctcctggatcccctctcaccatctccactttgcctccggttctattttccaaggtcccgggtgcaaatgtttgttgaatgactgatgaatgaaaatgatttgagtttgttaccttttatgcttatatgttgtggaaaatgaaattctcctcaaaagggaaggaaatacttgagagctgcataggaaggaaattatctaattaagaatgtatagaaacttcactgttgggcaaatcatcgttgtgacaccgggggaagaagccatttaggtgctcagaagggaggctggaattcagagcaggactggacgtgccccacgacggtggttcttaggtcaggagtcagcaaacagtggcctgggggcccgatatggcccacgacctgtttttgcacaacctgccagctagagattgaagatgaacactgataatcgatttgatgatagggagcaccacccccaaagaattctatttgtctcatttgtaaacccgtattacaaacaaattgtactcaatcattatgtttgaaatttccctaatgacaaatttgtggaaaagtattttctgtcttgttatataagtacttgtacaacatattctatcagcctcttggtctgcaaaacctaaaatttactatctggctgtttacagaataagtgtgctaatccccgccccaggctaacagagctggacctgggaggcagacatctggatgctgggttagttagggtgaccgaatggatgggaaagggaatggagcaggaagacatgctgctatcttttttttttttttttttttttgatacagggtctttctctgttgcccaggctgtagtgcagtggcatgatcatggttcactgcagccttgacctcctgggttcaagcaatcctcccacctcagcctcctgagtaccactacacccggctaattttttattttttgtagagatggggtctcactgtgttgcctaggctggtcttaaactcctgagcccaggtgatcctcccacgtcagcctcttaaattattgggataacaggcctgagccaccacacccagccattgctttcttttaaattattattagtttttgttttttttttgtatttaattttgagataggatctctctctgttgctcaggctggagtgcagtggcacaatcagggctcaagtgatcctcctgcctcagccctccaaagtgctaggactacagcccctaactggcatgctactttcctctgcttgatccttcccccattctccctttagccttgaccttatgtcatgggttcaacttggacactgaaaacgcaatgaccttccaagagaacgcaaggggcttcgggcagagcgtggtccagcttcagggatccaggtgagacccttagatggagccccctttctcagtgctttctctccaagacttacatacctgaaaaaaatcagcgatttgagtgatctttttcaacagataaatcaattcaaaatatacaacaaattcatcttttgaatttacagtattctaaattcaaaagatgcaaaagggtgtaagagtaaaaatctcttccttactcccttcccctagttcccttcccaggagggacctcacaaatggtttcctgggtgttccttcggggagactctgtgtgtgcataacacatacacgttccctccctcagccaacacaccatgtgtagtatacattgtactgaaattaaggcctgcctgcaggctgccgcctatttttgtgaatgaattttattgaaaacaactccgtccacttgtctcttactgtttattgcccttccctcccttcctcccttccttccttccttccttctttccttccttccttcctccctctctcattccctgcttccctctttccctccttccctcccttccctcccttccatccttccttccttccttccttccttccttccttccttccttccttccttccttccttccttccttcatttctttctttcctttctgacatggtcttgttctgtcattcagcctggagtgcacaggtgaaatcatagctcactgtagactcaaactcctgggctcaagcaatcctcccaccttagcctcctgagtagctgggactacaggcatgtgccaccacacctggctaattttttgattttttttgtatagacgaggtctcactctgttgcccaatctggtctcaaactcctggcctcaagtcatcctcttgcttgggcctcccaacttgctgggatgataggtgtaaaccactgtgcctggctatggccacttttgagctgtaatggcagaattcaggagctgtgatagagattgtatggaccctgaagcctaaaacatttacctttacagaaacagtaattgtggaggtgatagtacctttccagaagaagggggctggtctctgctctttgctttatctcccataatacagcccagtgatttgagtccattaatcccatgttatgcttgcattgcatgccataattgggagatgctataatttattttattttatttttttagagactccctctgtcgcccaggctggagtgcagtggcatgatcttggctcactgcgacttctgcctcctgggttcaatcgattctcctgcctcagcctcctgagtagcttggattgcaggtgcctgccaccacgcctggctaatttttgtatttttgtagagacagggtttcaccatgttggccaggttggtcttgaactcctgagctcaggtgatccacctgcctcggcctcccaaagtgctgggattacaggcttgagccaccgtgcctggcttgtaatctccttttacattacattagatctcttgttaatgaacatttagattgttcccaaacttttgctctatgaacaatgctgtcattttgcacatgtgcaagcctatttggaagtaaaggctaggactgggattgtggtatccacgggtgcatgagcacgtgcaattttaatagatttttccagatccccctctacagtggtggcagcaatttacactcacaccagaaattcatgaaaatacctacttcctcatactccctcactcatttgccaactcagtgtgctatcaaacttactgatctctgcagatcgagtaggtgagaagtggtatcttaatttagctttaaattgcttcttttttttttatgagagaggcattttctgtgaacatgtttttcttatctgttggccatttttctttctttttttttttttttactagtttgtacaagctttgagtacactgaggaaagtagtctggggtatgagttgtgaagctctctcccttgtgtattatttttcttttgagtatgcttatggtagtttatcacatacaaaaatttatttatttatttatttatttatttatttatttatttatttatttattgagatggagtctcgctttgtcgtccaggctggagtgcagtggagtgatctcggctcactgcaacctctgcctcctgggttcaagcgattctcctgcctcagcctcccgagtagctgggactacaggtgcgtgccaccacgcctggctaatttttttgtatttttagtagagatggggtttcaccatgttagccaggatgttctcgatttcctgacctcgtgatccacttgcctcggcctcccaaagtgcagggattacaggtgtgagccactgcgcctggcccagaaatttattgaaaatgactgtgtggaggctgggtgcaggggctcacgcctgtaatcccagcattttgggaggccgagctgggctggtcgctggaagccaggagttcgagactaccctggccaacataaggaaacctcatctctactaaaaatacacaaattagccaagcatggtggcacacacctgtaatcccagctactcaggaggttgagacaggaggaatgcttgaacctgggaggcagaggttgcagcagtgagccgagattgcaccactatactccagcctgggtgatggagtgagaatctgtttcaaagaaagaaaataaataaaaataaaaataaataaaatgactgtgtgggccgggtccagtggctcatgcctgtaattctaacactttgggagactgaggtggaaggattgtttgagcccaggaggcagaggttgcagtgagctatgattatgccactggactccatcttgggcaacagggtgagaccctgtctcaaagaaaaaaaaaaaatggttggcctgggactacaggtgtgtaccaccatacctggctaatttttaaaaacattttttgtagagatggggtctggctatgttacccgggctagtttcaaactcctggcctcaaatgatgctcctgcctcaacctcccaaggtgctgggattaaaggcatgagccatggtgcccagcttgaattgacctatttttatttttaaaatttattcatttattttttgggacagagtcttgccctgtctctcaggctggagtgcagtggtgctatctcggctcactgcaacctctgcctcctgggttcaagcaattctcttgcctcagcctcccatttagctgggattacaggtacgcaccaccacgtgtggctaattttttgtatttttagtagaggcggggtttcaccatgttgcccaggctgatcttgaactcctgagctcaggcaatccacccccttggcctcccaaagtgctaggattacaagcatgagccaccgcgcctggtcctatttttaaatgacttctggtttttgtgtcattcttaggaagaccttttctcattctgagtcttaacattttcccatttttttctttgctaattcttcctcctagtcataggaatttaggaatccgggtatgggcccccaccgtcctctgggtggcagaacttcctctgtggtctccttctctccccacatgtcgaagttttctctgttcccacttctccccacagggtggtggttggagccccccaggagatagtggctgccaaccaaaggggcagcctctaccagtgcgactacagcacaggctcatgcgagcccatccgcctgcagggtgagtcactgccccgccgggctgggactgggattcccctgtgaacacatagggactttccaggcactcctgtgtcctggggatctgtggtggggacacaggtgcctgcctccgtaccctctcctctgcctgcagtctctaccctagacatccccaggcaacccctctgtgttcctttctttcccaagatttaggatcccccttcaccgtcagacctccttgtctcccgcatggaggtgacccctgcccagctcttccacagccttctctgtccccccaccagggtgaccatgcccatatctgtccccgcagtccccgtggaggccgtgaacatgtccctgggcctgtccctggcagccaccaccagcccccctcagctgctggtgagtggggctcgatcagaggagcatcctaatgggggtgtttgggggcccacgcatggtggggctgggggtcttgtggagggtggaggtgctggggtacaaggacaggaagcaggggcagccccttccactggctcctgtcccctaggcctgtggtcccaccgtgcaccagacttgcagtgagaacacgtatgtgaaagggctctgcttcctgtttggatccaacctacggcagcagccccagaagttcccagaggccctccgaggtgggttgcctttggcagagggaacagatgcgcagcaaaagaccaggggagggggcaggactgaggtgacgtctgctcaaggtctgggctctgggtgcagaagagtgggggaactgggtcccattagagtcagaagctagggaggtgctagggtcttgtactttaggaaaacgccttggctaggcacagtggctcatacctgcaatcccaaagctttgggagcccaggagcttgagatcagcctgggcaatgtagtgagatcctgtctctaaaaaaaaaaaaaaaaaaaattagctgagtgtggtgatgagcacctgtagtcttagctatttggaggccaaggtgggaagattgcttgaggccacaagttcaaggcaagcctgggcaacatagggagatccccgtctctacaaaaaaaaaaaaaaattagccaggcgtggtggcacacacctgcagtcccagctactcaggaggatcacttgagcctgggaagttgaagctgcagcaagttatgattgcaccactgtactccaacctgggtgacagagcaagaccctgtctttaaaaaataagtccaggtcacactgcagaggaggggatggtgcaaggtgtcattggcaagaggtgggaatcttggggaccatcctggggggcggccttccacacccctgttccccaaacctctgttgattgagattctgagtgactgtatggatttttttttttttttttttttttgaggcagagtctcgctctgtcacccaggctggagtgcagtggcacgatcttggcttactgcaacctctgcctcccaggttcaagcgattctcctgccccatcttcccaagtagctgggattacaggtgcccgccaccacacccggctaatttttgtatttttagcagagacggggtttcaccatgttggccaggctggtctcgaactcctgagctctggtgatctgcccaccttggcttcccaaagtgctgggaatgagccagggaatgagtggggggcatgagccaccatgcctggccagagtgcgtggatctttcaagctgctttttcccactgctttgttcgatggctatgccatctttttgcttgtcttcatgttgattctgggaccacaggcgaatgtttctcccttgcattttttttctttctcaagccctgttcctctatatttcaccctccacagttaatcctccttcctccacagagaaaacaaaagcttcaggcatggactccctccactttccccttctcttattttatcttaataagcggttttccagtcttcactggaatttgttgacaaattctaaaggagctgtaacaccgcactttctcctttttctcaaatttccataatgacagcactcctggcagtgactcactcgttttagaggaagacctgtctctcctctgtcccatgactaaattcttccatatgggcttttgagagtctctcatgcaccaactaaggtgatcacctatctttcttttttcttttttttttggagacagggtcttgctctgtcacctaagctggagtgcagtggcacaatctcggctcactgcagcctctgcctcctgtgctcaagaaattcttgtgcctccgcctccagagtagctgggatcacaggtgcgcatatactgatttttgtattttttgtagagatggggtttcaccttgttgcccaggctggtctcgaattcctgggctcaagagatcttcccacctcagcctcccacagtgctgggatcacaggtgtgagccactgcgcctggcccagcatctcttgaatcacttgttttctctctaggacaattaacttcccccttcctctggctgtaaacactcttcattctatctgtatctgaaaagcaatcaaccaccacaatcgatagccatgaaaacaatcttctctcttccagtctcctcctcatctcctgccatctctcctcaccctcaccacccaagcttcctgagtgcattctcttcacccccggctggcctccagcttccctctccacctaggggcactgggttctgggttctcttttcacccacgtgttcttctttcctgaaatcacccagttctgtggcttcagctaacacttctacctctccctctttagacctcactctcagggttcaagactacttctttaaaaaagttttcatttattaaaaaatatataatacatacacttggttcaaaattcgaaagggtgcggtagctcacacctgtaattccagcactttgggaggtcaaggcaggaggattgtttgaggccaggagtttgggaccagcctagacaacataatgagaccccatctctacaaaaaatgcaattagccaggcatggtggcgtgtgcctgtggtcttagctattcaggaggcctcccaaagtgctggggttacaggcatgagccactgtgccctgccagtctttctaaaatacaaaacaaatcatctcacttccttttctaagaaccttctgtggctccccattgcctacagataaagtcgagctccttattggagtagaaaggcccttgcccgctgctctttgcttgatgccaccgctgtgtctccatcgccgtcacatacgtttgtccctgtagtgctgtttccatcaaacggcattcctggattctgccagaatccttttgaggcccttgtcccatatatcagtaggagtctcaactgggaccaaaagcacattccagtaatgtaactgcccaaggggttcaccttgcttgctgcctagacagagccgattcatcaagacagcagaattgcgatagagaaagaataattcacacagagccagctatgcaggggaccagagttttattatcactcgaatcagtctcctcgagcatttgggggcagagtttttgaggataacttggtaggtcgcgggggaagccagtgagctgggagtgctgattgatcagggatgaaatcatcgggagtcggagctgtcttcttgcgttcagttggttcctgggtgggggcagcaagatcggatgaaccagtttattgatctgggcagtgccagctgatccatcaagtgcaaggtctgcaaaatatctcaagcactgattttaggagcagtttagggagggtcagaatcttgtagcctccagctgcatgactcctaaatcataatttctcatcttgtggctaacgttagtcctacaaaggcaatctagtccccaggtaagaaggaggtctgctttgggaaagggctgttacgatctttgtttaaactataaactataaactataaactaagtgtctcccaaagttagctcagcctacacccaggaatgaacacggacagcttggaggttagaagcaagatggaatcagttaagttagatctctttcactgtctcagtcataattttgcaaaggcggtttcagtaagatttatttacaaagaggggggtttatttataaagggagtaattataaagctgtgacaggcctaagggagccatcagggactttccaagccctgggcaagcaggtctgttgccacccctgggtttatgggttgaggagagggagagctcaccagggtctggagagagtcatgtggagctggcttccttctgaggaacagttggtcttttgtgaaggacatagctgtccccaaacaacctcaatgggagaacacccggacctcactgccctcctccctctagtcttctgttgagccccctcatctgccaaatccaatgggaatccagagggcaacagagtcctggtgatggggtccctgcaggttgacctcccaggccacagagctgagcggcaatgggtagaaagtggatttggggatggggcagaaggcagaggagcacattccacatcactttatatgtgtgtgcccttcccttttctagaatctactccttttgtatatctggcaaatccttccttccttccttccttccttcctcctttgctttcctttcctttcctttcctttcctttcctttcctttcctttcctttcctttttttcttcctttcttccttttcttcgaagtcttgctctgtgacccaggctggagtgcagtggtgcgatctcagctactttttgtatttttaatagagatagggtttcaccatgtcagccaggctggtctcaaactcctgatctcaagtgatccacctgcctcagcctcccaaagtgctgggattacaggtgtgagccacctcgcccagctgggcaaattatttcctgttcttcaagattcagtcaaacatcaccacattccctgattcccttgggcagaattaacgaaaattttccataccactttgtccttgtttatttacttatttatttatttttaagagacagggtctttctctgtggcccaggctggagtgcaatggcgtgatcatagctcactgaagcctcaaccttttgggctgaagtgatcccccaccctcagcctcctgagtagctgggactacaggcatgtgccaacatgcctgactaatttttaacgtgtgtgtgtgtatatatatatatatatatatatatatatatatatatatatatatgtttttaacgtgtgtatacatatatatatatacacacacgttaaaaattatatatatattatacataatttatatatatatttaacatctatattttttatagagacggggtcctatattctcattgttcagcagagggctgacatgcaaaaaaacccaaaacaccaagtgtcaaattacttgattcatactcttttccccttccccagggtgtcctcaagaggatagtgacattgccttcttgattgatggctctggtagcatcatcccacatgactttcggcggatgaaggagtttgtctcaactgtgatggagcaattaaaaaagtccaaaaccttggtgagggcccaggggtaggttagggaagagcccacacggggctggaagatacatggcaaccgggccaccatgttctcctcccagttcaactgcagacattgccaaattgacgatcgattatggtttgccttcctgagtctcttttctgctctgttggatgcagcctcagcattctttcagccttttataaagcgggcagctctaattgttaaggttggcatgggagatgaagcccacgtgtcattgctggctgagttctattttcatttttatttcttatttttttgagacagaatctcactctttctctcaggctggagtgcagtggtgtgatcttggctcactgcaacctccgcctcccgggttcaagcaattctcttgcctcagcctcccgagtagcggggattacaggcgcatgccaccatgcctggctagtttttgtatttttagtagagacggggtttcaccattttggccaggctggtctcaaactcctgacctcaggtgatccacccgcctcggcttcccaaagtgctgggattacaggtgtgagccactgctcccggccgctggccgtgttctagtattgaggagagatgggagctgctggcagctctccgtcctggtgaggcaggggattaggggcagcacagaggaggaatttggagagtggagtgtttaagatcttcgtggagcttgctgggagatgtctgaggggtgggggcaccttctccagcatcacaccagccgccccctccgcagttctctttgatgcagtactctgaagaattccggattcactttaccttcaaagagttccagaacaaccctaacccaagatcactggtgaagccaataacgcagctgcttgggcggacacacacggccacgggcatccgcaaagtggtgtaagcttccccttttcccttaggatggagggaggaggagacacttttagctgggctttgatggatgaagggagccgttcagacaggggtggtagaggatgcttccccaccggcagaggtggggaggctgtgcgtggtgtgttcatcaaaggacaagttgtgagtgaaaggtgggagtggagtggggaagtgagggaaaggtgtctggagggaagctacaaagatcagctcaggccagggagccaaaggcagctttacagcctgtggtgagatatcgccatgtctcattttgggaagttcactctgattttgaggtgggtgtagaggcaaggatggggttgggacagaagtacaagaagcactggagagtcctagaggggctggggagctggtgcagtgctctgggagaggtttcctgaaggccaattaactatatatatatatatatatatatatatatatatatatatattttttttttttttttttttttttttttttttttttttgagacagagtctcactctgtcacccaggctggaatgcagtggcctgatctcggctcactgcaacctccacctcctgggttcaagcaattctcctgcctcagcctcctgagtagctgggattacatgcgtccatcaccaccatcagctaatttttgtatttttagtagagacagggtttcaccatgttgaccaggctggtcttgaactcctgacctcaggtgattcacctgacttggcttcccatagtgctgggattacaagtgtcagccataaatatatatatttttaaaattcaaaagtaataatactcagttaaaaaacccaaattatgcgaaagtataaaaacaaaaaccgtgaaggcttcctttcccttccctgctgcttttccaggtctcggggcagttgcatctcagtgctaagtctcaggggagacggagcccctccgagacctcgcctagctgtatctgtgtctgggactctgctgacatttcctttctgacgttaatagcatctctggctaggtgcagggtctcataccagtaatgtcagcactttaggaggccgaggtgggaggatcacttgaggccaggagtttgagaccaattgacaacatagtgagactctatctctaaaaagataaaaaaataaaccaagtgtggtggtacatgcctgtagtcccaggtactcaggaggctgaggcaggagaatcacttgagcccaggagttcaagtctgcagtgagctatgattgtgtctctgcactccagcctggataacagagtgagtgtctatttcttaaaaaaaaaaaaaaactagtgtgtcatctacttgcatttgactttgtccctcctgtttcctgcacagacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtagggaatgcagctctcaggttgatgcttctgtggagggtttctatgtggatccatcctcccttcaatttgcaaatattattaaaatcaaagtgacatgagagctaatgctagctcatatacaccgtatcagctatctgttgccacatcaatgctgtgtaataaactatcccaaaattcagcagcttaaaataataagtaagcctgtgggtcagcctgccaagagttctggtctcaatggccttcctcactgtcattagctacaggttggcaggctgctctgctgatcttggccaggctctctctgtttctgagggttgccagctatgtcatctgctggaccagatggccttgggtggaaccactggggtgacttggccctttggcaacctggctctcattctccagggctagcctgggcatgtcctcatggtgaaggcaggggagcaagagaacagtggagatgttgcaagtgcttttttacgcctctgcatcatgtttgataacatccatgggtgtcacgagcagtgcaaggttagcgataaccaggtccatgcaggtttgtgtttttccacaacatctttcgctgatgctatttcaatcacaaacgccacaagctgcatggaattcccaaggaggcagttcttcttagtgcatcctgttccctcagacactctggctcaagccacccacaagtcagtcaatattgcaaaccatatataatagtatacttaatcaatatataagttataggttaaacattccacagcaaacaaagtaacatttaacatcagaagaaaaagaaagaggagaaaggatgaatgaaaaggactcctggtctgggcccaagggtcctggtcctgttagtcttgcaaggcagagtctttgatacggcagagccctcggcagcaaatgccaggctctcatcatgagcgactgcgaggtgtgagttccaacagctgctttgagctgctgaaggcctgatctcttctagtcacagagctgtctggtgagaacagacagagaagaatgtgcttgtttgcatccttatctggttggatgtagtctttatttgtttattttatttatttatatttatttatttatttattttgagactgagtcttgctctatcgctcaggctggagtgcagtggcatgatcttggctcactgcaacctccacctcctgggttcaagcagttcttgtgcctcagcctcctgagtagctgggactacaggcatgcaccaccatgcctggctaatttttgttttgtattgttagtagagatggggtttcaccatgttggccaggttggtcttgaactcctgatctcaagtgatctgcccgccttggccttccaaagtgtgggattataggcatgagccactgcacctggcctatttaaaaaatttgtttaaaacgaccttatccttgttggcaaagtgccctgtgaaatatagaatggagcctttttctaagatggagtcagttatgtcaagggtgctctgtatacaatgggctaaagcaagactcatgtctgagcccagaggcaatgaagggggcagatgactccaccaagagcaggagggcacagcagagtgctgggggaaagggcttggatacaggaagaggcaaggagtcaggatcatcagtgtaatcaaactactacagcacctgcatgacacagaaagcgatatcaccatggatacatgccttggcacgtaggacataccttcatataaagaaaaaggctccccttcctctagggggaggtcagctccataccaggagacgtggcacagcagatggatcagcagccgggtttctgccccaacttgcttccttggcacagtgccttgtgcagtgtacaacctgcccaactatacctggcaaccctgtcccagggaccttctgatgcatttcctcacttgataaataatggttcagactagtttcctgcagaattgtctttgccagatgatattgctagcctcacaccatgatttagcctctgttccttggtaacaggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtgagtcaggcatctgtgttcccagagcagctccagaggcagccccccaccccagaacatagtcccctctagaatccagaccttcctaacccttggtatcccccagcatcaactctctccacttcctacagctcccagtcccagcctcacttggtcaattcctttgaagtcaaagaatccatacttttatctgtaattttgcaaatcttggctataggctggtaaattggagtatgggggagtcaaatcccacccagtattttaacaaaaatttggatgtgttgccagctgtcgtctgttcggttctctgttgtatcccaattgcctagaatagtgcctggtactcagaaggtgctcaataaatgtttgttgaataaaaggaatttagaaattgggggatttcataaacagtctgggtttatggcttatcttgaaaagctggaagattagacaccttgaagaccgcattcccacttggcaggatgttgctggaggtgaatggctgccatccttctaagagggacgtatgctgtccagcttgacacagatcctgtcggagtctcctttgtctgtggccaccagagcacttgggttttcagtacctgttctaggttcttctgctttcttttcttttctttctatttttttttgagactgagtcttgctctattgcccaggctggagtgcagtggtgcgatcttggctcactgcaacctctgcctcccaggttcaagtgattctcctgcctcagcctcctgagtagctgggattacaggcgcataccaccacgcccagctaatttttgtatttttagtagagacggggtttcaccatgttcaccagactggtctctaactcctgacctcaagtgatctgcccatctcaggctctcaaaatgttgggattacaggcgtgagccaccatgcccggccttctgctttctttaatatagaaacttctcctctttacaggtactcagacaggaagtagcagctcctttgagcatgagatgtctcaggaaggcttcagcgctgccatcacctctgtaagtggcccttcattaaattgcgggggtggggcagggggtagcaagaagagataggagagatgtgggggtttggggactcttctctgtgatagatacttgggaagtagctctgtgaggggcagcggttgtcccttcttccttcctcatcaaccctgttctacacctttcccagaatggccccttgctgagcactgtggggagctatgactgggctggtggagtctttctatatacatcaaaggagaaaagcaccttcatcaacatgaccagagtggattcagacatgaatgatgcttacttgggtaagtggggagggcaagggttactctaagaaggggtgaggatttggcataagtcaactagcatagatgtctgggtcttgaatgaatgggatacatatgtatgggatactagctattagtctcttgggatagctttaaagacagaaacttcaatttttttttttgaggtggagtttctttcttgtcgcccgggctgtagtgcaatggcactcggctcactacaacctctgcctcctgcgctcaagcgattctcctacctcagtctcctgagtagctggtattacaagaatgcaccaccacccctggctaatttttttttttttttcgaaatggggtttcgctcttgttgcccaggctggagtgcaatggcgtgatcttggctcaccacaacctccgcctcccaggttcaagcgattctcctgccttagcctcctgagtagctggaattacaggcatgtgccaccatgcccagctaattttgtatttttagtagagatgggatttctccatgtcggtcaggctggtcgcgaactcccaacctcaggtgatccacctgcctcggcctcccaaagtgctggaattacagacgtgagccaccgtgcctggtctttttttgtattttcagtagagaccgggtttcaccatgttggccaggctcgtctggaactcctgacctcaggtgatccgcctgtctcggactcccaaagtgctgggattataggtgtgagccaccgcacccggccagaaacttctaaattgaattgtaattatgttcataaagagaaatatagcgtagggatcagttaccccaacacagcaagcgtggggctgccccagtgcccctactcaaggggtgggtctgcatggtggaggagggggcagggaatgcacttcacctctcagacccccaccttcaggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccaggtgagtgcggtttgtggagcatgaatgtgcaaacagaggcgccctggggtcttagagattccaggaggggcattcagatgacatgcatggccctcttgtaaaggaggctttgggggctgtgagctggggagttgtgggatcagcttagcatttgtgaatgctgtgtcctcagcttttttaacaatgataaataacaatgcttgcctgtacagagctctctatgggtctttctgtactcagggctggtattcaacccgtatataaccaggatagccatgttagttaataaaatattgaaacaattccgtattcattgataaatggtggattccccctcacccatgcactctggtgcttccccagtctctgtgggcttccccatgatccagcaactatgaggtcaggcaggacacttcacacaccctctaggatctgctccagccatgcccctgctcagtacctgtgcagctccagctgttcattattttgaatatcacccctgcaaaagcagcatggtcacatattatgtgggaactagcgagtgaggcaaaactctctagtcaaaatcattcttgcaaattcctgaaataggactgcacccatgatatggtgcctatagttctttattttatttttattttattatactttaagttctagggtacatgtgcacaacatgcaggtttgttacatatgtatacatgtgccatgttggtgtgttgcacccattagctcgtcatttacattaggtatatctgctaatgctatcccttccctctccctccaccctacgacgggccctggtgtgtgatgttccctacctggtgtccaagtgttctcattgttcaattcccacctatgagtgagaacatgcagtgtttggttttctgtgcttgcaacagtttgctcagaatgatggtttccagcttcatccatgtccctacaaaggacatgaactcatccttttttatggctgcatagtattccatggtgtatatgtgccacattttcttaatccagtctatcgttgatggacatttgggttggttccaagtctttgctattgtgaatagtgccacaataaacatatgtgtgcgtgtgcctttatagcagcatgatttataattctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacgtgttgtttcctgactttttaatgatcaccattctaactggtgtgagatagtatctcactgtgattttgatttgcatttctctgatggccagtgatgatgagcattttttcatgtgtctgttggctgcataaatgtcttcttttgagaagtgtctgttcatatcccttgcccagtttttgatggggttgtttgattttttcttgtaaatttgtttaagttctttgtagattctggatattagccatttgtcagatgggtagattgtaaaaattttctcccattctgtaggtggcctgttcactctgatggtagtttcttttgctgtgcagaagctctttagtttaattagatcccatttgtcaatattggcttttgttgccattgcttttggtgttttagtcatgaagtccctgaccatgcctatgtcctgagtggtattgcctaggtttccttctagggtttttatggttttaggtctaacatttaagtctttaatccatcttgaattaatttttgtataaggtgtaaggaagggatccagtttcagctttctacatatggctagccagttttcccagcaccattattaaatagggaatcctttccccatttcttgttttttcaggtttgtcaaagatcagatggttgtagatgtgtggtattatttctgagggccctgttctgttccattggtctatatttctgttttggtaccagtaccatgctgttttggttactgtagtcttgtaatatagtttgaagtcaggtagcgtgatgcctccagctttgttcttttggcttaggattgacttggcaatgtgggctcttttttggttccacatgaactttaacgtagctttttccaattctgtgaagaaagtcattggtagcttgatggggaaggcattgaatctatgaattatgttgggcagtatggccattttcacgatattgattcttcctatccatgagcatggaatgttcttcaatttgtttgtgtcctcttttatttcattgagcagtggtttgtagttctccttgaagaggtccttcacatcccttgtaagttggattcctaggtattttattctctttgaagcaattgtgaatgggagttcactcatgatttagctctctgtttgtctgttattggtgtataggaatgcttgtgatttttgcacactgattttatatcctgagactttgctgaagttgcttatcagcttaaggacgttttgggttgagacaatggggttttctaaatatacaatcatgtcgtctgcaaacagggacaatatgaataccctttatttctttctcctgcctgattgccctggccagaacttccaacactatgttgaataggagtggtgagagagggcatctctgtcatgtgccagttttcaaagggaatgcttccagtttttgcccattcagtatgatattggctgcgggtttgtcataaatagctcttcttagtttgagatacgtcccatcaatacctagtttatttagagttttcagcatgaagggctgttgaattttgttaaaggccttttctgcatctattgagataatcacgtggtttttgtctttggttctgtttatatgatggattatgtttattgatttgcatatgttgatccagccttgcatcccagggatgaagcccacttgatcatggtggataagctttttgatgtgctgctggattcagtttgtcagtattttattgaggatttctgcgttgatgttcatcagggatattggtctaaaattctcttttttttgttgtgtctcttccaggctttggtatcaggacgatgctggcctcaaaaaatgagttagggaggattccctgtttttctattgactggaatagtttcagaaggaatggtaccatctcctccttgtacctctggtagaattcagctgtgaatccgtctggtcctggactttttttggttggtaggctattaattattgcctcaatttcagagcctgctattggtctattcagagattcaacttcttcctggtttagtcttgggagggtgtatgtgtccaggaacttatccatttcttctagattttctagtttatttgtgtagaggtgtttatagtattctctgatggtagtttgtatttctgtgggattggtggtgatatcccctttctcattttgtattgcgtctatttgattcttctctcttttcttctttattagtcttgctagcggtctatcagttttgttgatcttttcagaaaaccagctcctggattcattgattttttgaagggttttttgtgtctctatttccttcagttctgctctgatcttagttatttcttgccatctgctagcttttgaatgtgtttgctcttgcttctctagttcttttaattgtgattttaaggtgtcaattttagatctttcctgctttctcttgtgggcatttagtgctataaatttccctctacacactgctttaaatgtgtctcaggattctggtatgttgtgtctttgttctcattggtttcaaagaacatctttatttctgccttcattttgttatgtatccagtagtcattcaggagcaggttgttcagtttccatgtagttgagcggttttgagtgagtttcttaatcctgagttctagtttgattgcactgtggtccgagagacagtttgttataatttctgttcttttacatttgctgaggagtgctttacttccaactatgtggtcaattttgtaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctgtgtaggtcactaagcacttgctttatgaatctgggtgctcctgtactgggtgcatatatacttaggattgttggctcttcttgttgaatttatcggtttaccattatgtaatggccttctttgtctctttgatctttgttggtttaaagactgtttcatcagagactaggattgcaacccctggttttttctgttttccatttgcttggtagatcttcctccatccctttattttgagcctatgtgtgtctctgcacgtgagatgggtttcctgaatacagcacactgatgggtcttgactctttatccaatttgccagtctgtgccttttaattggagcattgagcccatttacatttaaggttagtattgttatgtgtgaattagatcctgtcattatgatgttagctggttattttgctcgttagttgatgcagtttcttcctagcatcggtggtctttacaatttggtatgtttttgcagtggctggcactggtttttcctttccatgtttagtgcttccttcaggagctcttttagggcaggcctggtggtgacaaaatctctcagcatttgcttgtctgtaaagtattttatttctccttcacttatgaagcttagtttggctggatatgaagttctgggttgaaaattcttttctctaagaatgttgaatattggcccccactctcttctggcttgtagggtttctgctgagagatcagctgctagtctgatgggcttccctttgtgggtaacctgacctttctctctggctgcccttaacattttttcctccatttcaactttggtgaatctgacaattatgtgtcttggagttgctcttcttgaggagtatctttgtggtgttctctgtatttcctgaatttgaatgttggcctgccttgctagattggggaagttctcctggataataccctgaagagtgttttccaacttggttccattcgccctgtcactttcaggtacaccaatcagacgtagatttggtcttttcacatagtcccatatttcttggaggctttgttcatttctttttactctttttttctctgaacttctcttcttgcctcatttcattcatttgatcttcaatcactgataccctttctccacttgattgaattggctactgaagcttgtgcatgcatcacgtaattctcatgccatggttttcagctccatcaggtcatttaaggtcttctctatgctgtttattctagttagccattcgtctaatctttttacaaggtttttagcttctttgtgatgggtttgaacatcctcctttagctcggagaagtttgttattaccgatcatctgaagccttctcctctcaactcgttaaagtcattctccgtccagcttcgttccattgctggtgaggagctgtgctcctttggaggagaagaggtgctctgatttttaaaattttcagcttttctgctctggtttctccccatctttgtggttttatctacctttggtctttgatgatggtgacatacagatggggttttggtgtggaaatcctttctgtttgttagttttccttctaacagtcaggaccatcagctgcaggtctgttggagtttgccggagttccactccagaccctgttttcctgagtttcaccagtggaggctgcagaacagcaaatattacaaaacggcaaatgttgctgcctgattcttcctctggaagcttcgttgcagaggggcacccagccgtatgaggtgtaagtcggctcctactgggaggtgccccccagttaggctacttgggggtcagggacccacttgaggaggcagtctgtctgttctcagatccaagctgcatgctgggagaaccattactctcttcaaagctgtcagacagggacatttaagtctgcagaagtttctgctgccttttgttcagctatgccttgcccccagaggtggagtctacagaggcaggcaggcttccttgagctgcagtgggctccacccagttcgaacttcctggccgctttgtttacctactcaagcctcagcaatggtggacgcccctcccccagcctcactgccaccttgcagcttgatctcaaactgctgtgctagcgtgagcaaggctccatgggcgtgggaccctctgagccagacgcgggatataatctcctggtgtgccatttgctaagaccattggaaaagtgcagtattagggtgggagtgtcccaattttccacttactctctgtcacggcttcccttggctaggaaagggaattccccaaccccttgcacttcccaggtgaggcgatgacccaccctgctttggctcatactctgtgggctgcacccactctcctacaagccccagtgagatgaacccagtacctcagttggaaatgcagaaatcacttgtcttctgcgtcactcacgctgggagctgtagactggagctgttcctattcggccatcttggaacctcctctgcctatagttctttaaaaaaaaaaatttcaggcagggcatgttggctcatgcctgtaataccagtgtagcaggacaagctgcatacaaaacccctcagacaccgagttaaagaaggaagggctttattcagtcaggagctacagcaagactcacgtctccaaaaactgagctccccgagtgagcaattcctgtccttttaagggcttaaaactctaaacaggtccacgtgagggggtcgtgatcgattgagcaagcaggaggtacgtgactgagggctgcatgcaccagtaaacagaacggaacagaacaggacagagattttcacaatgcttttccataccatgtctggaatctatacataacataactggttaggtcatgagttgatctttaaccagacccagggtgcagcacagcccgtggatttaatttctgccttttagtttttacttctttctttggaggcagaaattgggcataagacaacatgaggggtggtctcctcccttaccagcactttggaaggctgaggcaggtggatcacctgaggtcaggagtttgagacgagcctggccgatatggtgaaactctgtctctactaaaaataaaaaatattaaaaaaagttagccaagcgtggtggcgtgtgcatctgtaatcccagctactcgggaggctgaggcagaagaatcacttgaacctgggaggcagaggttgcagtgagctgggatcttgccactgcactccagcctggatgacagggcgagacttcatctcaattaaaaaaaaaatttcaagttttagatttggggtacatgtataggcttgttacatgcatacattgcatgttgctgaggtttgggctgcagatcccatcacccaggtagtgagcatagtacctgtggtggtttttcttttttctttttcttttcttttctctctctttttttttttttagagacagggtctcactatgttgcccaggctggttttgaacacctgagctcaagcaacgttgcccaggctggttttgaactcctgagctcaagcaatcctcctgccttggcctcccaaaatgctgagattacaggtgtgaaccactgcgcctggcccaataggtggttttccaacccacacctcctgctcctccatctggtagtctgcagtatctatcattcccatctttatgtctatgtatacccagtgtttagctcccacttataagtgagaacatgcagtatttgattttctgttcctgtgccaattcacttaggattatagcctccagctgcatccatgttgccgcaaaggatgtgattcatttttttttttatggtggcgtagtatttgatggtgtatatgtaccacattttcttttccaatccaccactgatagacacctaggttgattccatgtctttctattgtgaatagtgctgtgatgaacatacgagcatgtatctttttgatagaacagcttattttcttttggatatatggccagtaatgagattgctgggctgaatagtagccctgttttatattctttgagaaatcttcaacctgctttccacagtggctggactaatttacattcccaccagccaacaatgtataagcgttcctttttcttcattgccttaccagcatctgttattgtctttttaataatagcattctgactggtgtgagatggtatctcattgtggtttatgatttgcatttctctggtgattagtgataatgaactttctttttcaaatgttttttggctacttgtatgtcttcctttgagaagtgtctgtttatgtcctttacccactttttaatggggttatttgtttcttgcttgttgatttgttgaagttccttatagattctggatttcagacctttgtcagatgtggtttgcaaatattttctcccattctgaaagttttctgtttactctgttgatagtttcttttgctctacagaaactctttaattagttcccacttgttgatttttgtttttgttgcagttgcttttgagggcttagccgaaagttctttgccaaggctgctgttgagaaagtatttcctaggttttcttcaatgattttaatagttcgagggctcacatttaaatctttaatccatgtgatttaagtctttaatcacatttaaatctttaatacaccttgagttgatttttgtataaggtgtaaggaaggggttcagtttcattcttctgcatatggatagccagttatctccacactctttattgaatagggagttctttccccattgcttgcttcatagtctttattgaagatcaggtggttataggtgggtggctttatttctgggctctctgttctattccgttggtctatgtgtctgtctttgtaccagtaccatactgttttggttactatagcctcatattcggatagtgtgatgcctccagctttgttatttttgcttaggattgcttttgctatttaggctctttttttgttccgtattaattttagaatagttttttctatctgtgaacaatggcattggtagtttgatacaaatagcattgaatctgcaaattgctttgagcagtgtggccattttaacaatattgattcttccaatccatgagcatggaatacttttccgcttatttgtgtcgtctctgatttctttcaacagtgtatttctctttgtagagaccttttacctccttggttagctgtgttcccaggtacttcatttttcgtttctgcctgtagttctgtgtgtttttaaaatttttgtcggtggttctctttgacttgtaattaatgcattgtatggggatgaaaccagtttctcctgatacctgaacagcttgtcataattctttgccaatagtcaaattcttcacgtggtctctctaaacacatactggccattgatggtgtcaatgcctgacatgtataagggatggggtggggaaaaaagtgtagaggaattacgggaagtcaagtgtggattggatgccacttctctgttttcggtgtgtggtcaggaccacatgaggaaggctggctggtcaactcccccaccccacacaagtacacgcacattaccatcaagggtgatagatgcttaaagtgggacagtctgggagttatgagagcaaatgggaggggcacccacagaaaggcagtatggaagccttcctggtggaagtggcagctaagccaaggcctgaggtggaagcacaagagaagtgaaaaggggtgtggggaagcaaggggccagaggagggagagagaatggaatggagggtcagaatatgcgtatagggtggtgggaggagtggtgggagaaaacaggaaagaagggtaggtgtggcttatcccagacatgcagggcttgttcaatatcccaaataccaatattgcagaaatggacaagctgatcctgaagtccatatggaaacagaagggacccatatattagacttatacctaaatgtttcatgacctttggcactattgtaaattgtactggtttttaaatttaaatttccaattgttggaacagaacagagccctcagaaataattccacatgtctacaaccatctgatctttgacaaacctgacaaaaacaagaaatggggaaaggattccctatttaataaatggtgctgggaaaactggctagccatatgtagaaagctgaaactggatcgcttccttacaccttatacaaaaattaattcaagatggattaaaagcttatatgttagacctaaaaccataaaaaccctagaaggaaacctaggcattaccattcaggacataagcatggtcaaggacttcatgtctaaaacaccaaaagcaatggcaacaaaagccaaaattgacaaatgggatctaattaaactaaggagcttctgcacagcaaaagaaactaccatcagagtgaacaggcaacctacagaatgggagaaaatttttgcaatctactcatctgacaaagggctaatatccagaatcatcaaagaactcaaacaaatttacaagaaaaaaacaaccccatcaacaagtgggtgaaggatattaacagacatttctcaaaagaagacatttatgcagccaacagacacatgaaaaaatgctcatcatcactggccatcagagaaatgcaaatcaaaatcacaatgagataccatctcacaccagttagaatggtgatcattaaaaagtcaggaaacaacacgtgctggagaggatgtggagaaataggaacacttttacactgttggtgggactgtaaactagttcaaccattgtggaagacagtgtggcgattcctcaaggatctagaactagaaataccatttgacccagccatcccattactgggtatatacccaaatgactataaatcatgctgctataaaggcacatgcacacgaatgtttattgcggctctattcacaatagcaaagacttggaaccaacccaaatgtccatcaacgatagactggattaagaaaatgtggcacatatacaccatggaatactatgcagccataaaaaaggatgagttcatgtcttttgtagggacatggatgaagctggaaaccatcattctcagcaaactatcgcaagaacaaaaaaaccaaacactgcatgttctcactcataggtgggaattgaacaatgagaacacttggacacaggaaggggaacatcacacaccagggcctgttgtggggtgggggaagggaggagggaaagcattaggagatatacctaatgtaaatgacaagttaatggatgcagcacaccaacatgacacatgtatacatatgtaacaaacctgcacgttgtgcacatgtaccctagaacttaaagtataataaaaaaataaatttccgattgtttagggatatagaaatacaactggccgggcccagtggctcacgcctgtaatcccagcactttgggaggccgaggcaggtggatcacctgaggtcaggagtttgagatcagcctgaccaacatggagaaaccctgtcgttactaaaaatacaaaattagccaggtgtggtggcacatggctgtaatctcagctacttgggaggctgaggcaggagaatcgcttgaatctgggaggcagaggttatggtgagccgagatcatgccattgcactccagcctgggcaacaagtgtgaaactccatccaaaaaaaaaaaaaaaaaaaaagaaatacaactgattcttacatattgatcttgtatccaaaacaatcttagaaaaggggaacaaagctggagggttcacactttccaattcaaaacttacaaagccatcaagccagaaagtaaattagtggtttccaggggctgggggttggactggggattggaaatactgctaacaggtagagaatttctttctgggaagatggaaatgttctggaggtagtggtgatgattacacaacattgtgaaggtactaaaacccagtgaaccttatactttaaaatggtaaattttatggtctatacatttaatctaaattataaaagctactttgaagaaaacaatgtgattcaccataacagcagattaaagaagaaaaaacatgtaaccacctgaacagatatagaactctaatttgacaacatacaacatcgtttcatgattaaaaatactctcagccgactaggaactaaagggaacttcctcaagctgaaaaagagcatttacaaaaaatctctaccaggcattatacttaaaagtgaaagagaatgcttttcacctaaaattggaaacaagacaagaatatctacttttataattcctatccaacattgtactgaaagacctagccaatgcaataaagcaggaaaaagaagaaaaaaaaatataaagaggaaaggaagaaataaaaccctctctatttgcagatgatacaattgcatggaaaattccaaagaacctataaaaaagctatgataataggttttttcagtaagttctcaggatataggagcaatgtataaaaattagttttatttctataatataattgaacaattggaaatttaaattaaaaagtaccatttacaatagcataaaataccatgaaatatttaggtataaatcaaacgaatcatgtacggtaactttatgctgaaaactacaaaacactaatgagagaaataaaagacctaaataaatggagagagacgctgtggtcatggattcgaatattatagttccaatattgttaagatgtcaattctccctgggttgatctacagattcaatgcagtaaaaatcctggataatattccattgtgcacatgtaccacattttctttatccattcatctgttgatggacacttaagttgattctatatctcgactattgtgaatagtgctgcgataaacacgggagtgcagttatctcttcagtatactgatttcctttcctttggcaatatacccagcactgggattgctggatcatgtggtagttccatttttagttttcttgaggagcctccatattgttctctatagtggctttactaatttacattcctactaacagtgcatgagggttcctctttctctgcatctttgccagcatccatcattgtttgtcttttcgataaaagcccttttaactggaatgagatgatatctcattgtggttttcatttgcatttttctggtacacaaaggaatattattcagccataagatgaatgaatcttgtgatttgcaataacaggattggaactggaggacattatgttaagtaaaacaacccgggcacagaaaaacaaatattgcatgttctcattcatgtgtaggagctaaaaaaaaatggatctcatggaggtagagagtagcatgatgggttactagagactgggaagggtagtaaggaggatggggtaaagaggggatggttaatgggtacaaaaatacagttaggaaaaataagacctagtgtttggtagcacagtagggtgactatagttaacaataatttattgtgtatttcaaaataactacaggaatggaattggaatgttcccagcaaaagaaatgataaatccttgaggcaacggatatcccagttaccctgatttgatcatcacacattgtatgcttgtataaaaatatcacatgttccctataaatatgtgcaattattacatattcataaaaaggtaaaaatcctagaagtatattttgcagaatttagccaattctaaaatttatataaaaaataaaaaagtagagtatccaaaagaattttgaaaagaatcttgatacataccattaagtagctgtcactttttatttatttatttaatttaaaaaaattagattgatattttataatttttcaacttttactttaggtttgagggtacacatgaaagtttgttatataagtaaactcatgtcatgggagtttgttgtacagagtattttgtcacccaggtattaagcctagtatccaatggttattttttctgctcctgcctcctcccaacctccaccctcaagtagaccccagtgtctgttgtttccttctttgtgttcataagttctttatagtttagctcccactaataagtgagaacatgcagtatttgtttttctgttcttgtgttagtttgctaaggataacggccttcagctccatccatgttcccacaaaagacatgatcttgctatttttatggctgcatagtattccacggtgtatatgtaccacattttaaaaaatcctatttgttattggtgggcatttaggttgattccatgttttgctattgtgactagtactgcaataaatattcatgtgcatgtgtctttatggtaggatgatatatattactctgggtatatccccagtaatggggttgctgggttgaatggtagttctgcttttagctctttgaggagttgccatactgctttccccaagtggttaaactaatttaccactcccaccaacagtataagtgttcccttttcttcacaacctcaccagcatctattttttaacttttactaatagccattctaactggtgtgagatggtatctcattgtggttttgatttacatttctctaatgataatgattttgagctttttttgtatgcttgttggctgcatgcatgtcttctttcgaaaagtgtctgttcatttccttttcccaccttttaatggcgttgtttttctcttgtaaatttgtttaagtaccctgtagatgttggatattacacctttgttggatgcatagtttgtgaatattttctctcattctttaggttgtctgttcactctgttgatagtttcttttgctcttgcatttaattagatgccatttgtcaatttttgcttttgttgagattgctttttgtgtctttgtcaggaaatctttgcttattcctgtgtctagaatggtattgcctaggttgtcttccagggttcttatagttttgggttttacatttaagtctttagtctatcttgagttgatttttgtatatggtgtaaggaaggggtccagtttcaatcttctgcatatggctagccagttatcctagcaccatttgttgaataggaattcttttccccattgcttatttttgtcttagatcagatggtcataggtgtatggccttatttctgggctctctattctgttccattggtctatgtgcctgtttttgtaccagtatcatgctgttttggttactgtagccctgtagtatagtttgaagtcaggtaatgtgatgcctccttctgtgttctttttgcttaggattgacttggttattcaggttcttttttgattccatatgaattttaaaatagtttttcctagttctgtgaagaatgtcattggtagcttaatagtaatagcactgaatctataaattgctttgggaagtgtgtccattttaatgatattgattcttcctatccatgagcatgagatgttttaccatttttttggtgtcatctctgatttctttgaacagtgttttacaattctcactgtacagatctttcaactctctggttagctgtattcctagttattttattctttttgtggcaatcgtgaataggattgccttcctgatttggctcccagctcttgttggtgtataggagtgctagtgatttttgtacattgatttcgtatcctgaaactttgttgaagttatttatcagctgaaggagctcctaggccaagactatggggttttctaaatatagaatcatgttgtctgcaaacagggatagtttgacttttttacttcctttcttcctatttgtatgcccttttttctttcttttgcctgattgctctggctagaacttccaataatatgttgaataggactagtgagcaaaggcatccttgttttgtgctggctttcaaggggaatgcttttgcccatcaagtatgatgttggctgtgggtttgttgtagatggctcttattattttgaggtatgttccttcaatacctagtttattgagaatttttaacataaaggggtgttgacttttattaaagccttctcttcatctattgagataatcatgtggtttttgtctttagttctgtttatgtgatgaatcatatttattgatttgcatatgttgaaccaactttgcaccccgggaatgaagcctacctgatcatggtggattagatttttgatgtgctgctggatttggtttgcaggtagtgtgttgaggatttttgcattagtgttcatcaagaatattggcctgaaattttctttttttgttaagctgacactttttagtttgatgccaccccatttgtctggtttgcttttgttgcctgtgcttttggggtcatatccaaaaaatcatttctcagaagcttgattgtcaagaagcttttccctttgttttcttctagtagttttacagtttcaggtcttgtgtttaagtctttaatccattttgagttgattttgtatatggtttgggataaaggtctaatttaatccttttgaatatgaatatccagttctccccacaccatttgttgaagagaatgtcctttctcctttgcatattcttggcacctttattgaagatcaattgaccataaatgcatagttttatttctagcctccctgttctgttccattggttgatgtgtctgtttttatgccaccaccttgctgttatgcttactagagctttcttgacacagtatgttttgagatcaggaattatgatgcctccagtattttttttcttgaggattgctttggctatttagggtcttctgtggttctacataaattttagttttttttctatttttgtaaaaaaatgccattgggattttgataaggattgtactgaatcagaagattgcattaatactccagtccatgaacataggatatctttccatttatttttgtcttgtttaacttccttaatcaatgttttatagttttagtgtacatgtttttcacctctctggttaaatttaagcttaggtattttttttgatgctattgtaaatgagattgtttcttgatttctttttcagatagttcattgttagtgtatagaagcactattgatttttcacattgattttgtaacctgtaactttactgaatttattcattagttctagtagttcttttttggtggagtttttagggttttttaaaaatatatttatatatatatgtttttatatatatatcattttaagtgtaaacagagacaaatttccttttttatatctgatttgggtctctttcatttatttttcttgcctaattgctgtgaccaggacttccagtactatgttacatagaagtagtgagagtgagcattcttgcctttttcctcattttagtggtaaagctttcaatttttcaccattgagtatgatgtttgttgtgggcttgtcgtatatggcctttatcatattgaggtacattccttctgtagcgaatttattgagagtttttattataaaagaatgttgaattttgtcaaatgcttttttttgcgtatattgagatgatcatgtggttttagtccttcattctgttaatgtgatatgccacattaattgatttgcatatgtggaatcatccttgcatctcgcatcccagggataaatcacacttgatcatggttattatctttttatcttttttttttttttttttaacagagtctctctgtgttgcccaggctggagtgcagtggcgttatctcggctcactgcaagctccacctcccaggttcacgccattctcctgcctcagcctcttgagtagctgggactataggcgcccgccaccatgccctgctaatttttttttttttgtatttttagtagagatggggtttcaccatgatttccaggttggtctcgaactcctgacctcaggtgatccacacgccctggcctcccaaaatgctgggattacaggcatgagccactgcatctggccggttatatgactttatatgtttgtcaaaactcataaaactatgtactaaaaggctgaattttattgtatgtaaactcttccccaataaatctgacctaaaaaacaatcaaattctgttgactttaggataaagtattcagttatcaatgagtcttccctcaatggtgtatgaggcagaaatcacgttgcagagccgtggcatgatgtcccctgcacattccctttctagaacttgtcccagtttgaaattgctatacacatctccctgttaatccattgattactctcctctcctccacctggctgcactgagggccctggaaggcactgtatctctattacccagctgtgtgcttagcaataagaaacacttgtttgttgaatgaatgaataaatgaatgaatgaatgtatgattaaataggtgaattttatggatgaattctacatattgaccttgaagatatttcttaatatcacaacaaatattcaaataacaaatagttatttttaatctaagccagttattagccttattagtcagagtgccaactttgactttttacctccctaaagattcccaatatattgaaagggtggtattctgtcttctcttctagaattttctatgtattttccaacccaaattcttctttgctgccttaataatctcccaggaataccacctggagtaaatcctcactcactgcccattgactctactataggcttattttttatcttttaaattattaaaaaatatatatatacacttagagattgggatcttgctctgttgcccaagctggagtgcagtggtgacaaagctcactgcagccttaaactccttggctcaagggatcctcccacttcagccccccgaggagctgggattacaggcagaaaccattctgccaggcttattatataggttcctttagctggcagcacattcaagtgataatttatcatgaaccatatagaagatcacatctgctccagagggattcccccagcaggcataacttttcttcagagagagaaaacctccacatctgctttaggtgggaagaggtgtgtgattacggtcctgtctctttcagatcggcgcctacttcggggcctccctctgctccgtggacgtggacagcaacggcagcaccgacctggtcctcatcggggccccccattactacgagcagacccgagggggccaggtgtccgtgtgccccttgcccaggggggtgagtggcaatgggacctgggctgggtggggcccggtgtgggtggaggggtcgcctgggttggggcctgatactgtttgtgtttagcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccaggtgagacctggtcactgtccttgtcatgacagtagcctctttgttgatctttctcctaattcagtgtgcccacagctgccagataagttctcacagtactcctttcagaaccttcaaaaataataacatgtggctgggcctggtggctgacgcctgtaatcccagcactttggaaggctgagttgggaggattgtttaagcccaggagctcaagaccagtcagggcaacatggtgagaacccatctctccaaaaaaaaaaaaaaaaaaaaaaaattagccaggtgtggtggcatacacccatggtcccagctactctggaggctgaggccggaggattacttgagcctgggaggttgaggctgcagtgagtcctggtcacaccactgtactccagcagccagagtgacagagtcagacttgcacatgcatgcgtgcacgtgcacacacacacacacattcacagaaatctcaaagactcttagttccagattgattatttctacagcaataggaggtgcatgatagcctcatcacccccactttacagatgagtagatcaaggcccagcgatggcaaatggcaagctagcagtattgggatgcaggcattcctttcttctgaatctcggtcctggtaaggtgaccaagagctctagtttgcttaactctgtcccagatttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctgggtttttgctagccttacatttttctttctttatgtttaaaaatttttttattgtggtaagggcacttaacatgagacctatcctcttaacagattttaaaatgtacaatgtaatactgtcatctattggtgcaatgttgtacagcagacctcttgaacttcatcttgcatattgaaaatgtatacccattgattagcaactcctcattgttctctagcctctggcagccaccattatattctttgcttcaatgagtttggctgttttatttttttttagtttttgagacaaaagtttcagtctgtcgcccaggctggagtgcagtggcacaatctcggctcactgcaaccttacctcctgggttcaagcgattctcctctctcagcctcctgagtagctgggattacaagcatgcaccaccatgcctggctaatttttgtattttttgtagagactgggttttgccatgttgtccaggctggtcttgagctcccggactcaagtgatccacctgccttggcctcccaaagtgctgggattacaggtgtgagccaccgcaccctgccagtttggctattttagataactcatataagtgaaaccacgccgtattcatcctttggtgactggcttatttcacttagaataacgtcctccaggttcatccatgttgtcacaaatgaaagaatatctttcttctttttcttctcctcctcctcctcttcctcctcctcctcctccgcctccccctcctcctcctcttcctcctcctccccctcctccccctcctcgtcgtcctcctctcctcctcctcctcctcctccttcttcttttttgacaaagtcttgttctgtcacacaggctggagtgcagtggtgcaaacacggctcctggaagcctcaacctcctgggctcaagcgaccctcccacctcagtctcctgagtagctgggactgtgggcccattccaccatgcctgtctaatttatttttattttttgtagagatggggtctccctatgttgcccaggctgatggctttcttttttaaggctgaataatatcccactgtatgtatataccacaattaaaaaaatccatcatttcctggtagagagggaaggaaaaatccctcatctgttgataggcatttaggttgttttcacatcctggctattgtgaatagtgctgcaatgaacatgggcacgttcatatctctttaagatcataatccccattcctctggttaaataaccagaagtgggattattaaatcatatggtagttctatttctaattttttgaggaacttccatacgttttccctaggagctgcaccattttgcagtctcgccaacagtgtgcaaaggttctgatttttccatgtgtttaccaacacttgtcttttgtttttttggcaatagccaggctagcaggtgtgcaagtgaaatttcactgtggctttgatttgcatttccctgatgattagtgatgttgagcatcttttcatgtatgtattgggcatttttgtgtctgaaaaaaatgtctcttcaagcccttaagcttatttttaaatcaagttattaaggccgggagcagcggctcatgcctgtaatcccagcacattgggaagccgaggcgggtgtatcacctgaggtcaggagttcaagaccagcctggccaacagggtaaaacttcatctctactaaaaatacaaaaattagccgggctgtggtggtgcatgcctgtaatcccagctattccagaggctgagatgggagaatcgcttgaacccgggaggtggaggttgcagtgagccgagattgtgccactgcactccagcctgggagacagagggagaccttgtctcaaaaaaagagaaaagttattagattttttgctattgagttgtatgagttcactatatattttggagattaaccccttatcagatacatggtttgcaaatactctctcccattccataggttatattttactctgcttattcttgcctttgctgtgtagaagtctcacttggtttgatgcagtcaggcttagttatttttgtcgtctgtacttttggtgtcatagccataaactcattgctcaaaccaccatctttccagcttctcccctgagttttattctagatgttttactttttcattgaagtctttaattcattttgaattgatttttgtgtatggtatatgagtcaagttgcattctcctgcatttgtatatccagtttcccaataccatttgtctaagagagtatcctttacccattgtgtattcttggcattatttaggagaatcagttggacccatatggatgggtttatttctgggctctgtattctgttccatttgtctatatgtctatctttatgctagtaccatactattttaagtactataactttgtcatttatatatataatcctgcattttattagagtcaaataacattaaaagaaagacacttatattcgctttagaaaacccattgatgttgatgaatttggcacatacttataaaagcaaggcttattagctcatatatttggaactaaaaagtatttgaagttgatcacagcataatgaatcctcaatttccagagtactagagatgattatatacaaaaatccagtgaaacttattttactaatttaccagttctatatcactcctaaatttccctaaaaatatggatttataaaaggtagtattctataattcacaaatatgaagagctttattataatttgagtatgaactgtgtatcacccatatcatggcttcagaaaactattgcttttcttactaacttatttaaggtttcactacatgagtcagtatgcagaactcactatgttgtaactacgatctgtaatgataaaaatatagaacctctttgactttaatctaaaaaagtcaccttatcataaaacagtgttaacataatcaaaaattaaccctgacaaaaaaaaacccacttattttggcttttaaaaatagctcatgctcatggttctttcaaagtggtgttgtagctaccgtcttttctaacagaggaatattttcatcatagcaactatttctgagccaaaaataaaccacactaaaaacagaagaaaattctcagtgtagaaaggaaaaggctcatctgttgtgcaatagcaggcatcgggctctgtgagtgcctttcagacatcctcaatcaacccaactagaggcactattgagtttatccagtaagagcactgtgcaatctagtgctgtgagggcattacttaattagccaaaggaagaacaatctttttttctttcttttcttttcttttttcttttcttttcttttttctttctttctttctttcttctttctttctttctttctttcttccttcctttctttctttctttctttctttcttttttctttccttctttctttctttcttttttttctttctctttctcttttgtttttgtttttgttttgagacggagtctcgtgctgttgcccaggatggagtgcagtggagtgagctcggctcactgcaacctccgcatcccaggttcaagctattctcttgcctcagcctgccgagtagctgagatgacaggcgcccgccactacgcctggctaatatttttctctttttaggagagacggggtttcaccatgttggccaggctggtctcgaacacctgaccttgtgattcacctgcctcagcctcccaaagtgctgggattacaggcgtgagccaccgcgcccagctttttctttctctttctttcttctttctttctctctctctctttccctccctctttctttctttctctctctctctttccctccctctttctttctttctttctttctttctttctttctttctttctttctttctttctttctttctttctttctttctttctttttctttctctctttctttctctctgtttctttctctctctttttatttttttgagacaaggtctccctctgttgcccaggctggagtgcagtgacgagatcatggctcactgcagtcttgacacccaggctcaagcaattcttccttctcagctgcccaagtagctgagactataggtgtgcacccccacgcttggctaatttttcaattttttgtagagatgaagtctcactatgttggccaggctggtcttctggcctcaagccatcctcctgccttggcctctcaaagtgttaggattatagatgtgagccactgcacccagccaaagcagtcttcaagttatgtaccagtaatttatatagcttttctaaaatttaagaaagtactgaatggactatagttattatctaaaatttaagcaagtactgagtggactatagtcattatatgattttttaaaaaatttcagtaacttttggggtacaagtgctttttggttacatgaatgaattctatagtggtgaattctgagattttagtgcacctgtcatcaaagcagcgtacactgtaccaaatatatagtcttttgtctcttacctcctcccagactccccttccccaagtcctcaaagtccgttacatcactcttgtctttgcatccttatagtttagctcccacttataaatgaaaacatatatttagttttccattcctgtgttacttcagtaatggcctccagttctatccaagttgctgcaaaatacattatttgttcctttttatggctgggtagtactctgtgtatatatacacatatacacacacacatatatataactttttaaaatccactcattggtcgacgggtaccacagtttggttccatatctttgcaattgtgaattgtgctgctataaacatgcatgttcatgtatctttttcatataatgacttcttttcctttgggtagatacccagtagtgggattactgaatcaaatggtagatctactattagttatttaaggaatctccatactgttttccatagaggttgtgctaatttacattcccaccagcagtgtaaaagtgtccccttttcatcacatccatgccagatctattgttttttgactttttagttatggccattcttgcaggagtaaggtggtattttattgtggttttaatttgcatttccttgatgattagtgatgttgagcatttttttcatatgtttatcggccatttgtatatcttcttttgagaattgtctattcatatcctttgcctactttttgatgggattatttgttttttccttgctgatttgtttgagttccttatagtttctggatagtagtcctttgtcagatgcatagttggcaaatattttcttgcattctgtgggttttctgtttgctctgatgattatttcttttgctgtgcagaagctttttagtttaattaggtcccatttattggttttgttgcatttgcttttggggtcttggtcatgaattctttgcctaggccaatgtccagaagagtttttccaatgttatcttgtagaattgttatggtttcaggtcttagatttcagtctttgatccatcttgagttgatttttgtataagttgagagaagaagatccagtttcattcttctacatgtgatttgcctgttttcccagcgccatttactgaatagggtgtccttttcccaatttatgtttttgtatgctttgtaaaagatcagttggctgtaagtatttggttttatttctgggttctttgttttgttccattggtctaagtgcctatttttataccagtaccatgctgttttggtaactatagccttgtagtataatttgaagtctggtactgtgatgcctccagatttgttctttttgcttagtattgctttggctatttgggctctttttttttgttccatatgagttttaggattgttttattctagttatgtgaaaaatgatgttggtattttgatgggaattgcattaaatctgtagattgggcagtatggtcattttcacaatattgattcttcctatccatgagcatgggatatatttccatttgtttgtgtcatctataatttatttcagcagtgttttgtagttttccttgtagggagcttcacctccttggttaactatattcctaggcattttattttatttttgtagctgttataaaaggggttgagttcttgatttgattctcagctttgtcattgttggtgtatagcagtgctactgatttgcatacattgattttgtaacctgagactactgaaattgtttatcagatctaggaatcttttggatgagcctttagcattttctaggtaaatgatcatatcattggcaaacagctctaatttgacttcctcttttccaatttggacccctttatttctttctcttgactgatttgatttggctgggactttcagtactgtgttgaatagaagtgctgaaagtgggcattcttgtcttgttccagttcttagtgagaatgctttcaacttttcccccttcaatatgaagttggctgtgcttttgtcagataatggcttttattattttgagataagtcccttctatgtctaatttattgaaagcctttttttaatcataaagggatgctggattttatcaaatgcttgttctgcatctattgagatgattatatagttttcttctttaattctgtttatgtgatgtatcacatttattgacttgcatatattaaaccattcctgcgtccttgggatgaaacagacttgatcatgatgtattatctttttgatgtactgttggatttggttagctagtattttgttaaggatttttgcttctatattcatcagggatattgttctgtagttttcttttttttgttatatccttttctggttttgatattagtgtgatactggctttatagaatgatttagggaggattccctctttctctatcttttggaatagtatcatatcattggtaccaattctttgaatgtctgttaaaattcagctgtgaaaccttctggtcctgggctctttctgatttgatctcgctgcttgttattggtctgttcttggtatctatttcttgctatagctattatatgattaatccaaggtaccgaaaagcattttgaatgatttagcaggccatcctttttccttgtgtcctaatgaggaatttttttgacgcttcataattctcttaacaaggaattttagctcctcctccatcattttgtaaaataacgatgataatttaaaacttccatcaacatattaaattttcaaaattaaacaactaaaagctacaaaaatctcaaagtttgagttttaaactgaatatttgaagctaatatagaaatttttgataagaatatcagtgcagacatataacactcaaaccttcacagctaatggcaatatctattagcaatgcaaggtactctttttttttttttttctttttgagatggagaattttgccctgttgcccacactggagtacagtggcatgatcttggcttactgcaacctctgcctcctgggcaagagattcttttgcctcagcctcctgagtagctgggattacaggagtgcgccaccatgcccagctaatttttgtatttttagtagagattgggtttcaccatgttggccagtctggtctcgaactactgaccttgtgatctgcccgtctcagcatcccaaagtgctgggattacaggcatgagccaccatgtctggccgcaaagtactcttaatgacttttaaatcatgtttaacagagagtttacacaagttagtccaatgtagttagtattagtgtccaataatatatgaacacccttcaagacaattgctgctacattttcaatataattattaattgttgtctgaaaaacacacataaacgcaagtgagactaaaagttgtgtcacaaaagaaaaaaagaaaagaccagtaccatgctgttttggttactgtagcctggtagtatggtttgaagtcaggtagcgtgatgcctctagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacaatattgattcttcctacccacgagcatggaatgttcttccatttgtttgtatcctcttttatttcattgagcagtggtttgtagttctccttcaagaggtccttcacatcccttgtaagttggattcctatatattttgttctctttgaagcaattgtgaatggaagtgcactcatgatttggctctctgtttgtctgttactggtgtgtaagaatgcttgtgatttttgcacattgattttgtatcctgagactttgctgaagttgcttatcagcttaaggagattttgggctgagacgatggggttttctagatatacagtcatgtcatctgcaaacagggacaatttgacttcctcttttcctaatcgaatgccctttattcccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatatgtcctatcagtacctaatttatggagagtttttagcatgaagggttgttgaattttgtcaaaggccttttctgcatctattgagataatcatgcggttttcgtctttggttctgtttatatgctggattacgtttattgattttcgtatgttgaaccagccttgcatcccagggatgaagcccacttgatcatggtggataagctttttgatgtgttgctggattcggtttgccagtattttattgaggatttttgcataaatgttcatcaaggatattggtctaaaattctctttttttgttgtgtgtctgccaggctttggtctcaggatgatgctggccttataaaatgagttagggaggattccctctttttctattgattggaagagtttcagaaggaatggtaccatctcctccttgtacctctggtagaattcggctgtgaatccatctggtcctggacttttttttggttggtaagctattagttattgcctcaatttcagagtctgttattggtctattcagagattcagcttcttcctggtttagtcttgggagagtgtatgtgtcgaggaatttatccatttcttctagattttctagtttatttgcgtagaggtgtttgtagtatcctctgatggtagtttgtatttctgtgagataggtggtgatatcccctttgtcatttttgtattgcatctatttgattcttctctcttttcttctttattagtcttgctagggctctatcaattttgctgatcttttcaaaaaaaccagctcctggattcactaattttttgaagggttttttgtgtctctatttccttcagttctgctctaatcttagttatttcttgccttctgctagcttttgaatgtgtttgctcttgcttctctagttcttttaattgcgatgttagggtgtcaattttagatctttcctgctttctcttatgggcatttagtgctataaatttccctctacacactactttgaatgtgtcccagagattttggtatgttgtgtctttgttctcattggtttcaaagaacatctttatttctgccttcattttgttatgtacccagtagtccttcaggagcaggttgttcagtttccatgtagttgagcggttttgagtgagtttcttcaccctgagttctagtttgattgcactgtggtccgagagacagtttgttataatttctgttcttttacatttgctgaggagtgctttacttccaactatgtggtcagttttggaataggtgtggtgtggtgttgaaaagaatgtatattctgttgatttggggtggagagttttgtagatgtctattaggtccgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagactgttttacccgagactaggattgcaacccctgcctttttttgttttccatttgcttggtagatcttcctccatccctttattttgagcctatgtgtgtctctgcacttgagatgggtttcctgaatacagcacactgatgggtcttgactctttatccaatttgccagtctgtgccttttaattggaacattaagcccatttacatttaaggttagtatttttatgtgtgaattagatcctgtcattatgatgttagctggttattttgctcgttagttgatgcagtttcttcttagccttgatggtctttacagtttggcatgtttttgcagtggctggtaccggctgttcctttccatgtttagtgcttccttcaggagctcttttagggcaggcctggtggtgacaaaatctctcagcatttgtttgtctgtaaagtattttatttcttcttcacttatgaagcttagtttggctggatatgaaattctgggttgaaaattctttcctttaagaatgttgaatattggcccccactctcttctggcttgtagagtttctgctgagagagaaagttcgggttacccacaaagggaagcccatcagactagatcagctgccagtctgatgggcttccctttgtgggtaacccaacctttctctctggctgcccttaacattttttccttcatttcaactttggtgaatctgacaattatgtgttttggagttgctcttctcgaggagtatctttgtggcgttctctgtatttcctgaatttgaatgttggcctgccttgctagattggggaagttctcctggataatatcctgcagagtgttttccaacttgattccattctccccgtcactttcaggtacaccaatgagatgtagatttggtcttttcacatagtcccatatttcttggaggctttgttcatttctttttattcttttttctctaaacttctcttcacgcttcatttcattcatttcgtcttccatcgctgataccctttcttccagttgatcgcgtcagttactgaggcttgtgcattcgtcacgtagttctcgtgccgtggttttcagctccatcaggtcctttaaggacttctccgcattgattattctagttatccattcgtctaattttttttcaaagtttttaacttctttgccattggtttgaacttcctcctttagctcagagtagtttgatcttctgaagccttcctctctcaactcgtcaaagtgattctccgtccagctttgttccgttgctggtgaggagctgcgttcctttgtaggaggagaggcgctctgatttttagagtttccggtttttctgctctgttttttccccatctttgtggttttatctacctttggtctttgatgatggtgacgtacagatgggtttttggtgtggatgtcctttctgttgttagttttccttctaacagtcaggaccttcagctgctggagatatagaccaatggaacagaactgagcactcagaaatagtgccgcatatctacaactatctgatctttgacaaacctgacaaaaagaagaaatggggaaaggattccctatttaataaatggtgctgggaaaactggctggccatatgtagaaagctgaaactggatcccttccttacaccgtatacaaaaattaattcaagatggattaaagacttacatgttagtcctaaaaccataaaaaccctagaagaaaacctaggcaataccattgaggacataggcatgggcaaggacttcatgtctaaaacatcgaaagcaatggcaacaaaagccaaaattgacaaatgggatctaattaaactaaagagctgctgcacagcaaaagaaactaccatcagagtgaacaggcaacctactgaatgggagaaaatttttgcaacctactcatctgacaaaggggtaatatccagaatctacaatgaactcaaacaaatttacaagaaaaaaacaaacaaccccatcaaaaagtgggtgaaggatatgaacagacacttctcaaaagaagacatttatgcagccaaaagacacatgaaaaaatgctcatcattactggccatcagagaaatgcaaatcaaaaccacaatgagataccatctcacaccagttagaatggcaatcattaaaaagtcaggaaacagcaggtgttggagaggatgtggagaaataggaacacttttacactgttggtgggactgtaaactagttcaaccattgtggaagtcagtgtggtgattcctcagggatctagaactggaaataccatctgacccagccatcccattactgggtatatacccaaaggattatacatcatgctgctataaaggcacatgcatacaagtgtttattgcggcactattcacaatagcaaagacttggaaccaacccaaatgttcaacaatgatagactggattaagaaagtgtggcacatatacaccatggaacactacgcagccataaaaaaggatgagttcatgtcctttgtagggacatggatgaagctggaaaccatcattctcagcaaactatcgcaaggacaaaaaaccaaacactgcatgttctcactcataggtgggaattgaacaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacaaacctgcacgttgtgcatgtgtaccctaaaacttaaagtattataataataaaaaagaaaaagaaaagaaatccaatgaatcaattaatgctatcaacaaagaacatgcaagaatgtaacattacatgtaatttttgttttcaaaaaagacactaaaatgccactgcattaaaatgtatttattatttattattattatttttgagacagggtcttggtctgtcatgcaggctggagtgaagtggtgcaatcatggctcactgcagccttgacctcccaggctcatgtgatccgcctgcctcagcctcctaagtgtctttgactgcaggtgtatgccaccatacctggctaatatttaaatttcttttgcagtgacagggtctgtctatgtttcccaggctggtctccaactcctgggctcaagtgatcttcccaccttggcctcccaaagtgctgggactactggtgtgagccactgcactcagccggactataatttattcagaacatctttagtgttcattcccagagatcttgatctgctcagtaatgctttcacaagatcgattatagccatcttttgcagtgaatgcttaggctggtccgtcctcctgtggtagtagggagcagtctttttttttttttttttaaatcttcatgtttttatttattttttcttttttaaattacacattgggccaggcacagtggctcatgcctgtaatcccagcactttgggaggccgaggcgggcggatcacgaggtcaggagttcaagaccagccttgccaacatggtgaaaccccatctctactaaaaatacaaaaattagctgggcttggtggcgtgtgcctgtaatcccagctacttgggaggctgaggcaggagaattgcttgaacccaggaggcggaggttgcagtgagccaagactgcaccactgcacgccagcctggcaacagagcgagactccgtctcaaaaaaaaaaattatacgttaagttctgtgatacatgtgcagaacatgtaggtttgttacctaggtatacaagtgccatggtggtttgctgcacccatcaacccgttgtctaggttttaagcctcacatgcattaggtatttgtcctaatgctctccctcccccttgatccccacccctcaacaggctccagtgatgttcccctccctgtgtccatgtattctcattgttcaactcccacttatgagtgagagtatgtggtgtttgctttcctgttcctgtgttagtttgctgagaatgatggtttccagtttcatctatgtccctgcaaaggacatgaactcattctcttttatggctgcatagtattccatggtgtatatgtaccacattttctttatacagtttatcattgatgggcatttaggttggttccaagtctttgctattgtaaatagtgcttcagtaaaaatacatgtgcatgtgtctttatagtagaatgatttataatcctttgggtatatacccagtaatgggattgctgggtcaaatggtatttctggttttagatccttgaggaatcgccacactgtcttctacaatggttgaactgatttacactcccactaacagtgtaaaagcattcttatttctccacatcctctccagcatctgttgtttcctgactttttaatgatcatcattttaactggcatgagatggtatctcattgtggttttgatttgcatttctctaatgaccagtgatgagcttttttttttcatatgtttgttggccacataaatgtcttcttttgagaagtatctgttcatatcctttgcccattttttgatggggttgtttgtttttttcttgtaaatttgtttatgttccttgtagattctggatattagacctttgtcagatggatagattgcaaaaatattctctcattctgtaggctgcctgttcactctgatgatagtttcttttgctgtgcagaagctctttagtttaattagatctcatttgtcaattttggcttttgttgcaattgcttttggtgttttagtaaggaagattttgcccatgcctatgccctgaatggtactgcctaggttttattctagggtttttatggttgtaaattttacatttaagtctttaatccatcttaagttaatttttatataaggtgtaaggaagggatctagtttcagttttttgcatatggctagccagttttcccagaagcatttattaaatagggaatcctttccccatttcctgcttttgtcaggtttgttgaagatcagatggttgtagatgtgtggtgatatttctgaggcctctgttctgtttcatttgtctatatatctgttttggtatcagtaccatgctgttttggttactgtagccttgtagtatagtttgaagtcaggtagtgtgatgcttccagctttgttgttttgcttaggattgtcttggctatatgggctcttttttggctgcatatgaaatttaaagtagttttcacaagatcagctacagccaacttttacagcaaacggttaggctgttcctcctgtggtagtaggaggcagggtttttttttttttttttttgagatggagtctcagtctgtcacccaggctggagtacagtagcgtgaactgcaacctctgcctccaggttcaggtgattctcctgcctcagcctcctgagtagctgggattacaggtgcccaccaccacacccagctaatttttgtatttttagtagagatggcatttcaccatgttggccaggctggtctcaaactcctgatctcaagtgattcacctgcctcagcctcccaaagtgctgggattacaggtgtgagtcaccgaacccggccctctttgcccatttttaaattgggttatttattttcttactattgagttctttatgtgttatggatattaaccatttatcagttgtgtggtttgcaaatattttcccccagtctgtaggttgtctcttcactctgttaattattcctttattgtgcagaagctttttagtttgatgcaattccatttgtctgtttttgtttttgttgcttgtgctttcaggatcatataaaaaaatcattgcccagaccaatgtcatgaagctttccctctacgtttccttctaatagtttatagtgttagatcttacatttaagcctttaactcactttttaatttttttattttttaatttaattttattttagatggagtctctctctattgcccaggctggagtgcagtggcacgatctcagctcactgcaacctccacctcccgggtcccagcgattctcctgcctcagcctcccaagtagctgggattacaggcctccgccaccatgcctggctacttttttgtatatttaatagagacggggtttcaccatgttggccaggctggtcttgaactcctgatctaaggtaatccacccgcctcagtctcctaaagtgctgggattacaggcgtgagccactgcacccggcccagcacttttgatttttgtatttggtttgagataaaggctcagtttcattcttttgcctgtggatatccagtgttcttaacaccatttgttaaaaagactgtcctttccccattgtatgcccttggcacctttgttgaaaattagttgattgttggccgggcgcggtggctcatgcctgtaatctcagcactttggaaggctgaggcgggtggatcatgaggtcaggaaatcgagaccgtcatggctaacaaggtgaaaccccgtctctactaaaaatacaaaaaattagccgggcgcggtggcgggcgcctgtagtcccagctactcgggaggctgaggcaggagaatggcgtgaacccgggaagcagagcttgcagtgagtcgagattgcgccactgcagtccgcagtccggcctgggcgacagagcgagactccgtctcaaaaaaaaaaaaaaaaaaaaaaaaaaaaaaaaaaaaaattagccaggcatggtggtgggcacctgtagttccagctactcgggaggctgaggcaggagaatgggggaacctgggaggaagaggttgcagtgagcctacatcatgccactgcactccagcctgggtaacagagcaagactccgtctggaaaaaaaaaaaaaagaaaagaaaattagttgattgtaaatgcatgggttcatttctgagctctgtattctgttccattggtcaatgtctctgtttttatgtcagtgtcatgctgttttgctgagtatacctttgtggtgtattttgatgtcaggtagtgtgatacctctacctttgttgtttatgctcaagattgtcttggatatttgaggtcttttgtgacttcatattaattttagtattgttttttctatttctgtaagaaatgccattgggattttggtaggaattacattgactctatcgatcactttgaatagtatggacctttaaaaatattctttcaatccataatatgggatatctttccattgatttttgtcttaactttctttcgtcaatgttttatagttttagtgtgcatatttttcaccttcttggttaaattaacttgtaagcattttattttttgatgccattgtaaataggattaatttctttttcagatagtttgttgttagtgtatagaaacaaataatttttgtatgttcattttgtattccatgactttactaaatttgtttattaaatttgataactttttcgtagagtatttataacaagtttcttatatataagatcatgtcaattgcaaacagggacaatttttttttctttatttctaacttgaatgcatttcttatctttttcttgcccaattgctctggctaggactttcagtactgtgttgaaatagaagtggtgagtgtgggcatccttgccttgttcctaattttagtggtaaaatcaaattttcaccactgggtatgatgttaactagacactttttttaatgttctttatcatgttgatgtaatttccctgtatttctagtttgttgagggtttttaatcatgagtggctattcctgtggcctgaatgtttgtgtcctccccagattcatatgttgaagcctaattccttgtgtgatggtatttgtagatgggacctttggaaggtgtttaggtcatgagagtgtggccatcattaataggattagtgcccttagacaaaagcaaaatgatggttgcctatgaaccagaaaataggctctcaccagatattgaatctgcttgcaccttgattttggatgtcacaagtcttcagaactatgagaaataaatttctattgcttataacccatccagtctatgttatttgttataccaaataagctaagacagatgtttagttttattaaatgctttcttttcttattgataagatcatgttatttttattccttattctgttaatgtggtgcatcacatttattgatttgcatatgttgagccatccttgcatgccaggaataaagcccacatggtcatggcgtatgacccttttgtgctattgaattcagtttgctagtattttatttaggattttggatctatgttcaatagggaaattggcatgtagtgatcttttctcatggtgtgtttgttgggatttagtgtcaggatagtgcttgcctcatacaataagtttggaagtattccctcctcttcagttttttggatgagtttgagaagaattcatattaattcttatttaaatgtttggttggtagaatttgcctgagaagccaccaggtcctgggcttttctttgttaggaggtctttgattactgattcaatttccttactcattatagatctgtttaaactttctattgccttatgattcaggcttggtaggttgtatatttctaggaatttatccattccttcaaggttatcaagtttgttaacatataattgttcatagtagtctcttaatgatcctttttattgctatggcatcagttgtatgttctttcatttataattttacttatctgttgtttctgttttttctccctttttccttggtctacctaaaagcttgtcagttctttttttttttttttttgagatggagtctcactctgttgcccaggctggagtgcagtggcatgatcacagctcactgcattctccacctcccaggttcaagtgattctcctgcctcaggctcctgagtagctggcattacaagcacgtgccaccacacctggctgattttcgtatttttagtagagacagggtttcaccatgatggccaggctggttttgaactcctcatctcaggtgatccacttgcctcgacatcccaaagtgctgggattgcaggcgtgagccactgcacctggccaaagcttgtcaattctatctttttgaaaaatcaacttaatttcattgatttttttctattctctatttgatttatttttctgtaatctttattattttcttccttctactaactttaggtttagtttgttcttttatttctcatttcttgaggtgtaaagttaggttttgtaattgaaatttgtctttttgttttaaaattaggtgtttatcccgaactttcctttagtactgcttttgctgcctcccattaagtttggtatattgtgtttttgttttcatttatctcatgttattttctaatttatttttttatccattagttgttcaatggtgtattgtttaatttttacatatgtatgtttttttccagtttttcttctggtattgtttttagtttcattccattgtggttggaaaagattcttgatataatttaaatcatttcaaatttgttaagacttgttttgtgacctaacatgtggtctgtcctggggaatggtccatgtgcacttgagaagaatgtatattctgcagtagttggcttgtgtattttgtatatgtctgttaagtccatttggtccattctcccttgggttttttttttgtctagttgttctatttgctattgaaagtaggattttgaagtttcttactattgaattgctgtctatttctcccttcagttctgtcattattagctttatatattcagatgtctgatgggtgtgtatataattaattgttgtaactcctggtgaaatggccatttcatcattatataatatcattatttgttttttgacttaaagtctattttgtctgatattagcatgtcatcctgctctcttttggttaccattttaatggaatagcattttctactcctttacttttagcctatgtgtcagtaaatacaaagtgggtatcttgtagatagcatataattggattttgtatttttattaattctgccactctgttttgagagtttgcttctgtttacatttaaagtaattattgatagagaaggatttactactgccattttgttaattgttttctgttagtcatgtaggtcttttgtccctcttttcttctcttgctgtcttcctttgtgttttattgttgttaatttttgtattaatatgctttcattttgttctctttttgtacttttttttttttgagacggaatctcattctgtcacccaggctggagtgcagtggtgcgatctcggctcactgcaagctccgcctcccgggttcaggccattcttctgcctcagcctcccgagtagctgggactacaggtgcccaccacctctcctggctaattttttgtatttttaatagagatggggtttcaccacgttagccaggatggtcttgatctcctgacctcgtgatccgcccacctcagcctcccaaagtgctgggattacaggtgtaagccacgtgagccaccgcgtctgaccctttttttgtgtatataacttctaaaggtattttctttgtggtttccacaaaacatctcataattatcatggtctattttaagctgataacaactgaacttaaatcacatgcactctatacttttattccccactacacgttttacgttattgattcacaatttacagttatttatattgtgtatccagtaacataattttagctatagttatttttaatatctttgtcttataacttttataccataattaaaagtgtccaattcacttgcattaaggacatgacaaaatcacttttaaaatttctttaaaatttattatttggctgtcatttttttcaatattactcttgcacatactttaaagagtcaaaatagttccaaaaagctcactattaaaaaacaacaatttccacatacacgatggttttggcttcatttcccttgctcttgagggaaccactttcagctctttcaattctctatttgttccaattacataataataattttgctactttttgatttttgttttaccactgacttcccaccatggaaggtggagattgatctctttttcagttttccttttgccacatagtagcactcttttaccccccattcacgcctcatgtttatgtgatcattttgtttagatcaacattcagtgtttgcattattctgactacgtaaatgaaattcagctgagccaaataatatacttttacttttccctgtatgcagggaaatgcaggtaattaatagaaattggggttgggcgtggcggctcacacctataatcctagcacttgagaggctgacagggcagaatcgcttgagcccaggagttcaagaccagcctgggccacaaagtgagacccccgtttttattttaaaagtttttttaaaaaagaaattgtaggtatcctcttgaggttgtggtctaaaggtgaataattccttgataagttctaagctgtcctagttccttggttagttgcaagagatgagacttgagtagagcttagagaacctctgtctgggccatgctggatgactgagttatacatctcctgtctttcctacccctttctctctccacacctcttttttaccctcagcggatagcaggctccaagctctctcccaggctccagtattttggtcagtcactgagtgggggccaggacctcacaatggatggactggtagacctgactgtaggagcccaggggcacgtgctgctgctcaggtgagaatgccttttggagtcaaccggacattctcccttgaaggaatgtttcctgtttgaaggtccctgatggttttctggtgtccctttaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggtgaggcttggtggatgagtctcaagaggttaaacgaccgaggacatgaatgggtgctgcaatccactctgcccagccttctggctgtcctgaactgagttctcacaggctctgacaaccttctccaagccttacctgagtgagcaggctattgtcctgctgggtagggaagtccagtggacctccctaaagaggtgagcatgtggcacttccttactcactcagttctccagagaactgaaggccccatgcctgtgaacaaactatgtttttgttttttaataaacggagagaaaacctatttggggagattgaattgatgaagctaaacagagatttacaaagcactcacatacgcattttatcaccagtgacttcttcccttgttcctattctcaaagagtagaactgtgtttggggtgggagaatagtaatgacaatactaagaataactgtctctagtagtgacagcactaggaataactgtctctagtaatgacagtactagaaagaattgtaccctctttaaaagtaaaattattagctaggcatgatggcatgttcttgtagtctcagctacttgagaggctgaggtgggaggggaggatcacttgagcccaggaggttgaggccagcctgggcaacatagcaagacccatccctaaaaaatgattacctttctaggaacagttttcctgtgctgaggagatagcattccagatatgagagcagccagcatggctagaaattaagagcaaaatgttagagagtagggaattgaagaagaggtacccttaaacctacatagaagtccccctctactctttggctgactcttaagacacgaatgcctaggtcagtactccaagacacccagtagaaaacagcaactgaaaagccaaagagctgatcagagaattcagcagctcctcagtgctggggagacagagatttgagaggccttggtaaataccttggtctttccattgagacaactgactagcaaccaagagaaacaatatacaatagaaatagacccacaggtgattcagaaattagagtgattggataggaatttttaaaaggtaactataattaatatcttcaagaaaaaagggaaaggatgagaacttcagcaaaaacctggaattcataaaatagagtcaaatggaaactctagaaccaaaaatcgcactgactgaaatgaagaattcagtaaatagatttatagcagattagaagcagaacagagaattagtgaacaagaagacagtcatttgaaagtatctggataaatatgcgataaaaagaaagaaaaatacagaaaaacaccataagagatgtgtgggatatggtgaaagatctaacaaacatgtaattggaattacagaaagtggtggtgggggaggagagagagagagagagaaagaaaataggaaagatggaataggaaagacagaataggaaagatggaataggatggaataggaaagatgcagtagttaaagaatttccccaaactggccagtcacggtggctcacgcctgtaatcccagcactttgggaggccgaggcaggtggatcacctgaggtcaggagtttgagaccagcctggccaacatggtgaaaccccatctctactaaaaatacaaaattagcaggtgtggtggtatgcgtctgtaatcccagctactcaggaggctgaagcaggagaattgaacctgggaggcggatgttgcagtgagctgagatcgccccattgcactccagtctgggtgacaagagcgaaactccatttcaaaaaaaaaaaaaaaaattccccaaactgatgaaagacatcaagattctttacaaaatcaaagcaggataaatatgaaggacattatatcattgtacgttataatcaaactgctgaagaccaaagacaaagagaaaaaaatttaaagtagtcagaaaaatacaataaattttttagtgagtgacagaatagctaccatttattgagcacttattgtataaaagacactgtgctaaatacttgataagcactatttcatttcctttttaccattgggagggtatcattattatcctcactttaaaaataaagaatggaggccaggcgcagtggctcatgcctttaatcctagcgctttgggaggctgaggcaggtggattactttgagaccagcctggctaacatggtgaaaccccatctctactaaaaatacaaaaattagcacggcgtggtggcatgtgcctataatcccagctacttgggaggctgaggcaggagaaacgcttgaacctgggaggcagaggttgcagtgagctgagatggcaccactgcactccagcctgggcaagagagtgagattctgtctcaaaaaagaaaataaaaaataaaaagaaaggaaggaaggaagaagggaaggaaggaaaggaaggaaagtaggaaaggaaggaaaggaagaaaaggaaggaaggaagaagggaaggaaggaaaggaaggaaagtaggaaaggaaggaaaggaagaaaaggaaggaaggaaaggaaaggaaaaaaggaaggaaggaaggaaagggaggaagagagcgaggaaagaaagaaagaaagaaaaaggaaggaaggaaggaaagaagactcagagaagtcagataacataccccaagtcacacagctgagaagcagaggagctgggccttgaactcccatctgccgggttccgaggctcaggcccctcactgctgtgccaccctgtcccttcaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccggtgagcaggctagtggccagacccctgggtcttccaagcatggagtgggcttggggagctgaggagggcagatccccaaatcccggctatctcttagaattgcatcgaggacccagtgagccccattgtgctgcgcctgaacttctctctggtgggaacgccattgtctgctttcgggaacctccggccagtgctggcggaggatgctcagagactcttcacagccttggtgagtccagagttggggtcctgcaggggtgtggaagagaccagagaccaaggtggttgaaactcattttatttgattgcatctaattttacttcaacatttgattttattgtttaatttcacaatacttggttattttctttcctttcatttgatcatatttattttttaaaagtttccctttgagaagaattgtggcaatgacaacatctgccaggatgacctcagcatcaccttcagtttcatgaggtgagtttcctttcctcctcacctcctccagagaaggacccgtaccatgacccgctcttttctcctcctggcccccaagggagccgggtgttcctgggctataaggtccggtgtggctgcccctccactgttgtctcttcatcaagtgtctgcgtctctgttctgctggagcaggcttgccacagggaagcccagcgccccatcccccggcctgtcttcttcttcccacagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccaggtagccacatccttctcaggctctatctgacctttgcttccccatcctcacggccggaggtggatatcaccgcctttgcctcccctgccttccagaaccagcgctcacagcgatcctggcgcctggcctgtgagtctgcctcctccaccgaagtgtctggggccttgaagagcaccagctgcagcataaaccaccccatcttcccggaaaactcagaggtcagaactcctggctcctcccctccttttctctttgatttctttggggattcttttcttcttcttctcttctttagtagtggttcctttttgtacaaaacagctttattgagatataattcatataccatccaattcacctatttaaagcatacatttcaagcccggcacagtggctcatgcttgtaatcatagcactttaggaggtcgaggcaggaggatcgcttgagcccgagagtttgaaaccagcctgggtgacacggcgagaccctgtctctacaaaaaatgtaaaaattagctgggcgtggtggtgcacacctgtagtcccagctactcgggaggctagggtgggaggatcgtctgggcctgggaggttgaggctgcagtgagctatgatcacaccactgcactctagcctaggcgacagagtgagaccctgtcttgaaaataaataaaatgaaataaaataaaataaagtatacagttcagtggctttgagtgaattcatagggtcttgcatccgtcatcatgatccattttggaacatcttcattacctcacaaagagcttctgttcccgttggccctcagccccagtcctcccatatcccccagccctatgcaaccactaatctactttgtctatagatttgcctattctggacatttcatataaatgaaataatcccgtatgtgatcctttccctagcataatattaagcaaggacttagcaaggatcattcatgtcgtagtatatgtcagtacctcattgctttaaaaaaattgtttttaaattttttatatatatttttgagatggagtttcacttcgttgcccaggctggagtgcagtggtgcaatcttggctcactgcaacctctgcctcccaggtttaagcaattcttgtgcctcactctcccaagtagctggggttacatgcgcccgccaccacacccagctaatttttgtatttttagtagatacagggttttgccatgttggccaggctggtctcgaactcctgacctcaggtgatccacctgcctcagcctcccaaagtgctgggattacaggtgtgagccaccgcacctggccttcattgctttttatttggtgaacaatatcctgttgcatggatgggccatatttcatgtctccattaatcagatgacgggcatttgggttattttttctctcatatttctgtcattgtctctcctttctctcactccaggtcacctttaatatcacgtttgatgtagactctaaggcttcccttggaaacaaactgctcctcaaggccaatgtgaccaggtgctctctgctaccaggcttctgcaggcagttgcccgtctgacgccccagcccctggcccatggtgggcctttgccctttgcccactggttctcccttcaactcatttgttcactcagcaaacactcactgaccacccaccacgtgctgggccttgtgctgagtgctggtgggatggtggtggatcagacgatagtggttcctgccctctcggagatgataatttagtggcaaagacagacaagaaatctagccattaatcttgcatccatctcaaatccagtatgagatgcaagattagatgggggacggccagtgttcttgggagtttggtgttcagagaagattcctaaagaaaatatatttaggagctgggcgtgctggctcaagcctgtaatcccagcactttgggaggctgaggcaaaacaattgctcgaacccaggagttcaaaatcagcctggacaacatatcaataccctgtttctacaaaaaaaaaaaaatacaaaaattagccaggcatggtggtgcatgcctgtaatcccagctactcaggaggctgaggcacaagaattgcttgagcctggaagattgaggctgcagtgagctgagatggtgccactgcactccagcctgggcaatagagtgagacccagtgtcaaaataataataataataataataataaaaaataaaagggaaaaaaagaaaatatatttagacaaagcaaaggcatgaactgagggcgggcatgaagacagaaggcaggaagcagataccagggacgggaagatcagggtgtgtttaagagtggcctcagcatgaaatgcagggctgaaggagttggtggtggttagatacaggccatgtcccaaaatgactgacgggtgttgtttgggatttgcagtttcgcctctgggagtgacataatcatatttgcatgttagaacgatcactcttcaggagggctggcgattggggtgggagcaggtgtgaattcaggggaccagttagaagaaggtggttgcagacatccagctggagagggatgggcctgggctaggcgggggcaggggttggagaacagtggggtttcagatgcagagataacagaacttggtggctgattggaggcagggagtgagggagagggaggagcaaagactaactgtcagttctcaagagccggctggagctctttctttccctccagtgagaacaacatgcccagaaccaacaaaaccgaattccaactggagctgccggtgaaatatgctgtctacatggtggtcaccaggtgctggcttccaggactttagctgagcctccacttctgggctggacatggctgattgtgcatctgtgtgcatgagtctgtgcatgtgtgtgtgtgtgagagtctgaggatctctgtgcatgtatgtgtgcatgggtgtgtatttgggcatgggtgtgtgagtgtgatgatctatgtgcatgtttgtgtgcatggacgtgtatttgtgcatgtgtgtgtctgaggatgtatctgcatgtgtgtatgtgtgcatgggcgtgtatttgtggatgtgagtgtgatctatgtgtgtgtgcgtgcatgggtgtgtatttgtgcgtgtgtgtgaggatccttgtgcatgggtgtgtatttgtgcatgtgtgtgtgaggatctatgtgcatgtgtgtctgggcatgggtgtgtgtgcatatgtgtgtgtctgaggatatatgtgcattgtgtgcatgggtgtgtatttgtgcatgtgtgtgtatgaggatctgtgtgcctgggtgtgtatttgtgcgtatgtctgaaggtctatgtgcatgcgtgtgcgcatgggtgtgtatttgtgcatgtgtgtgtgtgaaggtctatgtgcatgtgtgtgcgcatgggtgtgtatttgtgcatgtgtgtgagggtctatgtgcatgtatgtgtgcatgagtgtgtattcgtgcatgtgtgtgtgtctgaggatctatgtgcatgtatgtgtgcatgggtgtgtatttgtgcgtgtgtgtgtctgagggtctgtgtgcatgtgtgtatgtgctcatgggtgtgcatttgtgcacgtgtgtgtgagtggcccaaatgggcacgcactgtgtgtccagcacacattggttcccccatccccctgcaccccaccccatctccaccccccaggacttcatacccattacccatgtgcctgttcgctccttacacacttagcctgagacaccctcccagggcacccctcatgttttgtcacctcctgtcccttttttctcccttcagccatggggtctccactaaatatctcaacttcacggcctcagagaataccagtcgggtcatgcagcatcaatatcaggtgggcagctgggacgtctgggtcctgagaaggaggctggggaggaaaatcgatggtagaaaatgcagaaacagggatgggaaatgtgcgcaaggcacctgtggtgtgccaggcttggttccacgctgctatcactcagtatgcacacatacacgcacgtatgtatgtgacatgcacgcacgtagttatcttgtattaccttcgtagcgactctgtggggcactgtcatgatccccagtttacagatgaagaaactgaggctcagagaggtttacagaacaagctcgaggtctcccaccgagtaagtgggagagctaggactggagaccaggccgtgtggcactggaatgcgtattacatgtacactctactctctcaaacaggaaggggcaggacgcccgggcctatggcctgccccgtggggaggggaggctgattctccaggctggtgggggaggaaggccagagccctgaccccgccctccccggtgcaggtcagcaacctggggcagaggagcctccccatcagcctggtgttcttggtgcccgtccggctgaaccagactgtcatatgggaccgcccccaggtcaccttctccgaggtgagcggagctcggcctgactcctgcacggccctgcgcgttcctctcacctctgttaatgctattgggttttagagccgctccgcccctctcctggacccaggccatctcacctcccgagatgaggccctggcgccttcatctctgccccttctcagtgcgtctctttcctcagaacctctcgagtacgtgccacaccaaggagcgcttgccctctcactccgactttctggctgagcttcggaaggcccccgtggtggtgagaagctaagtcagccccagggccacacagagacccagagcgcttccctgctggaacctgtatggtctctgagcaaacggggaggggtgttctctgccttcggcttccttacccgtcccctcccctcctgcgttccccagaactgctccatcgctgtctgccagagaatccagtgtgacatcccgttctttggcatccaggaagaattcaatgctaccctcaaaggcaacctctcgtttgactggtacatcaaggtgtgtggggtcctgaggcttcgccgggcacaggcgtggtgctcagggcccaggtgcagtgcccacccgctctcttccacagacctcgcataaccacctcctgatcgtgagcacagctgagatcttgtttaacgattccgtgttcaccctgctgccgggacagggggcgtttgtgaggtcccaggtacctgtcttgggcgctgaggaactattggagggagaggggctgcgcttgtggagatttctgggggaggagagagagacacaaagagagagggagagagagagacagagcgacagagagacagagagatacagagacgtaaggagagagacagacagagacagagagatagaggcagagggagaaacagacacagagacagacaaaggagagagagatagagagtcagagagatagagatagagacagagacagtgagagatggagatagacagagagatagagataaagagagagatacagagcgcgacagagacagagacagtgagccatggagatagagagacagagagaggcagaaagcgatagagagagatagaggacagagaaacggaggagggagaggagggagaagaggtgggggaggaggactgagggctggggttctgggggacatgaggaggggttccccacttgattcaggggtgcacacggtgtgaatggggaacccccagaaatccagagtcgtctcccctgacgcccctccttcctcccccagacggagaccaaagtggagccgttcgaggtccccaaccccctgccgctcatcgtgggcagctctgtcgggggactgctgctcctggccctcatcaccgccgcgctgtacaaggtgctccccgctgctcccccaccccctcccttcatcctctcgggcctcgcgctgcagctccgtgcctcggtttccccggcggggctgccagctgtgtgactggggcgagtctgggagcctctctgcgcctcagtctcttagggagggtggccgggttcatgcgcggggcgcgctgagaacgagtcgccctccttgtagtttctgtttttctccaggccccgacgcggatgtcactcccctcccgccccgccctcctgggtcccttctgtctctgccggccctcccgccccctccccctggtctgcggagccgcacgctccctggctgctgtcgctctcactgccctcctctgccccgcagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcaagtgtctgtgtgcaagtgtgtgcacatgtgtgcgtgtgcgtgcatgtgcacttgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggcagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcgagcctgcggcctgctggagcctgcgcagcttggatggagactccatgagaagccgtgggtggaaccaggaacctcctccacaccagcgctgatgcccaataaagatgcccactgaggaatgatgaagcttcctttctggattcatttattatttcaatgtgactttaattttttggatggataagcttgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacacaccacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcattctcttgttattgcatcaatgctgagttaataaatcaaatatatgtcatttttgcatatatgtaaggataa

SEQ ID NO: 2548 - DNA, 72926 bp, Homo sapiens; identical to SEQ ID NO: 2547
  source 1..72926: mol_type = genomic DNA

SEQ ID NO: 2549 - DNA, 35097 bp, Homo sapiens
  source 1..35097: mol_type = genomic DNA
ttccatggacagcctgtattgaagttttattttttttctatacacgtgattgattaacaatataattaatgggatgtcattttataccctgacaagtttaaatgtaaataaattggcaccacctttaatcagactgatgtcctgacttgcacaggaaacacgcacctaacctcaccaacctcaagccctccctcctcaagtctccatgcaaagactgtgccagtcagagtggagctgtccccccgacgagcccccagaagcacccggccggccatggctgtcattttgagggcggaaaataactggatttctggttaattggtgacatcctcaagagctgtggcaagccatgtctcggccgcgtgatggggcagacatggtgggtcctgacggccttgtcttcaccaagtgctcctaactctcagcaaacttggggttcatgaccgtcgtggtggcgctcttgaaaaggggattatcctggtgggaaatgcaaacaggggcttgtgagtgtgggaggttttcagagcagaatctttctccctgaggacactccccgcatggaagccgtcactttgaggaagagctagacgtggggcagcccccccagggtcccagcaccggcagccaagctcacccacagcggcggacgcccagaggacaagctgcctggggaggccggggtgcagccacacacgggtgtccacggcctcccgcagcaggaggtcgcatagtgtgggacgcacgtgcccctctgcgtgggacccccaaggacggccacttacattgttccactgggacttgagcttctccttctcaaagcgcctgtactcccggaggtcgctcaggtggatcagagccttccagatgaccagcaggagaatgccgatcagcacgatgcctgccacggtgcccccgacgatggcggcgatgttggggcctgccacacactctagggaagaagcagcacacctgagcgtcagtccagccccatctcactgagccgtgtgcccacaggtccgaggtcaccccacaacacagcacttagagagacggaggttcccagggccccggctcaccatccatcaccatggccaggggtcagtgagaacctggcccagcccctgctggattccaggccaggccctgtggttccaaatgaaacctaagggccattgccaccacccctgctgacagagaagaaggcagggccagggtaccgggcagccaggacagagtgctaatactggggggtaggacacagtgcgagggaccccgctctcctacagcagagttcagaaccaggctcagggtccctgctggagttcactccccatactgtgaaagtgatttgtggtcgtcaaggacaagaccagagaccagagctcagcaggtgaggccggtgccaggatgagcaacgcaaggtcctggttcccacggcagctgtgcccacctcctgagcatggggactgtgggccatagtgggccaggcccacagctgctgaccctgggacagacactagcgttcagtgcagtccctggcctggtctggcatcctcactccctgtacccctcctgccatcctgacctgcaccctcactccctgtggttgctcctgccatcctgatctgcaccctcactccctgtgccccctcctgccatcctgacctgcactctcactccccgtgccccctcctgccatcctgcctttcctgggggacctgccttccttcacctgtcctcaaaggtgaagtgacttggccaggattgcacaaaccagacgtgacccaagtctgtccctcaaagtggcccgcaggggttcctgccctggcaggtgggggtctgcagccccaggcccacatgtgggttgtgagctccaggcatgtcacctacaggctcagagacccccgccgcctgcctcgggtcccttcctggtgagggaggagctcccaggtctcagttctgcaagagtcctggccggctgctggccatgcctgatggagtccgccagcggccccccagccccagcccctctgcctctcaggagcctgtggaacatgagacctgaagaagcagggccagtgtcaccaaggtcaccgtggggctgggcctggttccaactggagctgaatgagacagggtcagtgccaccaaggtcactgtggggctgggactggttccgactggagccgaatgagacagggtcagtgccaccaaggtcactgtggggctgggactggttccgactggactggagccgaacgagtgatggggacggtggtgcctggtggccctgggcccctccagggctgagagccgagcaccaggatctcccaatcccctcaaaggagcctcacgcagcaacctgaccgcgggccacccctggggacctgcaactgcaagccttgccccatgaggcatccagcgggagatggcccgggccgtgtggcatgctggtgggcctgcccggtgtggagcagtggtgcccccagggagcaggccgtctgctgcccagcttgatgtggggtcaggtgaggaggggagggaaaggggaggctgctgggggtgaggggaccggcctctggcctccttgcaatgccaagggcatcccgcatggctcatccaccctgctgggcccacaacactggaggtgagatcctccttccgcaccaccctcgcctctgcggagaccccgcagccggagctctggagccggtccccgctgcaccccagcggcctcacctcggctctcatccacatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggggagccaggtgtgagcatcggtgccagggtgtgcgggggctccggcaacgggggctcgggcttgggtgtgtgtccaccagggggggcaggtggggttggggcgccctcaggccaaggagggggcccaagtggggcagatgcgggtgcagcgggtgaactggaagcctgatcccagggcccgcggcaggtgcgcacaggagggaggagggacacaggggcacggcggccgcggagggcccctcagtccagacgcacccgcagagaaccccgcggtgcagaggtgctcactggggtccccgagtgagcccggctgctgggtaggtggccggggagtggggatccctgcccgccctgcctgctccgcctgcactcacatgtacttgccacagggtgaggggcagccggggcactcctggcacagaggcagctggtagcctgaatggcactcgcatacgttgcagcggcaccggccacgaccactacactcaacacgccgcgggttcaggcagccctcagtggtcctctcgcactggcacgctgagccctcaaagcccgggtggcagcggcacttcccgcagaagcagagccccctccctggaagacggggcagcacggctaagctcctgcttggcctgggaaccgagacccgcccgaaaccccactgcggttgctccctccggcccgcctgcctcctccagcctgggggatgttcctgagcaaaaggcatggggccactagccaggcccttctgcccccgccagccacgtggccgcctcctggccagtctggacctcccctgccctgctgtgaatgggacctcaatagggctatgaccgttcctcctgtgggccctccccacaaggacgccttgtcctcatggacacagaaactgaggcagggcggggtgcagggccatccaagttcctgctgacgcccggtggctgggcgagacttgcactgtctgtcctcaggatcccccctttctgttccactcgttgaatggtccagaacgcaccccccaacaccaagtctgtgccgcaggacggccgttgtccagcagggacccacgggctcacccgggccgccgcagacctggccgttgtagcgctcacagttgatggtgtcacactcgcagtactgcccgtatatcagcttgccggggacgtcgctggtgtggcacaggcactgcccgcagacacagtcccccagccctgagcagatgatggagttgttgtccttccggcagcttccttccagctcctggctgctccggccctgtgtctggcactcacagtttttcccaatgtagccagtgtcacacctggggacaggaggggccccaaggtcaggctccccccagtgatgtgggacaagggacagccgccctgtcctccaggccccttgcccttggtggagaacacccctatggcacattttgctttcctcgaggcctactgagcacttgccacggactaaatgtgctcaaaacgtgcaggggccccgcgttccctccccaggatgtcccgaggggaaagcagacacctggccttggcctgcgcatgcagtggctcggcaggctcactgtggagctgtgttgcagccatgcacatggcctgtgctgcgataccggtgctctgtgagtggctggtgtctgctcctgcgtgccccacatggtggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccctacagtcccgtgaagaggccgccccagggctgcacacccaggacagtgggcggggtggccactgaggcacgaggacagcaacagagaccaccaagaccacagagaccatcattgtcctgagatatgggaggaggctgggggcagcagggacctgaaggtgaggaagggcactgccaccaggacgtggattggcactgcggtcaggacaggggaggaggtgaccagagcaaagggggcagagtcctgggaggtcagcctagcagctctggccaggcaagcaaggaaagggggacagccatccagcccccgggcaggccgcctggctgagtgccatgtgaacctccccactgggtccacctgtcccccacttctccctgaggtggggtgcccacgcctggcagggggtgtgcacgcccaagaggtggcctatggggcccaggctcccagaagccatcacctgtcccaggaggctctctagccacccatgccccagggctgccagcctgatggccttgggtccccaaggtcagagagaagccagctcctagggtcaaggaaggtcgggcagagaaagtgacccactcaaggccatgggcacgcccagcggggactccttgtgcccctgagatgggcctccatcctctggtgagggggtcctcctgcccacaagtcccctgccttgggtcctccatggccagagagtgtagagtacaggctggcattgctggtgccctggctcaggagcacgggtgagggcttgccgaggggttctgggttccaatcccaaatctccccacctcctgcagaagggggcccccaggatgcctgctccgtggggtgggggaagggatggagccacctgcacccacctcacctgccgacacctgccctgtggggtggggctcggggatggttcaacagggacctgcgcccgcctcacctgcagatgccgcactccaagaagcccttgccatggcagaggctgcggtctctgctctggtcccggcaccggcactcacactggggaagaacctgcacggtcactatgtccgtgaagcccagcgcccggatgacaaacgactgctcctggatgcactctgtggccgtgaccttcacctggaaggtgatctgcagggcagtgctgggctcaggtggggaccctcggtggccagggtggcagcccagctcccaaccctcacctcctggcctctgcaggggtcctggggggttcagcgtggggaggaaggggtgaccaggagcaggaagagctgatgctcagatccgagagccaaagtcagccggcaaggaggtgctctgcccgcactcccgcactggccggcaccaggatctccccggccacacatcagcagagacatgtgacacgcagacagcaaatcaggagaagctgagcacactcccactcagaccacccaacatgagggaaacgttctggtgagaatccatgggacagctgggcgccgcggctcacgcctgtaatcccagcactgtgggaggccgaggcgggtagatcatctgagggcaagagtttgagaccagcctggccaacatggcgaaactctgtctctactaaaaatacaaaaattagccgagcgtggtggcacacgcctgtagtcccagctactcaggaggctgagtcaggagaatcacttggattgtagtgagccaagatcgcaccagtgcactccagcctgggcgacagagcgaaactccatctcaaaaaaaaaaaaaaaaaaaaaaatccacaggcaacatttaccaagaaacatgtttgaaggaattccaaagtcatattaagaaaatgcaatgaaagcaagtgtcttgctgaatattatttcacagctagcaaaaaaaaaaacaaaaaacaaaaaacaaaaagaaacaacaaatgattggataataaacttaaacctgaaagattagagaaggaactcagtgtccattcctaaccacctgtgtggcccatgccttaatgtttctgtcaaaaaaacagaatgaaacacgcagaaaatcatgacaactaaccctacccaggtttgccgtttgcgcctgttctgtgtgtccggcgtctgcccccagggggcgcagccatcactccatccctcagtctgcagtggcctgacccagggatttgggctccaggttgatgagtaggactcttgggggccaaggcgtgtgtgaagaaccctcccagcaccctctcactgagaagcaccctctcggcaccctctcactgacgttcctgacatcagcttcacaaggaaagcgtctggcctcggcagagaggatgtgaaggaaagaaacagggtccttccagtggatgctgcctgctcccagacagcctctgatgcctgtgtgcccctccctgcccccgtcagagtgctgggatggggaccctggctccttctggctgtccccaggacccctcagtgtgctgggatggggaccctggctccttctggctgtccccagagcccctcagcaagctgggatggggacccttgtggccaggctcaccgggacattgatctgcacgccatcacagtcacctctgggctggttcctgtgcgtcactccattgctgcagaaggagtcgtaggtgactttcagggtgtcggggagggcgttgtgatccaggaagaccctggaggagagtttctgcgggcagagagcggttactcttgggggcgagtgtttctgttgtcctggccctgcctggcccagcggtttagacccgtctccacttctcctctcagtgcaagtccccagtgtcagctaatgacacagaggagagcacagcaggatgtgctgaggatggcagggctgccagggccacagtcctgccctcgagacagcctgaccacagggactagcatggagccagggtgtgagcctcaggggtgggagcttctgctgctcctcagccttgagtccccaggacctagcacagggcaggagctgcataaattgttcaagcgataagagagatggggagaaacagagagaggcagagacagacagagatgggcagagccagagccagagacagagagatggagagaaacagagagaggcagagacagagacagacagagatggggcagagacagagagagacagacagagagagacagagaaagagagacaaagactgagagacagacggaaattgagaggaggcagagggacaggttcataggggcatcgggtgaatggccagggcagtggcgtcacctgcatcctctgtgtaaggacagaaacacctcgggcagtggctggcacccaggagggtctgctctgggggtttggggctcacgggaggctacgagaagcaaatggcacctcctccacgggccttcagtttaattcaatgacccaacgtttgtcggaggcgctaacgtgctgagctccctcaagccagcaggacctttggcctagaaggatccaggccagaattctgagaacatctctcacctgggggtagatttccagagcagtcgggacctctggtgcctggggccctgaatggcacctagtgcgcacctatgcctacctatgcccaccagggccatgggctccccaggggagcagcccagggtgcagctcgatgggccgtgcaccagggagaaattcaggggttaagggcttctctggagcttgcccaggacaggtgaacagagcaagaggaattccaccccccagggtgtcttcccagggcccaagtccactgtgggggtttcctgtggcctcctcctgccccagctgcactgtttgccaccagagctgtccacctcccttctccatagagacccgcagagaagagtctggaatgaagagtccggagctcaggtttcagggagcatcgcccacaacatcaacgagagaggacccagagctccccgtggaagtgccgggccagggtgtcctggaggcctgagggcaggtcgggaggctgcagctggcccacggggcaggggctttcctcccagaccaccctcctgctgacctgcagcaggagctgacctgcagtggggagattgctggccaccccatgggtcccagctgagtggtgcgggagactcacattgtaagcattcttaatgagttggaccacattgctggagtcctcagacagctcccccacggctgacttggggatgatctcggtgagtttctgttgggcaagaagaccagacatggcacggctaggacctgtgccacggcatctccacgcactgggctcaccccaggggcttctgcacctgcaaaatggctgggacggtcctcaacgcagttttgcacttggtccccagagtgtgtggtcagtgatgtgtggtaagaggttcttgggggtaaaaagccctgagctgcccaggggccacgcctggaataccagtactcgggaggccgatgtgggaagattgcctgagcccaggagttcaggaccagcctgggcaacataagaagaccccatctctacaaaaagtacaaatattagagtggtgtggcgtcacatgcctgtagtaccagatactcgggaggctgaggcaggaggatcacttaaacccaggaggtggaggttgcagtgagctgagatcgcaccactgcactccagcctgggcgacagagcaagaccttgtctcaaaaaaacaaaacaaaacaaaaaaaacccaggccaggcatgatggctcacgcctgtgatcccagcactttgggaggccaaagtgggtggatcactgaggtcaggagtttgagaccagcctggccaacatggtgaaaccccgtctctactaaaaatacaaaaattagctgggcgtggtggtgggcacctgtaagcccagctactcaggagactgaggcaggagaacccaggaggcggaggtcgcaatgagctgagatcacaccatggcactccagcctgggcaacaagagcaaaactctgtctcaataaaataaaatgaaatgaaatgaaatgaaatgaaatgaaataaaaaaataaataaaataaaataaaataaataaaaaataaaaaaaaaattactgttgcatcatgaggataagaaaagaaagcaaagccctgagctgcagcattgtccaggcctgcccgtgtgagtcctcctgcctgcggtgtgagtgatcccgcctgcggtgtgagtgctcccgcctgcggtgtgagtgatcccgcctgcagtgtgagtgatcctgcctgcggtgtgactgctcccgcctgtggtgtgagtactcctgcctgtggtgtgagtgatcctgcctggtggatttcaagctcgcaatatcactgggttgggaggacgtgcatggtggccagtgttggccagaatttccaccacacaggtagggaattcctaccaccacacagatggtaggcggaagtagccccacgagggtggatcacagtaaaatcaccaggaagccatcggctcttggcactctactgagtttccatgggtgttaaacagcccggtgacatcggttctggccggccagatgcacaggggcgcagccagcctcccccatgctcacacatgctcagcttctttcatggaagattgcggcatcatttcaccttccaggaacacggagcagatggtcgggtcacctccccgcccaaaccctcccatgactgccctgcatgggcccagtcccttccatggagctcctggggccggtcacagcctggccaccaccctcctctgcgccctccgcccaccgcccacttccatccgtcccagtctggggccatccctgtcttgggagagctgggccctcccacatcctgtcctgctgagcctgctgtgcgcttggtgcagaaacacactcggagggggcgtggcacgtgtgtccacactcgctgcctgttgccttgaccacccccgaaggtgaccaggaaaggctgaggaaggcttgtgtgccccaaggctcagcagtaggcatggggtgcactctacctgcctccagtgcctggccctggtgccacaccatcgcctggagtctggctgccatgacaaatggcaaaggattgggacctgctactgctggtgaggaggggaccgtcatggccacctacagatgggacacagggctgtgacatcctgaccagcaggtggtctctgtggatgtccggccccagccctgccctgcgctgacccactgtcccggcagcctgaccagctctgggtgcccactcggagggtcccccagacacctgcccccatcccgtgtctcccgcagggtcctgctcccactccagagcccggggaacctatggcaggaaccgctggtctcgctgtcggccccaacacaccacgaggttgagcttgtagctgggatacgggcctgacaatggatccctgtagttcagcaaatgttcactttacaaaagcagcggccctcccgggcactttccttccccaaaccccgagtatgtctcctcagcctaagcagcagggcaggggctgtgaggctgcccagctgggcagagccccaggcagggggaagagggggccctggtttcctgcgtgccattttgaagaagatggcggtgatggccctggaatggccagcaggtcggtcactgtccggatgaggataatcgggccctttagggcggctgctctgtgaattccctgagtgggtgagctcagtacccacgacgcactgcccgccgggcaccactacccctttcacagatgaggaaactgagggctcggggtaaggaagggcctggggcgtcctgtggtaagtaacagagctgggtgtgaggtgagccacccagggccctgtccaccctgaagaacggggcacgtggctgtgtaaagtacaatgacaactatctcgttcctccagctccaccctgaagaacggggcacgtggctgtgtaaagtacaatgacaaccacctccttcctccagctcagtccttctgtccctgtggcctcagggccacacactgtgcaggctgctatgggcggaggctcctttcaggagggcgtgcagtgtttccttccttctagcgaatccctgttacacagtcagggctccacccagcaggcctggctggccacaccccacacatgccaaagagtggtagaccccggctgagctcctgagaggtagcctctgagcccttggtacatcctacccgatgggggtgtcattgttcctggggcctcaggtcacaccggatagtcccacagtgtgatttggggtggggccctggacagttttcagcttgacctctggagggctagagactgaggtcagccatggggtgtcagccgcgccgctgtgactgacccccagtagacaccgaggctcaagagcctccttggggaccatgttctgtgcatgaggccacacatcatcgctgggaggatggagcgccgcccacacccctgcagggaggggacactgggagctggtgcctggtttctctcctgtgcacctttgacctttgctgacttttgtctgtatcctcccacctcgggcagcggctggcacccaggagggtcggctctgcaataaactgtaactgtgagtttactggttcctgagctctgcaagtccttccggcaaatcactgatcctgagaaaggtcttgggaaccccaacagcacctgagcgtcttgacgcactgacctgctcaggctgaacacatggcactagcagcggaaatgcaggatgaacgtgtttcactgggggcctctttttctaggagcagaggctggttatcagctgtgcttccttcgtgaaattcatcccactccgcactccaagcttgtgaacgtttttgtgtaattttatcttcacggagagtgttgatgttcaaatgtatgtgagcataaaataagtgtgtttccataaaataaagaattgtgttgtattccaggaaaaaacagaaatatcaccaatgccaagacatgctgttaacacagctgagtttcagggacggggaggaattcctcctcctatcgacacgcaggcgtcctgtccccgacgggaagcctcgggctcctcacctagggggatccaggacctgggccggctggttgctcacgtgcccagcatgcagaggtggcgctcagacctgcagtggcgctgggtctggcctgtggctgaaacatgcccccacccaatggatgctcgggacccaacagcactcacctcgtaggtcttcaccatcctactggtcaccgcgaagatgggctggatgttgttttcagccagcttgtgcgccagctggcccaccgatgggtagtcctggagagaggaggtcctgctcagttggccccgagtccaggacaaggcttccaggtacccgcccctgtctgccccgctcagcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtcttgtatctctaaagtcctttgcggcccccagagcctacaacgtcaggctgcaagagcgtcgcactacggccagcgaggacaagccccttgtgaccagtggttgcctctcggcccacggctgatcccagccagaagtcctggcccctctgagccattgagatgcctccgcagagaggctcatcctaacccgtgcatcctgggctccttctcgcctctgtccctccctgcatgttcctcatggtccccgcagccgctcacccagctcaggcaatgggggcagggaggggccacactggaggaggcggactcaggggcagcagggaacgtacagtggaggccgggagggggaggaggcggatgcttggggatgggaccctggccagaggcggggacggcagggtgcagccgtagcctgggggcggttactatacctccacagcagctgtcagcccaggtaggggggcagtggggctggagaccaacagagcctgggtgtcccacaagggcgaggccgggcctcagcctggctgcccccaccaaccctaccctcccctggcctgaggccagtccggggagaccccacgctgccacttggggcttccagaagtttcctcaggaatctgctccttgggtcagaaggaggctctgtcaggtggagaccccacccttgtctcctccgtcagtggtgtcctgccaggcggtgcctgggtgcctggggtggggacttacgaattcgttgctcctcttgtacaagttgtcctccaggtgacagcggccgtcgttgggggtcaggatggcgcccagcttcccgtcgcccgcgaaatggaagccgtcatcagtggcaaacaccagcagccgcgtgacgttgcgccagccgatttcctcctgagaagaaggcgtggggggcagggttacctgcctcagtttcccagacccggccctctggagcagaggagacgatgcagagctggtggggtggcccggaggctggtgtgggtccccctttcccctgggtctcagggacccagctgtgttcccccagacgccacgcccaggaggagacaacggccctcaaacaccccgtgcacatgtgaggcgcagggagtggaggcacgtgtggaaaggcaaggagagagacacggctgcggtccctgcacttcagagctgggaacaaaccctcaggaaaccatccccaaggggaaaaaccctcgcagacgtgtgggccacacgcagaacgagtgcaacatggaggaaaacgagcctgaggggcccagcaggccttgagtccaccattgacagcccctggcaggcgcatgtgggggccgtgcgtgtcctaggctgtgacctcacactcgtgagcagtgtgtctgcgctgggactgcagggaagcaggagagctaaggtgggttgtgaggggaggacagtgcatgtggcctcaacatggcccagggactgtggctgctctgttaggctgacagtcacaaactgggtgggcgggacgtggagagcgacacacactgggcagccagcgcccacccggcctggagggaggagggtggttccaccccaggaaccacgggacctgctgcctagcggccctgttccacccttggccgctcgcaaaatgtttaggcttcataaggtttgcccagggtcacaaatttaactcacagcaaacaatgaaatcagcgcatgattttcgagccctcgtggtcaccctcccttcctcctgccctttcctgcatgggcagcagcagggtgaggagctgctctccccaggcccaggctggagtccctcagacgacctgccggccagggtacccccctgcccccacacagcgcctgacagagccccccacactgggggaacgtggggacccaagcaggggcagcggcctcaccgggcaggcggcgacctgcatcatggcgtccagcccaccctcgggtgcatccaggtttccggaaatcagctgcttcccgacctcggtctgaaactggttggagttgttggtcagcttcagcacgtgcctgaaggcaaacgggggctggcactctttctccttgttggggcatgggtttcgcagcttatcagggtgcgtgttcacgaacggcagcacggtcttgtccacgaaggacccgaagcctgcagggcacatggaggggctggggaggtggcaggctgggcccaggtgggagggccagcttcaaaggggcacgagggcaagcctgtttcctctctcctagcagggaggtggagaaagcaagatggcacatgtggagtgtgtgtgtgagcatgtgcgttgtgcaagcacacatgtgaacgtatgtgggcgtgtgtgtgaacctgggagtgtgcaatgtacatggatgagcataagtgtatgcatgtgtgttcctgcatgtatgtgtgtgaccaggtatacatgtgggcatgtgaacaggtgcgtatgtgtatctgtgtgtgcagccatctgcatgtgtaaacatgagtgtgtacatgcgtagcacaactgtgtgtgcacgtattcctgtatgcatgtgagcatgttcaggtatggacacacctagttcacgtaggtgaccaggtacatatgtgggcatgtgtgtttatgtacgatttatacatgtgagtgaagacatacatgggtgatcatgagtgtgcatgtgagcatgtctgtgtgcacatgtggtcttgcacgtgtgtatgactgtgtgtgcatgtgtgtgcacatgcaagtgtgagcatgcattcatgtgtgtgagcatgcatttgtgtgtgagcgtgcattcacgtgtgtgagcgtgcatttgtgcatgtgagcatacattcgcgtgtgtgagcatgcatttgcgtgtgagcatacattcatgtgtgagcatacattcacatgtgagagcatgcatttgtgtgtttgagcatgtgtgtgagcatacattcacgtgtgtgagcatgcattcacgtgtgtgtgcatttgagtttgggtgtgcttttgtgtgtgagcatgcattcgcgtgtgtgagcatccatttgtgcatgtgaggatacattcatgtgtgagtgtgcattcgcatgtgtgagcgtgcatttgcgtttgagcatgcatttgtgtgtgagtgtgcattgcatgtgtgaacatgcatttgtgtgtgagcgtgcattcacgtgcatgagcgtgcatttgtgtgtgagcgtgcatttgtgtgagcatgcatttgcttgtgtgtgtgtgtgttatcgtgcatgtgtgcatccccgcatgtagggaaggtggcagagtgccgatgtgagaagccacggccggcggggaagacatgcgctgtgactgacacacacgtgtgctggagacctgctctgtggcaaggcagtgctggtgtagagcggagcccttggcccagcagagcttgctgtgtggtttcttcagtgctgccgtcgctgtgccgtctatatgtgttgtggtctttaatgtttaataattggcactgtcagaattttgtcttttaaacataccaagaaataaataaaggaagtagaagatggaaggggaagtggagggctggacaatgtctacaagtgttggggagccagggactgggtgtggcccctggcagggaggcaggccgactgcagccctgtggatgccctggggggacctgcatctggggcccccagatctaccctggggacctgagtgcgaggagttgtgtgggccacaggcaggagtggccagggtctgggaaaggactgggttttgtcctgcagtgcctgggcctcaccaatgcggccggactcggtgatctcgttgagggcccggagcaggtcgccacctagcttcttgacattcctgaggtcatcaagcatggagtaggagaggtccatcagatagtacaggtcgatggggtagcccttggcccgccggaaggtcacgttgaacgctgctgcctggcctgccggtggggacagaacaaaaggagccacacctcacatctcacacagggtgtctgggggcgtgtggccccgagcgggctgtgcactggcaccctctcctccagcccccaaatcctcctgacctcccctctccccgcctggcaggagagctgaggaccagacacaggacatccaggcaggctggagtttcagaggaaggacatgactcccggacgcaggcatgtgcctcgcagtgacactgaaacccgcctggggtgcttagagttgacgccagcgacattggggacgcctttcattgagagtggcagcggctcacctgggctcacacctaacccggccccatgcctgcagtcccacgggcgccctcatcagcagccacatagacaggcatcacacgaacctggcacttcccagcaaggcccacgcgggccgtccccaggaggcccctttctccatcccagccctggacttccgctcgcccgcgtctcagtcacacgtgcggttgtgtagctgtctgtttacctgtcaccgcaaccagcctgtgtccctggctcccagaaccgtgcctggtacaagtcagctctccataaacacacatcatgttaatgaatgagcagggagggagggtgacgaagcctgtcccctctgccccaccctccagccttcagcccccctgggcggcaggacaagtgcagagcccactccacccccaacctgcctgctgccacaccctgggagaaagggtatgtgcccctcctcacagacacacacacacgcactcctacacataaatacaccacatgcacacacagtcacacatggcatacacacccacatatatgcacacacacaatactcacacacaaatataactcatgcacacacagtcacacgtagcacacacgcacccacatatacacgcacatggcacccacacacagcaaacacaccacaaatatgcacacacaccacaaacaccaaccaccacacatgcacgcatacacacacacctcacactcatacacaacaccagacacaaagcacacatactatatgtacttgttcatatacacaaacacaccacatgcacgcacacacactcgcacacacatacacacaccaaacacacacacatgcactcacgcacatacaccacacacatgcactcacatacacatgcatgccacacacatatacacatgccacacacatgcattcacacccatacacacacgtgccacacatatacacacaccccacacaatgctaaacacatacataccacacacaccatgcatacacacacaccacacacacatgcgctcacacacacacacactcacccacattcacacccggcactcctggccctggccctcgccctgctgtgccttgcagccctcagaggcttcacttggcctctgggccaaggaccccaatcactttctatgaagggccagacagtaaatgtgtttggctttgggggccgtgcggcgtctgcagcgacatggaggaggcagccaagaccatgtccccacgagcaatgtggccatgctgcagtcaaagggcacagacataggcctttggtggctgaccaaggggccccgtcccttcccttccagagtagaggctcagcgaagggccagcaggctgcgggggtagggccaggaccccgcgagaggacagtcccttcccagatcctgccgccctgctctgggagcctgtggccctggggtgctgttaagatctctccctggtgctcacccgagtttgcctaccctcacctgcatccacccgagctcacctgtgccctcccagaggccacagcatttgccccctgcacagtggggatgcatgccaggccgtgggcagccactcccccacccttccccacggcacaaggatgcccccactcaggcgcacccccaccctccaggacgatccttcctgacacctccagcaccacagagctgcacaaactctggccacaggcaacacctctgtcagcctcagtttcctcactgtgaagtggggcgtggggaaaatacatcagagctgcctccaggggccacagggccaggccctcgagtttgaggtcagaggtggaggttccagcacgaaggggcttgtgcctgctcacggggcagcgaggggcaggcctgaccctaccaccagggtggggttttgtcccctgctgcccccagggacacctgggccctgctcctgcaggacctccccaatggctcggccccatccctcactgtctcccagctgcctccctcccggctgctgctggctgtcacctggccgcctgcaccctgggccactctgccccaaggctaactcagtggccgctgacctgggcttcccctgagggcagagctctgagccccagcctgtccgacaccagctggttcctctaaagtcaccctggccccgtctgcaccctctccctgggagatggcttccccttccttccctggcctcactgtggcctgggaggtcacaggtcggtggccacaccaggcctccttctcccatctgctgcaccaccacacctgccttcctggagcaaggagggagcttcgtttcttccctcccttccccttccctcccttccctcccttccctccctcccttccctccccttctcttcccttcctttcttttcattttgagacagaatctcgccctgtcgcccaggctaaagtgcagtggcacaatcttggctcactgcaacctctgcctcccaggttcaagtgattctcctgccgcagcaggagaatgttggccaggctggtctcgaacccccgacctcaagtgatccacccgcctcggcctcccaaagtgctgggattacaggcgtgagccaccgataaggagggcgtttctcaaagcactgacaggggactgtgttctgaaacaggtgctctggtcaagtcgaaacaggtgctctggtcaagtcagtttgggcaacactggtttaaacagttacttaggtctcttggctgcaagactgatcagagcctttactcttctaagagtaccctggccttctgagtgtgtaatggaatagtgttttgcaaatggtttggtctccctttaaaaaaaaaaggtgcagaacgtcgggctgcgagagagtgcagacactgggcaccgatggtaagggctggggcagctccacctggggacagagcggaagggcactgaggagctcagctttccagcagccttggggcttcactggcccacacacccgtccgacccggacacatgccttctgggcagccctgacaccccagagcagggccggactcccagccagagccaataaccagcacagacggtgcctggcaccaccaccgaggccaagcctacctggtcgcaggtaaagcgtcactttttgtggggacagctgcttctggcccccattgtggtcttcctgggtttcagcgaggcttgtggggtccatgatgtcgtcagccgcacagcccctcatgagcagctgtggccgggtgtcgcagcgaatggagtcaggatcccccggccctgtgaagttctggggagggggagtcaggggtcaggagggggccacactgcgggacctgcaggaggctgactggccatggaggactgaggacccaccctgtcccctcctcctctgcgcctggaatttgggacagaagtccctgtggacagagacagggagctccttcagcctcccagacagcccctccctgaaggctcccggccacagcagacccctggggggcagggtatcgcctcctcctctgcctctagcggcagaaaggactcaggacctactctccagcccgaggctgacccaagaggagaggcctcagcgtcctctagcagctggcccaggggcttcaagcccttcatcagcagaacctttgtccaagggagttgctgtgtcccaaaggaacgtggcagtccctaggcccccaagaaacccagaacatgggcagggttctgggccaagcccctcaaagtttagaagaacaaaagctggaggggagcctgggaggcctgggcccagggcgctttcctctcagccactttgtccctgcaaatcccctggattctgatgagggctgtgtttggtgggtcccgtcactggccccgagcctgctgcctctacagggaagggtgctggtgatgcggggccagaagcgcgtgtttgtgcacttgctttcgtagagggaagctcaggaggataagcccggcccccagaggctggtgagtcccgcaggcaggggggcaggtgggaggggagggcgacagtccccagggtgcctctttgtagggctctgacttttggaaccacagaattttttaaagaagtcctccagaaataaaagtacatcagcaagtatcccagcaagagagaaaagaaagcctaaatgtaatccacacagaaacaaacaaatctcactgaaaggtgtttatttcagaggagctgaaaacctccagaaaggggagggaaaaaacccagcctgaccaaggtagtttccacctggggcctggccaccctgctcagtccgaggacagacgggagccacccggcttctcctccggggactgctcgccgcggtggcgtgggctggaggacccaaagccgctccctgtgggacgcaaaattgagaaatgaggaagctgctgacggtaaggaatgagacaccacttctcctgctgccctccccttcttctccaccccctccccttctctagtttataagacaggagaaaagagagaaagcaaaaagttggaaagaaacagaagtaagataaatagccagatgaccttggcgccaccacccggccctggtggttaaactaataatattattattattattattattaacccctgaccaaaactactggtgttatctgtaaattccagacattgtatgaaaaagcattgcaaaactttctgttctgtcagctgatgcatgtaacccccagtcaagttccccacacttgctctatctatcacaaccctttcatgtggaccccttagagttgtaagcccttaaaagggctaggaatttctttttcggggagctcggctcttaagacgcaagtctgctgacactcctggccaaataaagcccttccttctttaaccgagtgtctgaggaattctgtctgcggcttgtccggctacaacggtgctggagcccagactctcagggaaaggaacccgagccgtcagaaaaccatctgattccaggctggggcaagggacatggagatgggcctgcagcatcatgttgctccagaaagcaagaaagtgctcagaacggtagaacggggatgcatggacaggacacgcagccagacccagcggatttgagcaactcggggaagaaaggacagccacagatcatgcactactgaacaaaataaaactgtgggtcacgctgatgagagagaggctgcagagaaggagagacccttccttaggttggcagccgtgagtggcaggcggggaccagcacggcaccaatctgcagccatcgcagtgatggcggcttcaggcggggacctccgcggatgctgagcctgcgggtgcgatttgatgagggcagaacctcaccagcccacagtggctgcgaggggatcatgcagcgggatggggaggccggggggatgccgtctcagcagagccgtccacgctgacctcatcaagactgggacggggccacagcagtgcctctcatgggcacttaggacaccgtcactgaggggctcctgccaaagcacacctgagtccaggcagaggaaactccagacaagacccccgagggtcatgctacaaagctgctctcctgacttcctcagaaacgcccaaggacaggaaagacaaagaaagctgaggacttgtccagattcaagaagcccaaggagacggctgagcgtagggcgagcctgggtgaggagattcagagcgttagacggctgagcgcagtgtgtgaacctgggttaggagatttggggcctgagatggctgagtgcagggtgagcctgagtgaggagattctgagcctgagacagctgagcacagggtgagcctgggtgacaaaatccaccaggaaaatatgctcacgaagacatcattgggacaaccaataaaatatgcgtagtgtgtaggtttgatgataatgagataccaatgctgaatttcctgaatttgatacatgaatttatcaaatatagatatacatgtatcaaaatacatttacatcaaagtacatttcctcttggccaccttgtccctgcaaagcccctggattctgataagggctgtgtttggtgggtcccgtcactggccccaaacctgctgactctgcaggaaagcgtgctggcgatgcggggccagaagcgcgcgtgtttctgcacttgcttacgtagttttgtaagtgaaaaccttgttcttaagaaagacctcccttgaagtactaagagacaaagggctccatgtctacaacctactcggaaatggctgagaaaaaatacaagtgtgtgttctgtgtgtgtttccaaacagaccacacatcagaacctcaggggccccttgaggggagggtgaggccagggtctggggaccccctcaaaaagaaaatggagttgttggtcctctgggtgccactggcttcaggggcaggaaagggccctcacccaggagctgggcaggtggggaggggtccaggaggcacttaccagcttctggcaccaggtgcagccgggccccgactcgatgcattcccggcagctgctgaccttgaacttcgtgcactcctgagagaggactgagggacgaggccggctggtgagtgggtgctctgggccgccctgcccacacccaagggggagtagagcaggaaggtcagaggaggcccaaaaagacagggaggcagcctccaggaggagaccccgcattcgccaccacccccaggtgcaaagaggggccctcgggaaacagcacagctacagcctcctggcacgtgcggagacgaggcctgagtccccgacctacccccagtggcaaggtccttccccagcctcccgggaacttctgtctatgggaaagtgagggcaggccctgttctccctgattggaatgtcacgcgtggagtcccctccgtggaacacagaactcaccgcacccgagggagagcagccccaccagggcgagcagtggggggcgcaggcccagcatgtcctgtggagggaaggggtcttggtgacggtctcaggcccaacccctggggctgaccacccatgaagctcccctccagctggcctgggacaaggagctggggccctgtccctgctgcagggggtgggttagggtcaggccagcacagctgcactgggcccagctgccaacagccagggagggagggatcccgggctcagcagtgcgggcagcacacctgctcagccaggcacccaggacagctgcagcgggcccctgcagaggcacacaacacaggcacacacacacatgcagacgtgtacacacaccacacatgcacgtgtacgtgcatacagatgtgtgcctgactgcatgtacacaccacgtgcatgcacacaccacacatatacatgcatcacaccacacatatgtacacacagagatgtatacaccccttacccacaccatactccccgcaagacactacacaccacacacaaatatacacatgcacacgtacacacacatacacaccacacagacacacacaccacacgcacacaccatacacacgtgcaaatgtacacgcacacaaacaccagaaccccacacacccggtgtgtgcactctgccccagtgtgccccaggtcctccgtgagcagagcctgtgcttggaggagagctgggcttggccctgtctctctgtggcagaaacatagccaggaagagaaagctggctggatgcccgcgggtgccaggctgtgtgccaggaagagaaagctggcttgatgcccgcgggtgccaagctgtgtgctaggcctgcccaggagccctgcagtccctgccaggtgggaaaaaaagtcacctgacttgcccaagccaccagttgccggggtcctgcccttttgtttccagatacacacccaccccgtccttaacccacgcatccacagccaggggcggctcagtggtcactcacaggccctcggccccagaggcaaaatgacggaagcaggcctcagcctggtgctggaggccggcagcacctcctagcgggcagcagggccgttccacccctgggttcccttccctccatccgggaggtgcccaaaccaggcctaggtcggctccttggggggtcttagggcttcctaggtggggtgggcccctgggtctgacctcccaggacctgagaacattatagctggctgggacccttttatctggcaccaagaaggtggagaggtactgagaaggggtacccaggagccttcctgtcatggtgggcaggaagacatttccgttaccctggggctgttgtcagaagcaaagatcaacacacctcctccagcaaatgccagttcctgtcacggcctcccaggctgctggggcgttcctgccccacacccttccctcgggtggtgctggcagggccacccaaggttcagtgggcagacccaagccagcagagccccaaactagggcctgccggctttgaagacagcgctgggtgctgtgctgtggcccgggaggctcgggtgccctcagccacaggccctggctcccctccatcccccgaaagccctgcacctgtgctgggggctctgaggccaacggaacacccaccaggggcccatctgaggatcccacagcttagacgccccaacaagccccaaggtcctgttgttttggcagtgacctcattccctggttcccagcaaaattataatcagaatacaaaaatgtcaaaagggaacccttgatccttcccgtcctggggtcaaaaacagaacctgcaccctgctgtaacttcctggaggaggtggttttggttcacattgggcccaccctgtgtctgaaagcccccatatctctgatcgttgggggttgtggttcaggccgaggccagttccagctctccatctgggccccctcaaagtcctgcgcctggactgacctcggtgccacgagtgcccaccagcccctcagctgatcggaggccctgtgcgtgctggagctaccccagggtgcagggtccagccagcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccaggtcgcagctgcgccaagtggggagggggtgcagacctcccctggcagccccagccaggctggtaaggactcacaccccagctccacgctctccctggggccgcagacatgaggtctccgcccctaacacagtcgtgaccagtggcatgcaaacacttcataccctcaaatggggaaactgagggccccagcagcagcaagatatggacctggtgcccagttaccccgggcactcccacctgcccacagggagagggggtgcaccttgattccagcaggattggctcagagaccacggcaccccaaccttgaccacaggaagggggctggtggggagccaccttctccccactgttgctcctccatgagcagccctggggggcttggagctgggggcacaagagaagccaggccctgccccaccccccaatgccagtggctgagcccagacaaacagctggggatgaaggtccgctccaggaggtaaggcagtgcactgagcctggcagccagcctcccttctgtgggagaacagggcagggcagcccctctgcccagcagccaggatggcccacggaggtccagggcctcacctgaggcctgagagaccaagaccccatcaggcctatctgcctcagtttcctccatgtgcctggaggtggtcgaagggcctgtgccagctccctgggggatgggaatgggtaaggcacagatgtagggcagcattcgggcaaacaggtgcctggccactgtcacctctggtgccctgaggctaagccggcagagctgcagggcaggaggggaggaagagcacagacaccccccaccccagcccctgagctggccccagagctctggcctggagcctgatcaccctgaggccctccctgctgccccacactgggggcaggtgccctcctcattctccaaggccctccctgctgccccacaccaggggcgggtgccctcctcatcctccagctctggacatcccccatctaagggcgggcgggtccccttaccaagacctaaggtgcaaaacccaaagctgaggctgcttaggaatccacagccccacaggcctctcagaaccttgcatcagagtcgcccttgacctcaaccctgcccgagaaggaagtgctggtgcaaccccagcccagctgcaggaagtggtacctgtcaccaagtcccctgcacaggggaagcagggggctgagggggcaggaccagggggacgaggtcatccttccccggagaacccctcaggggccgggcgcccttccctcccgggcaccaaatggacacagctaacaagaaccacacttcacggtgagcaaagctctgaacattcaggctctgagacacgaaagcggcgtcagaagagacctgcagcagatccgggccaaatcacacacaccctttcacagaagtcgaggacaggagaacaggagcaaacacaggaaaggaagaggccagcctggtggctgacgcctgcaatcccagtgttttgagaggccaaggcaggagaatcacttgaggccaggagtttgagagcagcctgggcaacacagtgagactcctacctctacaaaaaataaaaatagaaaataaattagccagacatggtggcatgcatctctagtcccagttactcaggaggctgaggcaggaggatcactcgcgcccaggagggagagactgcagtgaaccctaatggcactgctgaactccagcctagttgacagaacgaggccctgtctcaaaaaaaaaagaaaagaaaaagaaaggaaactttaagcaagacagcagagagagggcagagcctatgctgggagaggaatccagcggggtcaggcttcctttttatttttttgagacggagttgcgctgtcaccggcctggagtgcagtggcgcgatctcagctcactgcaagctccgcctcccaggttcatgccattctcctgcctcagcttcctgagtagctgggactacaggctcccacgaccacgcccagctaatttttttgtgtttttagtagagacgaggtttcatcgtgttgatcaggatggtctcgatctcctgacctcatgatccgcccacctcggcctcccaaagtgctgggattacaggcgtgagccaccgtgcccagtctcaggcttcctttttgcaaccccgtaaaaccctaagacgagactgcttgaggaaccagaggccccgcagacccattggaactttgcatcagagcttcctcctgcctgtgctgaaacccaccttgcgctgtcctagaggagaggcactcgcatcaaagtgactcggaggtgcgcgggaagtgatggacgatgccgccaggggacaaggttggaaggaagaggacatgggagccaacccctgcgctgggaactgaaggctcaagggatgattataaactaggcatccaccttttaagccaaaagccagagcatcaagatggactcatttctgctttgtaggaatgtgataaagaactggagagaagtgccgtcaggtggggactggaacactgtccttggatcacagaggctccaggaaatccagggacaaaaacaggtcagatcaaataggaacaagtcggagcagagaggatgcaggaaaacccagcccatgtcgcctctgaacctgcgaccctgcaaaagcgtattttcccaagggtcagggagacgtgttcctactgttggtttgactatctgtgaagtttgatagcacagttttgtttgtttgtttgtttttttgagatggagtctcactctgtcatccaggctggagtgcaatggctagatctcggctcactgcaacctccgcctcccatgttcaagaaattcttctgcctcagcctcctgagtagctgggactataggtgcacaccactaggcccagctaatttttgtatttttagtagagatggagtttcaccatattggccaggctggtctcgaactcctgacctcgtgatccgcctgcctcggcctcccaaagtgctgggattacaggcgtgagccactgcgcccggcctgatagcacaaattttaaaggccacaatttctggccaaatgaaataaaatgagacaccccacccccccgacacacacatattaataaggaatgctaaagtactctgctaaatacctgaagtcaaagggaaatcaaatgatatttacagcattttagacaaggggacaccactcctccatctaacatgaaggagactgtctgttcctgggtggcgacgtgaggccgaggccccggacactcttgctgtggacataaaagaatggccacaaatgtgtaggacttcagttttagggaataaaacaataaaggaaatagaagaataggtatctaagagtaaggaaacctcagcataaaagctaaggggaggccgggcatggtggctcatgcctgtaatcccagcactttgggaggctgaggcaggcggatcacctgaggtcaggagtttgagaccagcctgagcaacatagtgaaaccccatctctactaaaaatacataaattagctgggcttggtggcgggcgcctgtaatcccagctactcgcgaggctgaggcaggagaatcacttgagcccgggaggcagagggtgcagtgagctgagatctcacctctgcactccagcctgggcaacaagagtgaaactgtctcaaaagaaaaaaaaaaaaaaagctaagggggaaaatagcaagaagacagactctaaaaatggcacatgttgtactaacaaattgcatagaggaaatagctattatctctctagtgcaaaaggtaaatggtaatcttcatctctaaagagatcttagaaattaataacaaaaaggtaaatactccattcaaggatgtttcaagggtgtggcaccctgagcaggtaattcacaaaagaaggaagaaaactggctaagaaacatatgagtcaccccaggaaagaaccagggatttcagccaaaatatcttgattccctgtgtagccgtcaacgtgtaagatgctttggcggtttcggtgcctgcgctatggagtcccacacagcaacgaaaacatgcaaacagctgctcagggcagcttggcttcgtggtaaaagtgaatttatggggaaaaaaagagagacacagttccaaaatattctgcatttctctgggtggtggcactatgagtattttcaattttcattattcctgtttgtattttccaccctttttgtgataaatgaataaaggacattttaaaaatggaatttcatggtggccgacgaattatgctgaaattgctccttcggattccaaagctactggctttcttgttcccactgtgacgttgatgaggacgctgcttcatggcagtgggacctccctgctggcatgggcttgttgccactgtcactcacccattcacccatccatgggacaggggcttgccagcctctcctctaggcacggcgcaggggctgagagctgcactccaggactcctggactctgccctctgctgagactctcagcacctcttttccccaacacctaccccaagtttccatcacacacagaaacctccaccactcccaacaccaacatgtgtccccagcgaggctgtttacaaatcagctgggcaggaaggtgttcccctggggctaactcttctgcactctcagaccctgaatggccggagagaacacgcagcccggggtgggcaggggcctcagctcaggacagcaccagggccctctgtgcttgctcagggcctgggctccacacacatgggctcggaatcgacaaatgcaaccacctaatcaatgccccgtgtcagtgccagtttgtgccaagcagaatgggagggataattgctggcaccaggtccggcttggggtgggtatcacccacagctccataattgctaggcgcccactgcagagccccttgagttggggcttcccagcgacctggcctgtacctgctgggcaaatgcctgtgtcactgacccctgtggcagctggcattctcctccgggaacgggagccagcctccggtgacatggcctcaggcaggaccacggttctctgacacaggacacgagtgcagcaaggggggcccacacaggacctgttccatggaatcgccacaggcgtcacgctgccccatccacagaggcaaatgtcccacagccctggtacctggtggggcccggcctgggccagagtggacagacctgggcctggcaggagccctggggaagtgagttcaagttacacggttgactatagagacagctggagtgcgcacaattggccagaccacccctcctgtttcacagatggggaaactgagtcacgggggaccaaatagcctgctcaccccatgccccttccagacagggtgcagatagggcccctcccatctcctggatggccgcggcccctgtgcagaacttccttcatgggcacctcgctgtctgggggcctcttccccagggagtctcctggtggtggccgtgttgcctcaggctcactgtgcactaggcaggtcacgtcgatgccgcctgaggggcaggggttaccaccctgtggttcaggtgagaagctccaggctcaggagtgtccagctgcctgggcagtgtttggatctcatgccagcccctgccaggaggccctgcttctccagcccagcccacgcccaccaggaaatgcccctatttactcccttgaggcaaaggcccttgggtggctaagcgtcccctctcccagcactcggagctgagcgtcccctctcccagcactcggagctgagcattcccctctcccagcactcggaggcacctgcagttgctcagctgttcattgagtgctgggagtggaaactcatacgctgagcggcagtgacgctgcggagctgacaaaccccacagcccgcccggtcacctgcttcaccgagggccacagcccccccggggtcaggtggccacaggggtcctggccatgtgggacatctgttctgtggccctgctcaggatggcacccggcggggactggccctggggccgaggcatgggctcagccgccgccctgcagggacgtagccagggacctcttcccagcagagggactcccccactcatccccagaatactgaggggcacgctgggtgccaggctggcagggaccctggggattctgctgtgagctggatggggaaggagttccttcctaaaatgtggagtctggaggccactcttggtaaagtgctggcccccggggattctgcagtgagctgggcatggattctgcagtgagctgggcttcactcatggtgaaacgctggggtgacggcagacagcccagagcttctagcagctcatttctgtgaagcctccagaatccggcctcagcccccaaacccgcaggcgttgcgccaccgtcacggggaaggcgagtgacagcgagtgtcccctatgcccccacagctcgctcccaggctgagctctccggccatccccccccttccccattgcagccatgccacccctccttctccccacccaggaactgacagaggagaggggccccggatggacagggacagcagggcagaatcccagctcccagatccaggggaggggggattgggtgtggggacggtggtgcaaggggtggtgccaggggtggaggatgcatggggagggctggccccaagagtgcagtgttgggggaagggggccaggtgggcctgggacccaggggcgtggcttcaatccccctcccaccaggaccttgggaatggcctccaggagcctgttgtggggaggccagggtcaccagctgaaccaactcgaccagaatcgcacagcggtgcccgctcccctacagcaagacgtcacccaggggtccccacggaggaggcagggaagctcgagggtcccagaggagcatggagcatgtgccacaccacaccacactacattacacatgtgcaccatacatgtacatacaacagactccccacatcacatgcgcacactcgcacaccatacatgcacacacacacaccacactacgctatgccacacacgtgcaccatacatgcacaccatgccacactacacacacgacactacacaccacgaaccacaccacaccatatcacacaccacacactgcgagtcgatctggagatggaatcgctgtagccaggcggggcagcatgcagacaggagggcctaacacaggcaggcgcagcaggttcacagaggaggccccgggaacctgcctcctgcccagcccggagcaccaggaccccccagccgtccccctaggggcttgtgggcccagcctcttcctggccttgccggcctcacagccccttgtcctcccatgccggccccatcctcagccgcaagcgctcccagcacaccatgtggctctgctcttggtggcaggcacttccccttgccgggtctcaaaggggaccctggagcagacggtctggagaccccttcctgccagacacccctgggccggggctataagcagggccaccagggtcactccaggctggggcaggagagtgcttccctccaaaaatcaccgtggacatagcggggcctctgcacactcaccctcggtgtgctggagtcctcggcggtgctcctggctgggcgtgggggctttgctaccagtctgccctgggtcacgtctagaaacctcagctggaggcgcgggtcgtaaagtcctgacacttcctgttcctctcagctcctccttggaggaagtggtgggttgcaccaccgtggcccttcacccctgcccctctccgctctacagcagctctgatgtcagagagcggccc

SEQ ID NO: 2550 - DNA, 42885 bp, Homo sapiens
  source 1..42885: mol_type = genomic DNA
ttccatggacagcctgtattgaagttttattttttttctatacacgtgattgattaacaatataattaatgggatgtcattttataccctgacaagtttaaatgtaaataaattggcaccacctttaatcagactgatgtcctgacttgcacaggaaacacgcacctaacctcaccaacctcaagccctccctcctcaagtctccatgcaaagactgtgccagtcagagtggagctgtccccccgacgagcccccagaagcacccggccggccatggctgtcattttgagggcggaaaataactggatttctggttaattggtgacatcctcaagagctgtggcaagccatgtctcggccgcgtgatggggcagacatggtgggtcctgacggccttgtcttcaccaagtgctcctaactctcagcaaacttggggttcatgaccgtcgtggtggcgctcttgaaaaggggattatcctggtgggaaatgcaaacaggggcttgtgagtgtgggaggttttcagagcagaatctttctccctgaggacactccccgcatggaagccgtcactttgaggaagagctagacgtggggcagcccccccagggtcccagcaccggcagccaagctcacccacagcggcggacgcccagaggacaagctgcctggggaggccggggtgcagccacacacgggtgtccacggcctcccgcagcaggaggtcgcatagtgtgggacgcacgtgcccctctgcgtgggacccccaaggacggccacttacattgttccactgggacttgagcttctccttctcaaagcgcctgtactcccggaggtcgctcaggtggatcagagccttccagatgaccagcaggagaatgccgatcagcacgatgcctgccacggtgcccccgacgatggcggcgatgttggggcctgccacacactctagggaagaagcagcacacctgagcgtcagtccagccccatctcactgagccgtgtgcccacaggtccgaggtcaccccacaacacagcacttagagagacggaggttcccagggccccggctcaccatccatcaccatggccaggggtcagtgagaacctggcccagcccctgctggattccaggccaggccctgtggttccaaatgaaacctaagggccattgccaccacccctgctgacagagaagaaggcagggccagggtaccgggcagccaggacagagtgctaatactggggggtaggacacagtgcgagggaccccgctctcctacagcagagttcagaaccaggctcagggtccctgctggagttcactccccatactgtgaaagtgatttgtggtcgtcaaggacaagaccagagaccagagctcagcaggtgaggccggtgccaggatgagcaacgcaaggtcctggttcccacggcagctgtgcccacctcctgagcatggggactgtgggccatagtgggccaggcccacagctgctgaccctgggacagacactagcgttcagtgcagtccctggcctggtctggcatcctcactccctgtacccctcctgccatcctgacctgcaccctcactccctgtggttgctcctgccatcctgatctgcaccctcactccctgtgccccctcctgccatcctgacctgcactctcactccccgtgccccctcctgccatcctgcctttcctgggggacctgccttccttcacctgtcctcaaaggtgaagtgacttggccaggattgcacaaaccagacgtgacccaagtctgtccctcaaagtggcccgcaggggttcctgccctggcaggtgggggtctgcagccccaggcccacatgtgggttgtgagctccaggcatgtcacctacaggctcagagacccccgccgcctgcctcgggtcccttcctggtgagggaggagctcccaggtctcagttctgcaagagtcctggccggctgctggccatgcctgatggagtccgccagcggccccccagccccagcccctctgcctctcaggagcctgtggaacatgagacctgaagaagcagggccagtgtcaccaaggtcaccgtggggctgggcctggttccaactggagctgaatgagacagggtcagtgccaccaaggtcactgtggggctgggactggttccgactggagccgaatgagacagggtcagtgccaccaaggtcactgtggggctgggactggttccgactggactggagccgaacgagtgatggggacggtggtgcctggtggccctgggcccctccagggctgagagccgagcaccaggatctcccaatcccctcaaaggagcctcacgcagcaacctgaccgcgggccacccctggggacctgcaactgcaagccttgccccatgaggcatccagcgggagatggcccgggccgtgtggcatgctggtgggcctgcccggtgtggagcagtggtgcccccagggagcaggccgtctgctgcccagcttgatgtggggtcaggtgaggaggggagggaaaggggaggctgctgggggtgaggggaccggcctctggcctccttgcaatgccaagggcatcccgcatggctcatccaccctgctgggcccacaacactggaggtgagatcctccttccgcaccaccctcgcctctgcggagaccccgcagccggagctctggagccggtccccgctgcaccccagcggcctcacctcggctctcatccacatagatgaggtagcggtccatcccgtcctgctgctccagcgtgtaggccacccagcagccctctgagtccctctccttgcaggtcctgcccttcacggggttgttcgacagctgcaggcccggacacgccgcgctgcagttcttcccaaaggggcccttttcgaacttcaggcactcggcgcaggagctgcggggagccaggtgtgagcatcggtgccagggtgtgcgggggctccggcaacgggggctcgggcttgggtgtgtgtccaccagggggggcaggtggggttggggcgccctcaggccaaggagggggcccaagtggggcagatgcgggtgcagcgggtgaactggaagcctgatcccagggcccgcggcaggtgcgcacaggagggaggagggacacaggggcacggcggccgcggagggcccctcagtccagacgcacccgcagagaaccccgcggtgcagaggtgctcactggggtccccgagtgagcccggctgctgggtaggtggccggggagtggggatccctgcccgccctgcctgctccgcctgcactcacatgtacttgccacagggtgaggggcagccggggcactcctggcacagaggcagctggtagcctgaatggcactcgcatacgttgcagcggcaccggccacgaccactacactcaacacgccgcgggttcaggcagccctcagtggtcctctcgcactggcacgctgagccctcaaagcccgggtggcagcggcacttcccgcagaagcagagccccctccctggaagacggggcagcacggctaagctcctgcttggcctgggaaccgagacccgcccgaaaccccactgcggttgctccctccggcccgcctgcctcctccagcctgggggatgttcctgagcaaaaggcatggggccactagccaggcccttctgcccccgccagccacgtggccgcctcctggccagtctggacctcccctgccctgctgtgaatgggacctcaatagggctatgaccgttcctcctgtgggccctccccacaaggacgccttgtcctcatggacacagaaactgaggcagggcggggtgcagggccatccaagttcctgctgacgcccggtggctgggcgagacttgcactgtctgtcctcaggatcccccctttctgttccactcgttgaatggtccagaacgcaccccccaacaccaagtctgtgccgcaggacggccgttgtccagcagggacccacgggctcacccgggccgccgcagacctggccgttgtagcgctcacagttgatggtgtcacactcgcagtactgcccgtatatcagcttgccggggacgtcgctggtgtggcacaggcactgcccgcagacacagtcccccagccctgagcagatgatggagttgttgtccttccggcagcttccttccagctcctggctgctccggccctgtgtctggcactcacagtttttcccaatgtagccagtgtcacacctggggacaggaggggccccaaggtcaggctccccccagtgatgtgggacaagggacagccgccctgtcctccaggccccttgcccttggtggagaacacccctatggcacattttgctttcctcgaggcctactgagcacttgccacggactaaatgtgctcaaaacgtgcaggggccccgcgttccctccccaggatgtcccgaggggaaagcagacacctggccttggcctgcgcatgcagtggctcggcaggctcactgtggagctgtgttgcagccatgcacatggcctgtgctgcgataccggtgctctgtgagtggctggtgtctgctcctgcgtgccccacatggtggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccctacagtcccgtgaagaggccgccccagggctgcacacccaggacagtgggcggggtggccactgaggcacgaggacagcaacagagaccaccaagaccacagagaccatcattgtcctgagatatgggaggaggctgggggcagcagggacctgaaggtgaggaagggcactgccaccaggacgtggattggcactgcggtcaggacaggggaggaggtgaccagagcaaagggggcagagtcctgggaggtcagcctagcagctctggccaggcaagcaaggaaagggggacagccatccagcccccgggcaggccgcctggctgagtgccatgtgaacctccccactgggtccacctgtcccccacttctccctgaggtggggtgcccacgcctggcagggggtgtgcacgcccaagaggtggcctatggggcccaggctcccagaagccatcacctgtcccaggaggctctctagccacccatgccccagggctgccagcctgatggccttgggtccccaaggtcagagagaagccagctcctagggtcaaggaaggtcgggcagagaaagtgacccactcaaggccatgggcacgcccagcggggactccttgtgcccctgagatgggcctccatcctctggtgagggggtcctcctgcccacaagtcccctgccttgggtcctccatggccagagagtgtagagtacaggctggcattgctggtgccctggctcaggagcacgggtgagggcttgccgaggggttctgggttccaatcccaaatctccccacctcctgcagaagggggcccccaggatgcctgctccgtggggtgggggaagggatggagccacctgcacccacctcacctgccgacacctgccctgtggggtggggctcggggatggttcaacagggacctgcgcccgcctcacctgcagatgccgcactccaagaagcccttgccatggcagaggctgcggtctctgctctggtcccggcaccggcactcacactggggaagaacctgcacggtcactatgtccgtgaagcccagcgcccggatgacaaacgactgctcctggatgcactctgtggccgtgaccttcacctggaaggtgatctgcagggcagtgctgggctcaggtggggaccctcggtggccagggtggcagcccagctcccaaccctcacctcctggcctctgcaggggtcctggggggttcagcgtggggaggaaggggtgaccaggagcaggaagagctgatgctcagatccgagagccaaagtcagccggcaaggaggtgctctgcccgcactcccgcactggccggcaccaggatctccccggccacacatcagcagagacatgtgacacgcagacagcaaatcaggagaagctgagcacactcccactcagaccacccaacatgagggaaacgttctggtgagaatccatgggacagctgggcgccgcggctcacgcctgtaatcccagcactgtgggaggccgaggcgggtagatcatctgagggcaagagtttgagaccagcctggccaacatggcgaaactctgtctctactaaaaatacaaaaattagccgagcgtggtggcacacgcctgtagtcccagctactcaggaggctgagtcaggagaatcacttggattgtagtgagccaagatcgcaccagtgcactccagcctgggcgacagagcgaaactccatctcaaaaaaaaaaaaaaaaaaaaaaatccacaggcaacatttaccaagaaacatgtttgaaggaattccaaagtcatattaagaaaatgcaatgaaagcaagtgtcttgctgaatattatttcacagctagcaaaaaaaaaaacaaaaaacaaaaaacaaaaagaaacaacaaatgattggataataaacttaaacctgaaagattagagaaggaactcagtgtccattcctaaccacctgtgtggcccatgccttaatgtttctgtcaaaaaaacagaatgaaacacgcagaaaatcatgacaactaaccctacccaggtttgccgtttgcgcctgttctgtgtgtccggcgtctgcccccagggggcgcagccatcactccatccctcagtctgcagtggcctgacccagggatttgggctccaggttgatgagtaggactcttgggggccaaggcgtgtgtgaagaaccctcccagcaccctctcactgagaagcaccctctcggcaccctctcactgacgttcctgacatcagcttcacaaggaaagcgtctggcctcggcagagaggatgtgaaggaaagaaacagggtccttccagtggatgctgcctgctcccagacagcctctgatgcctgtgtgcccctccctgcccccgtcagagtgctgggatggggaccctggctccttctggctgtccccaggacccctcagtgtgctgggatggggaccctggctccttctggctgtccccagagcccctcagcaagctgggatggggacccttgtggccaggctcaccgggacattgatctgcacgccatcacagtcacctctgggctggttcctgtgcgtcactccattgctgcagaaggagtcgtaggtgactttcagggtgtcggggagggcgttgtgatccaggaagaccctggaggagagtttctgcgggcagagagcggttactcttgggggcgagtgtttctgttgtcctggccctgcctggcccagcggtttagacccgtctccacttctcctctcagtgcaagtccccagtgtcagctaatgacacagaggagagcacagcaggatgtgctgaggatggcagggctgccagggccacagtcctgccctcgagacagcctgaccacagggactagcatggagccagggtgtgagcctcaggggtgggagcttctgctgctcctcagccttgagtccccaggacctagcacagggcaggagctgcataaattgttcaagcgataagagagatggggagaaacagagagaggcagagacagacagagatgggcagagccagagccagagacagagagatggagagaaacagagagaggcagagacagagacagacagagatggggcagagacagagagagacagacagagagagacagagaaagagagacaaagactgagagacagacggaaattgagaggaggcagagggacaggttcataggggcatcgggtgaatggccagggcagtggcgtcacctgcatcctctgtgtaaggacagaaacacctcgggcagtggctggcacccaggagggtctgctctgggggtttggggctcacgggaggctacgagaagcaaatggcacctcctccacgggccttcagtttaattcaatgacccaacgtttgtcggaggcgctaacgtgctgagctccctcaagccagcaggacctttggcctagaaggatccaggccagaattctgagaacatctctcacctgggggtagatttccagagcagtcgggacctctggtgcctggggccctgaatggcacctagtgcgcacctatgcctacctatgcccaccagggccatgggctccccaggggagcagcccagggtgcagctcgatgggccgtgcaccagggagaaattcaggggttaagggcttctctggagcttgcccaggacaggtgaacagagcaagaggaattccaccccccagggtgtcttcccagggcccaagtccactgtgggggtttcctgtggcctcctcctgccccagctgcactgtttgccaccagagctgtccacctcccttctccatagagacccgcagagaagagtctggaatgaagagtccggagctcaggtttcagggagcatcgcccacaacatcaacgagagaggacccagagctccccgtggaagtgccgggccagggtgtcctggaggcctgagggcaggtcgggaggctgcagctggcccacggggcaggggctttcctcccagaccaccctcctgctgacctgcagcaggagctgacctgcagtggggagattgctggccaccccatgggtcccagctgagtggtgcgggagactcacattgtaagcattcttaatgagttggaccacattgctggagtcctcagacagctcccccacggctgacttggggatgatctcggtgagtttctgttgggcaagaagaccagacatggcacggctaggacctgtgccacggcatctccacgcactgggctcaccccaggggcttctgcacctgcaaaatggctgggacggtcctcaacgcagttttgcacttggtccccagagtgtgtggtcagtgatgtgtggtaagaggttcttgggggtaaaaagccctgagctgcccaggggccacgcctggaataccagtactcgggaggccgatgtgggaagattgcctgagcccaggagttcaggaccagcctgggcaacataagaagaccccatctctacaaaaagtacaaatattagagtggtgtggcgtcacatgcctgtagtaccagatactcgggaggctgaggcaggaggatcacttaaacccaggaggtggaggttgcagtgagctgagatcgcaccactgcactccagcctgggcgacagagcaagaccttgtctcaaaaaaacaaaacaaaacaaaaaaaacccaggccaggcatgatggctcacgcctgtgatcccagcactttgggaggccaaagtgggtggatcactgaggtcaggagtttgagaccagcctggccaacatggtgaaaccccgtctctactaaaaatacaaaaattagctgggcgtggtggtgggcacctgtaagcccagctactcaggagactgaggcaggagaacccaggaggcggaggtcgcaatgagctgagatcacaccatggcactccagcctgggcaacaagagcaaaactctgtctcaataaaataaaatgaaatgaaatgaaatgaaatgaaatgaaataaaaaaataaataaaataaaataaaataaataaaaaataaaaaaaaaattactgttgcatcatgaggataagaaaagaaagcaaagccctgagctgcagcattgtccaggcctgcccgtgtgagtcctcctgcctgcggtgtgagtgatcccgcctgcggtgtgagtgctcccgcctgcggtgtgagtgatcccgcctgcagtgtgagtgatcctgcctgcggtgtgactgctcccgcctgtggtgtgagtactcctgcctgtggtgtgagtgatcctgcctggtggatttcaagctcgcaatatcactgggttgggaggacgtgcatggtggccagtgttggccagaatttccaccacacaggtagggaattcctaccaccacacagatggtaggcggaagtagccccacgagggtggatcacagtaaaatcaccaggaagccatcggctcttggcactctactgagtttccatgggtgttaaacagcccggtgacatcggttctggccggccagatgcacaggggcgcagccagcctcccccatgctcacacatgctcagcttctttcatggaagattgcggcatcatttcaccttccaggaacacggagcagatggtcgggtcacctccccgcccaaaccctcccatgactgccctgcatgggcccagtcccttccatggagctcctggggccggtcacagcctggccaccaccctcctctgcgccctccgcccaccgcccacttccatccgtcccagtctggggccatccctgtcttgggagagctgggccctcccacatcctgtcctgctgagcctgctgtgcgcttggtgcagaaacacactcggagggggcgtggcacgtgtgtccacactcgctgcctgttgccttgaccacccccgaaggtgaccaggaaaggctgaggaaggcttgtgtgccccaaggctcagcagtaggcatggggtgcactctacctgcctccagtgcctggccctggtgccacaccatcgcctggagtctggctgccatgacaaatggcaaaggattgggacctgctactgctggtgaggaggggaccgtcatggccacctacagatgggacacagggctgtgacatcctgaccagcaggtggtctctgtggatgtccggccccagccctgccctgcgctgacccactgtcccggcagcctgaccagctctgggtgcccactcggagggtcccccagacacctgcccccatcccgtgtctcccgcagggtcctgctcccactccagagcccggggaacctatggcaggaaccgctggtctcgctgtcggccccaacacaccacgaggttgagcttgtagctgggatacgggcctgacaatggatccctgtagttcagcaaatgttcactttacaaaagcagcggccctcccgggcactttccttccccaaaccccgagtatgtctcctcagcctaagcagcagggcaggggctgtgaggctgcccagctgggcagagccccaggcagggggaagagggggccctggtttcctgcgtgccattttgaagaagatggcggtgatggccctggaatggccagcaggtcggtcactgtccggatgaggataatcgggccctttagggcggctgctctgtgaattccctgagtgggtgagctcagtacccacgacgcactgcccgccgggcaccactacccctttcacagatgaggaaactgagggctcggggtaaggaagggcctggggcgtcctgtggtaagtaacagagctgggtgtgaggtgagccacccagggccctgtccaccctgaagaacggggcacgtggctgtgtaaagtacaatgacaactatctcgttcctccagctccaccctgaagaacggggcacgtggctgtgtaaagtacaatgacaaccacctccttcctccagctcagtccttctgtccctgtggcctcagggccacacactgtgcaggctgctatgggcggaggctcctttcaggagggcgtgcagtgtttccttccttctagcgaatccctgttacacagtcagggctccacccagcaggcctggctggccacaccccacacatgccaaagagtggtagaccccggctgagctcctgagaggtagcctctgagcccttggtacatcctacccgatgggggtgtcattgttcctggggcctcaggtcacaccggatagtcccacagtgtgatttggggtggggccctggacagttttcagcttgacctctggagggctagagactgaggtcagccatggggtgtcagccgcgccgctgtgactgacccccagtagacaccgaggctcaagagcctccttggggaccatgttctgtgcatgaggccacacatcatcgctgggaggatggagcgccgcccacacccctgcagggaggggacactgggagctggtgcctggtttctctcctgtgcacctttgacctttgctgacttttgtctgtatcctcccacctcgggcagcggctggcacccaggagggtcggctctgcaataaactgtaactgtgagtttactggttcctgagctctgcaagtccttccggcaaatcactgatcctgagaaaggtcttgggaaccccaacagcacctgagcgtcttgacgcactgacctgctcaggctgaacacatggcactagcagcggaaatgcaggatgaacgtgtttcactgggggcctctttttctaggagcagaggctggttatcagctgtgcttccttcgtgaaattcatcccactccgcactccaagcttgtgaacgtttttgtgtaattttatcttcacggagagtgttgatgttcaaatgtatgtgagcataaaataagtgtgtttccataaaataaagaattgtgttgtattccaggaaaaaacagaaatatcaccaatgccaagacatgctgttaacacagctgagtttcagggacggggaggaattcctcctcctatcgacacgcaggcgtcctgtccccgacgggaagcctcgggctcctcacctagggggatccaggacctgggccggctggttgctcacgtgcccagcatgcagaggtggcgctcagacctgcagtggcgctgggtctggcctgtggctgaaacatgcccccacccaatggatgctcgggacccaacagcactcacctcgtaggtcttcaccatcctactggtcaccgcgaagatgggctggatgttgttttcagccagcttgtgcgccagctggcccaccgatgggtagtcctggagagaggaggtcctgctcagttggccccgagtccaggacaaggcttccaggtacccgcccctgtctgccccgctcagcgtcagccctgcccgtgcttcgaaccctctctggggaaggctggagaggcagaggctgccacgcaggagtgcagggcagagagctgccacgccctctgggcaatgtgtgcatagactcgggctttcagagtccaggcatgagcagcatttgaggcgtctcaccgtgggactggggatgtccacgggggcagaatcccagccttccccacacggtggacctgctttcgcactgagggacactcagtttcggtagaggccatgagtgtcaggtgcggctctccctacccgagttccgggacccgagggccgtccctcccgtctgtggctcccggcggaggacctgagtcttgtatctctaaagtcctttgcggcccccagagcctacaacgtcaggctgcaagagcgtcgcactacggccagcgaggacaagccccttgtgaccagtggttgcctctcggcccacggctgatcccagccagaagtcctggcccctctgagccattgagatgcctccgcagagaggctcatcctaacccgtgcatcctgggctccttctcgcctctgtccctccctgcatgttcctcatggtccccgcagccgctcacccagctcaggcaatgggggcagggaggggccacactggaggaggcggactcaggggcagcagggaacgtacagtggaggccgggagggggaggaggcggatgcttggggatgggaccctggccagaggcggggacggcagggtgcagccgtagcctgggggcggttactatacctccacagcagctgtcagcccaggtaggggggcagtggggctggagaccaacagagcctgggtgtcccacaagggcgaggccgggcctcagcctggctgcccccaccaaccctaccctcccctggcctgaggccagtccggggagaccccacgctgccacttggggcttccagaagtttcctcaggaatctgctccttgggtcagaaggaggctctgtcaggtggagaccccacccttgtctcctccgtcagtggtgtcctgccaggcggtgcctgggtgcctggggtggggacttacgaattcgttgctcctcttgtacaagttgtcctccaggtgacagcggccgtcgttgggggtcaggatggcgcccagcttcccgtcgcccgcgaaatggaagccgtcatcagtggcaaacaccagcagccgcgtgacgttgcgccagccgatttcctcctgagaagaaggcgtggggggcagggttacctgcctcagtttcccagacccggccctctggagcagaggagacgatgcagagctggtggggtggcccggaggctggtgtgggtccccctttcccctgggtctcagggacccagctgtgttcccccagacgccacgcccaggaggagacaacggccctcaaacaccccgtgcacatgtgaggcgcagggagtggaggcacgtgtggaaaggcaaggagagagacacggctgcggtccctgcacttcagagctgggaacaaaccctcaggaaaccatccccaaggggaaaaaccctcgcagacgtgtgggccacacgcagaacgagtgcaacatggaggaaaacgagcctgaggggcccagcaggccttgagtccaccattgacagcccctggcaggcgcatgtgggggccgtgcgtgtcctaggctgtgacctcacactcgtgagcagtgtgtctgcgctgggactgcagggaagcaggagagctaaggtgggttgtgaggggaggacagtgcatgtggcctcaacatggcccagggactgtggctgctctgttaggctgacagtcacaaactgggtgggcgggacgtggagagcgacacacactgggcagccagcgcccacccggcctggagggaggagggtggttccaccccaggaaccacgggacctgctgcctagcggccctgttccacccttggccgctcgcaaaatgtttaggcttcataaggtttgcccagggtcacaaatttaactcacagcaaacaatgaaatcagcgcatgattttcgagccctcgtggtcaccctcccttcctcctgccctttcctgcatgggcagcagcagggtgaggagctgctctccccaggcccaggctggagtccctcagacgacctgccggccagggtacccccctgcccccacacagcgcctgacagagccccccacactgggggaacgtggggacccaagcaggggcagcggcctcaccgggcaggcggcgacctgcatcatggcgtccagcccaccctcgggtgcatccaggtttccggaaatcagctgcttcccgacctcggtctgaaactggttggagttgttggtcagcttcagcacgtgcctgaaggcaaacgggggctggcactctttctccttgttggggcatgggtttcgcagcttatcagggtgcgtgttcacgaacggcagcacggtcttgtccacgaaggacccgaagcctgcagggcacatggaggggctggggaggtggcaggctgggcccaggtgggagggccagcttcaaaggggcacgagggcaagcctgtttcctctctcctagcagggaggtggagaaagcaagatggcacatgtggagtgtgtgtgtgagcatgtgcgttgtgcaagcacacatgtgaacgtatgtgggcgtgtgtgtgaacctgggagtgtgcaatgtacatggatgagcataagtgtatgcatgtgtgttcctgcatgtatgtgtgtgaccaggtatacatgtgggcatgtgaacaggtgcgtatgtgtatctgtgtgtgcagccatctgcatgtgtaaacatgagtgtgtacatgcgtagcacaactgtgtgtgcacgtattcctgtatgcatgtgagcatgttcaggtatggacacacctagttcacgtaggtgaccaggtacatatgtgggcatgtgtgtttatgtacgatttatacatgtgagtgaagacatacatgggtgatcatgagtgtgcatgtgagcatgtctgtgtgcacatgtggtcttgcacgtgtgtatgactgtgtgtgcatgtgtgtgcacatgcaagtgtgagcatgcattcatgtgtgtgagcatgcatttgtgtgtgagcgtgcattcacgtgtgtgagcgtgcatttgtgcatgtgagcatacattcgcgtgtgtgagcatgcatttgcgtgtgagcatacattcatgtgtgagcatacattcacatgtgagagcatgcatttgtgtgtttgagcatgtgtgtgagcatacattcacgtgtgtgagcatgcattcacgtgtgtgtgcatttgagtttgggtgtgcttttgtgtgtgagcatgcattcgcgtgtgtgagcatccatttgtgcatgtgaggatacattcatgtgtgagtgtgcattcgcatgtgtgagcgtgcatttgcgtttgagcatgcatttgtgtgtgagtgtgcattgcatgtgtgaacatgcatttgtgtgtgagcgtgcattcacgtgcatgagcgtgcatttgtgtgtgagcgtgcatttgtgtgagcatgcatttgcttgtgtgtgtgtgtgttatcgtgcatgtgtgcatccccgcatgtagggaaggtggcagagtgccgatgtgagaagccacggccggcggggaagacatgcgctgtgactgacacacacgtgtgctggagacctgctctgtggcaaggcagtgctggtgtagagcggagcccttggcccagcagagcttgctgtgtggtttcttcagtgctgccgtcgctgtgccgtctatatgtgttgtggtctttaatgtttaataattggcactgtcagaattttgtcttttaaacataccaagaaataaataaaggaagtagaagatggaaggggaagtggagggctggacaatgtctacaagtgttggggagccagggactgggtgtggcccctggcagggaggcaggccgactgcagccctgtggatgccctggggggacctgcatctggggcccccagatctaccctggggacctgagtgcgaggagttgtgtgggccacaggcaggagtggccagggtctgggaaaggactgggttttgtcctgcagtgcctgggcctcaccaatgcggccggactcggtgatctcgttgagggcccggagcaggtcgccacctagcttcttgacattcctgaggtcatcaagcatggagtaggagaggtccatcagatagtacaggtcgatggggtagcccttggcccgccggaaggtcacgttgaacgctgctgcctggcctgccggtggggacagaacaaaaggagccacacctcacatctcacacagggtgtctgggggcgtgtggccccgagcgggctgtgcactggcaccctctcctccagcccccaaatcctcctgacctcccctctccccgcctggcaggagagctgaggaccagacacaggacatccaggcaggctggagtttcagaggaaggacatgactcccggacgcaggcatgtgcctcgcagtgacactgaaacccgcctggggtgcttagagttgacgccagcgacattggggacgcctttcattgagagtggcagcggctcacctgggctcacacctaacccggccccatgcctgcagtcccacgggcgccctcatcagcagccacatagacaggcatcacacgaacctggcacttcccagcaaggcccacgcgggccgtccccaggaggcccctttctccatcccagccctggacttccgctcgcccgcgtctcagtcacacgtgcggttgtgtagctgtctgtttacctgtcaccgcaaccagcctgtgtccctggctcccagaaccgtgcctggtacaagtcagctctccataaacacacatcatgttaatgaatgagcagggagggagggtgacgaagcctgtcccctctgccccaccctccagccttcagcccccctgggcggcaggacaagtgcagagcccactccacccccaacctgcctgctgccacaccctgggagaaagggtatgtgcccctcctcacagacacacacacacgcactcctacacataaatacaccacatgcacacacagtcacacatggcatacacacccacatatatgcacacacacaatactcacacacaaatataactcatgcacacacagtcacacgtagcacacacgcacccacatatacacgcacatggcacccacacacagcaaacacaccacaaatatgcacacacaccacaaacaccaaccaccacacatgcacgcatacacacacacctcacactcatacacaacaccagacacaaagcacacatactatatgtacttgttcatatacacaaacacaccacatgcacgcacacacactcgcacacacatacacacaccaaacacacacacatgcactcacgcacatacaccacacacatgcactcacatacacatgcatgccacacacatatacacatgccacacacatgcattcacacccatacacacacgtgccacacatatacacacaccccacacaatgctaaacacatacataccacacacaccatgcatacacacacaccacacacacatgcgctcacacacacacacactcacccacattcacacccggcactcctggccctggccctcgccctgctgtgccttgcagccctcagaggcttcacttggcctctgggccaaggaccccaatcactttctatgaagggccagacagtaaatgtgtttggctttgggggccgtgcggcgtctgcagcgacatggaggaggcagccaagaccatgtccccacgagcaatgtggccatgctgcagtcaaagggcacagacataggcctttggtggctgaccaaggggccccgtcccttcccttccagagtagaggctcagcgaagggccagcaggctgcgggggtagggccaggaccccgcgagaggacagtcccttcccagatcctgccgccctgctctgggagcctgtggccctggggtgctgttaagatctctccctggtgctcacccgagtttgcctaccctcacctgcatccacccgagctcacctgtgccctcccagaggccacagcatttgccccctgcacagtggggatgcatgccaggccgtgggcagccactcccccacccttccccacggcacaaggatgcccccactcaggcgcacccccaccctccaggacgatccttcctgacacctccagcaccacagagctgcacaaactctggccacaggcaacacctctgtcagcctcagtttcctcactgtgaagtggggcgtggggaaaatacatcagagctgcctccaggggccacagggccaggccctcgagtttgaggtcagaggtggaggttccagcacgaaggggcttgtgcctgctcacggggcagcgaggggcaggcctgaccctaccaccagggtggggttttgtcccctgctgcccccagggacacctgggccctgctcctgcaggacctccccaatggctcggccccatccctcactgtctcccagctgcctccctcccggctgctgctggctgtcacctggccgcctgcaccctgggccactctgccccaaggctaactcagtggccgctgacctgggcttcccctgagggcagagctctgagccccagcctgtccgacaccagctggttcctctaaagtcaccctggccccgtctgcaccctctccctgggagatggcttccccttccttccctggcctcactgtggcctgggaggtcacaggtcggtggccacaccaggcctccttctcccatctgctgcaccaccacacctgccttcctggagcaaggagggagcttcgtttcttccctcccttccccttccctcccttccctcccttccctccctcccttccctccccttctcttcccttcctttcttttcattttgagacagaatctcgccctgtcgcccaggctaaagtgcagtggcacaatcttggctcactgcaacctctgcctcccaggttcaagtgattctcctgccgcagcaggagaatgttggccaggctggtctcgaacccccgacctcaagtgatccacccgcctcggcctcccaaagtgctgggattacaggcgtgagccaccgataaggagggcgtttctcaaagcactgacaggggactgtgttctgaaacaggtgctctggtcaagtcgaaacaggtgctctggtcaagtcagtttgggcaacactggtttaaacagttacttaggtctcttggctgcaagactgatcagagcctttactcttctaagagtaccctggccttctgagtgtgtaatggaatagtgttttgcaaatggtttggtctccctttaaaaaaaaaaggtgcagaacgtcgggctgcgagagagtgcagacactgggcaccgatggtaagggctggggcagctccacctggggacagagcggaagggcactgaggagctcagctttccagcagccttggggcttcactggcccacacacccgtccgacccggacacatgccttctgggcagccctgacaccccagagcagggccggactcccagccagagccaataaccagcacagacggtgcctggcaccaccaccgaggccaagcctacctggtcgcaggtaaagcgtcactttttgtggggacagctgcttctggcccccattgtggtcttcctgggtttcagcgaggcttgtggggtccatgatgtcgtcagccgcacagcccctcatgagcagctgtggccgggtgtcgcagcgaatggagtcaggatcccccggccctgtgaagttctggggagggggagtcaggggtcaggagggggccacactgcgggacctgcaggaggctgactggccatggaggactgaggacccaccctgtcccctcctcctctgcgcctggaatttgggacagaagtccctgtggacagagacagggagctccttcagcctcccagacagcccctccctgaaggctcccggccacagcagacccctggggggcagggtatcgcctcctcctctgcctctagcggcagaaaggactcaggacctactctccagcccgaggctgacccaagaggagaggcctcagcgtcctctagcagctggcccaggggcttcaagcccttcatcagcagaacctttgtccaagggagttgctgtgtcccaaaggaacgtggcagtccctaggcccccaagaaacccagaacatgggcagggttctgggccaagcccctcaaagtttagaagaacaaaagctggaggggagcctgggaggcctgggcccagggcgctttcctctcagccactttgtccctgcaaatcccctggattctgatgagggctgtgtttggtgggtcccgtcactggccccgagcctgctgcctctacagggaagggtgctggtgatgcggggccagaagcgcgtgtttgtgcacttgctttcgtagagggaagctcaggaggataagcccggcccccagaggctggtgagtcccgcaggcaggggggcaggtgggaggggagggcgacagtccccagggtgcctctttgtagggctctgacttttggaaccacagaattttttaaagaagtcctccagaaataaaagtacatcagcaagtatcccagcaagagagaaaagaaagcctaaatgtaatccacacagaaacaaacaaatctcactgaaaggtgtttatttcagaggagctgaaaacctccagaaaggggagggaaaaaacccagcctgaccaaggtagtttccacctggggcctggccaccctgctcagtccgaggacagacgggagccacccggcttctcctccggggactgctcgccgcggtggcgtgggctggaggacccaaagccgctccctgtgggacgcaaaattgagaaatgaggaagctgctgacggtaaggaatgagacaccacttctcctgctgccctccccttcttctccaccccctccccttctctagtttataagacaggagaaaagagagaaagcaaaaagttggaaagaaacagaagtaagataaatagccagatgaccttggcgccaccacccggccctggtggttaaactaataatattattattattattattattaacccctgaccaaaactactggtgttatctgtaaattccagacattgtatgaaaaagcattgcaaaactttctgttctgtcagctgatgcatgtaacccccagtcaagttccccacacttgctctatctatcacaaccctttcatgtggaccccttagagttgtaagcccttaaaagggctaggaatttctttttcggggagctcggctcttaagacgcaagtctgctgacactcctggccaaataaagcccttccttctttaaccgagtgtctgaggaattctgtctgcggcttgtccggctacaacggtgctggagcccagactctcagggaaaggaacccgagccgtcagaaaaccatctgattccaggctggggcaagggacatggagatgggcctgcagcatcatgttgctccagaaagcaagaaagtgctcagaacggtagaacggggatgcatggacaggacacgcagccagacccagcggatttgagcaactcggggaagaaaggacagccacagatcatgcactactgaacaaaataaaactgtgggtcacgctgatgagagagaggctgcagagaaggagagacccttccttaggttggcagccgtgagtggcaggcggggaccagcacggcaccaatctgcagccatcgcagtgatggcggcttcaggcggggacctccgcggatgctgagcctgcgggtgcgatttgatgagggcagaacctcaccagcccacagtggctgcgaggggatcatgcagcgggatggggaggccggggggatgccgtctcagcagagccgtccacgctgacctcatcaagactgggacggggccacagcagtgcctctcatgggcacttaggacaccgtcactgaggggctcctgccaaagcacacctgagtccaggcagaggaaactccagacaagacccccgagggtcatgctacaaagctgctctcctgacttcctcagaaacgcccaaggacaggaaagacaaagaaagctgaggacttgtccagattcaagaagcccaaggagacggctgagcgtagggcgagcctgggtgaggagattcagagcgttagacggctgagcgcagtgtgtgaacctgggttaggagatttggggcctgagatggctgagtgcagggtgagcctgagtgaggagattctgagcctgagacagctgagcacagggtgagcctgggtgacaaaatccaccaggaaaatatgctcacgaagacatcattgggacaaccaataaaatatgcgtagtgtgtaggtttgatgataatgagataccaatgctgaatttcctgaatttgatacatgaatttatcaaatatagatatacatgtatcaaaatacatttacatcaaagtacatttcctcttggccaccttgtccctgcaaagcccctggattctgataagggctgtgtttggtgggtcccgtcactggccccaaacctgctgactctgcaggaaagcgtgctggcgatgcggggccagaagcgcgcgtgtttctgcacttgcttacgtagttttgtaagtgaaaaccttgttcttaagaaagacctcccttgaagtactaagagacaaagggctccatgtctacaacctactcggaaatggctgagaaaaaatacaagtgtgtgttctgtgtgtgtttccaaacagaccacacatcagaacctcaggggccccttgaggggagggtgaggccagggtctggggaccccctcaaaaagaaaatggagttgttggtcctctgggtgccactggcttcaggggcaggaaagggccctcacccaggagctgggcaggtggggaggggtccaggaggcacttaccagcttctggcaccaggtgcagccgggccccgactcgatgcattcccggcagctgctgaccttgaacttcgtgcactcctgagagaggactgagggacgaggccggctggtgagtgggtgctctgggccgccctgcccacacccaagggggagtagagcaggaaggtcagaggaggcccaaaaagacagggaggcagcctccaggaggagaccccgcattcgccaccacccccaggtgcaaagaggggccctcgggaaacagcacagctacagcctcctggcacgtgcggagacgaggcctgagtccccgacctacccccagtggcaaggtccttccccagcctcccgggaacttctgtctatgggaaagtgagggcaggccctgttctccctgattggaatgtcacgcgtggagtcccctccgtggaacacagaactcaccgcacccgagggagagcagccccaccagggcgagcagtggggggcgcaggcccagcatgtcctgtggagggaaggggtcttggtgacggtctcaggcccaacccctggggctgaccacccatgaagctcccctccagctggcctgggacaaggagctggggccctgtccctgctgcagggggtgggttagggtcaggccagcacagctgcactgggcccagctgccaacagccagggagggagggatcccgggctcagcagtgcgggcagcacacctgctcagccaggcacccaggacagctgcagcgggcccctgcagaggcacacaacacaggcacacacacacatgcagacgtgtacacacaccacacatgcacgtgtacgtgcatacagatgtgtgcctgactgcatgtacacaccacgtgcatgcacacaccacacatatacatgcatcacaccacacatatgtacacacagagatgtatacaccccttacccacaccatactccccgcaagacactacacaccacacacaaatatacacatgcacacgtacacacacatacacaccacacagacacacacaccacacgcacacaccatacacacgtgcaaatgtacacgcacacaaacaccagaaccccacacacccggtgtgtgcactctgccccagtgtgccccaggtcctccgtgagcagagcctgtgcttggaggagagctgggcttggccctgtctctctgtggcagaaacatagccaggaagagaaagctggctggatgcccgcgggtgccaggctgtgtgccaggaagagaaagctggcttgatgcccgcgggtgccaagctgtgtgctaggcctgcccaggagccctgcagtccctgccaggtgggaaaaaaagtcacctgacttgcccaagccaccagttgccggggtcctgcccttttgtttccagatacacacccaccccgtccttaacccacgcatccacagccaggggcggctcagtggtcactcacaggccctcggccccagaggcaaaatgacggaagcaggcctcagcctggtgctggaggccggcagcacctcctagcgggcagcagggccgttccacccctgggttcccttccctccatccgggaggtgcccaaaccaggcctaggtcggctccttggggggtcttagggcttcctaggtggggtgggcccctgggtctgacctcccaggacctgagaacattatagctggctgggacccttttatctggcaccaagaaggtggagaggtactgagaaggggtacccaggagccttcctgtcatggtgggcaggaagacatttccgttaccctggggctgttgtcagaagcaaagatcaacacacctcctccagcaaatgccagttcctgtcacggcctcccaggctgctggggcgttcctgccccacacccttccctcgggtggtgctggcagggccacccaaggttcagtgggcagacccaagccagcagagccccaaactagggcctgccggctttgaagacagcgctgggtgctgtgctgtggcccgggaggctcgggtgccctcagccacaggccctggctcccctccatcccccgaaagccctgcacctgtgctgggggctctgaggccaacggaacacccaccaggggcccatctgaggatcccacagcttagacgccccaacaagccccaaggtcctgttgttttggcagtgacctcattccctggttcccagcaaaattataatcagaatacaaaaatgtcaaaagggaacccttgatccttcccgtcctggggtcaaaaacagaacctgcaccctgctgtaacttcctggaggaggtggttttggttcacattgggcccaccctgtgtctgaaagcccccatatctctgatcgttgggggttgtggttcaggccgaggccagttccagctctccatctgggccccctcaaagtcctgcgcctggactgacctcggtgccacgagtgcccaccagcccctcagctgatcggaggccctgtgcgtgctggagctaccccagggtgcagggtccagccagcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccagggtgcagggtccagccggcttcaggactcccccaggtcgcagctgcgccaagtggggagggggtgcagacctcccctggcagccccagccaggctggtaaggactcacaccccagctccacgctctccctggggccgcagacatgaggtctccgcccctaacacagtcgtgaccagtggcatgcaaacacttcataccctcaaatggggaaactgagggccccagcagcagcaagatatggacctggtgcccagttaccccgggcactcccacctgcccacagggagagggggtgcaccttgattccagcaggattggctcagagaccacggcaccccaaccttgaccacaggaagggggctggtggggagccaccttctccccactgttgctcctccatgagcagccctggggggcttggagctgggggcacaagagaagccaggccctgccccaccccccaatgccagtggctgagcccagacaaacagctggggatgaaggtccgctccaggaggtaaggcagtgcactgagcctggcagccagcctcccttctgtgggagaacagggcagggcagcccctctgcccagcagccaggatggcccacggaggtccagggcctcacctgaggcctgagagaccaagaccccatcaggcctatctgcctcagtttcctccatgtgcctggaggtggtcgaagggcctgtgccagctccctgggggatgggaatgggtaaggcacagatgtagggcagcattcgggcaaacaggtgcctggccactgtcacctctggtgccctgaggctaagccggcagagctgcagggcaggaggggaggaagagcacagacaccccccaccccagcccctgagctggccccagagctctggcctggagcctgatcaccctgaggccctccctgctgccccacactgggggcaggtgccctcctcattctccaaggccctccctgctgccccacaccaggggcgggtgccctcctcatcctccagctctggacatcccccatctaagggcgggcgggtccccttaccaagacctaaggtgcaaaacccaaagctgaggctgcttaggaatccacagccccacaggcctctcagaaccttgcatcagagtcgcccttgacctcaaccctgcccgagaaggaagtgctggtgcaaccccagcccagctgcaggaagtggtacctgtcaccaagtcccctgcacaggggaagcagggggctgagggggcaggaccagggggacgaggtcatccttccccggagaacccctcaggggccgggcgcccttccctcccgggcaccaaatggacacagctaacaagaaccacacttcacggtgagcaaagctctgaacattcaggctctgagacacgaaagcggcgtcagaagagacctgcagcagatccgggccaaatcacacacaccctttcacagaagtcgaggacaggagaacaggagcaaacacaggaaaggaagaggccagcctggtggctgacgcctgcaatcccagtgttttgagaggccaaggcaggagaatcacttgaggccaggagtttgagagcagcctgggcaacacagtgagactcctacctctacaaaaaataaaaatagaaaataaattagccagacatggtggcatgcatctctagtcccagttactcaggaggctgaggcaggaggatcactcgcgcccaggagggagagactgcagtgaaccctaatggcactgctgaactccagcctagttgacagaacgaggccctgtctcaaaaaaaaaagaaaagaaaaagaaaggaaactttaagcaagacagcagagagagggcagagcctatgctgggagaggaatccagcggggtcaggcttcctttttatttttttgagacggagttgcgctgtcaccggcctggagtgcagtggcgcgatctcagctcactgcaagctccgcctcccaggttcatgccattctcctgcctcagcttcctgagtagctgggactacaggctcccacgaccacgcccagctaatttttttgtgtttttagtagagacgaggtttcatcgtgttgatcaggatggtctcgatctcctgacctcatgatccgcccacctcggcctcccaaagtgctgggattacaggcgtgagccaccgtgcccagtctcaggcttcctttttgcaaccccgtaaaaccctaagacgagactgcttgaggaaccagaggccccgcagacccattggaactttgcatcagagcttcctcctgcctgtgctgaaacccaccttgcgctgtcctagaggagaggcactcgcatcaaagtgactcggaggtgcgcgggaagtgatggacgatgccgccaggggacaaggttggaaggaagaggacatgggagccaacccctgcgctgggaactgaaggctcaagggatgattataaactaggcatccaccttttaagccaaaagccagagcatcaagatggactcatttctgctttgtaggaatgtgataaagaactggagagaagtgccgtcaggtggggactggaacactgtccttggatcacagaggctccaggaaatccagggacaaaaacaggtcagatcaaataggaacaagtcggagcagagaggatgcaggaaaacccagcccatgtcgcctctgaacctgcgaccctgcaaaagcgtattttcccaagggtcagggagacgtgttcctactgttggtttgactatctgtgaagtttgatagcacagttttgtttgtttgtttgtttttttgagatggagtctcactctgtcatccaggctggagtgcaatggctagatctcggctcactgcaacctccgcctcccatgttcaagaaattcttctgcctcagcctcctgagtagctgggactataggtgcacaccactaggcccagctaatttttgtatttttagtagagatggagtttcaccatattggccaggctggtctcgaactcctgacctcgtgatccgcctgcctcggcctcccaaagtgctgggattacaggcgtgagccactgcgcccggcctgatagcacaaattttaaaggccacaatttctggccaaatgaaataaaatgagacaccccacccccccgacacacacatattaataaggaatgctaaagtactctgctaaatacctgaagtcaaagggaaatcaaatgatatttacagcattttagacaaggggacaccactcctccatctaacatgaaggagactgtctgttcctgggtggcgacgtgaggccgaggccccggacactcttgctgtggacataaaagaatggccacaaatgtgtaggacttcagttttagggaataaaacaataaaggaaatagaagaataggtatctaagagtaaggaaacctcagcataaaagctaaggggaggccgggcatggtggctcatgcctgtaatcccagcactttgggaggctgaggcaggcggatcacctgaggtcaggagtttgagaccagcctgagcaacatagtgaaaccccatctctactaaaaatacataaattagctgggcttggtggcgggcgcctgtaatcccagctactcgcgaggctgaggcaggagaatcacttgagcccgggaggcagagggtgcagtgagctgagatctcacctctgcactccagcctgggcaacaagagtgaaactgtctcaaaagaaaaaaaaaaaaaaagctaagggggaaaatagcaagaagacagactctaaaaatggcacatgttgtactaacaaattgcatagaggaaatagctattatctctctagtgcaaaaggtaaatggtaatcttcatctctaaagagatcttagaaattaataacaaaaaggtaaatactccattcaaggatgtttcaagggtgtggcaccctgagcaggtaattcacaaaagaaggaagaaaactggctaagaaacatatgagtcaccccaggaaagaaccagggatttcagccaaaatatcttgattccctgtgtagccgtcaacgtgtaagatgctttggcggtttcggtgcctgcgctatggagtcccacacagcaacgaaaacatgcaaacagctgctcagggcagcttggcttcgtggtaaaagtgaatttatggggaaaaaaagagagacacagttccaaaatattctgcatttctctgggtggtggcactatgagtattttcaattttcattattcctgtttgtattttccaccctttttgtgataaatgaataaaggacattttaaaaatggaatttcatggtggccgacgaattatgctgaaattgctccttcggattccaaagctactggctttcttgttcccactgtgacgttgatgaggacgctgcttcatggcagtgggacctccctgctggcatgggcttgttgccactgtcactcacccattcacccatccatgggacaggggcttgccagcctctcctctaggcacggcgcaggggctgagagctgcactccaggactcctggactctgccctctgctgagactctcagcacctcttttccccaacacctaccccaagtttccatcacacacagaaacctccaccactcccaacaccaacatgtgtccccagcgaggctgtttacaaatcagctgggcaggaaggtgttcccctggggctaactcttctgcactctcagaccctgaatggccggagagaacacgcagcccggggtgggcaggggcctcagctcaggacagcaccagggccctctgtgcttgctcagggcctgggctccacacacatgggctcggaatcgacaaatgcaaccacctaatcaatgccccgtgtcagtgccagtttgtgccaagcagaatgggagggataattgctggcaccaggtccggcttggggtgggtatcacccacagctccataattgctaggcgcccactgcagagccccttgagttggggcttcccagcgacctggcctgtacctgctgggcaaatgcctgtgtcactgacccctgtggcagctggcattctcctccgggaacgggagccagcctccggtgacatggcctcaggcaggaccacggttctctgacacaggacacgagtgcagcaaggggggcccacacaggacctgttccatggaatcgccacaggcgtcacgctgccccatccacagaggcaaatgtcccacagccctggtacctggtggggcccggcctgggccagagtggacagacctgggcctggcaggagccctggggaagtgagttcaagttacacggttgactatagagacagctggagtgcgcacaattggccagaccacccctcctgtttcacagatggggaaactgagtcacgggggaccaaatagcctgctcaccccatgccccttccagacagggtgcagatagggcccctcccatctcctggatggccgcggcccctgtgcagaacttccttcatgggcacctcgctgtctgggggcctcttccccagggagtctcctggtggtggccgtgttgcctcaggctcactgtgcactaggcaggtcacgtcgatgccgcctgaggggcaggggttaccaccctgtggttcaggtgagaagctccaggctcaggagtgtccagctgcctgggcagtgtttggatctcatgccagcccctgccaggaggccctgcttctccagcccagcccacgcccaccaggaaatgcccctatttactcccttgaggcaaaggcccttgggtggctaagcgtcccctctcccagcactcggagctgagcgtcccctctcccagcactcggagctgagcattcccctctcccagcactcggaggcacctgcagttgctcagctgttcattgagtgctgggagtggaaactcatacgctgagcggcagtgacgctgcggagctgacaaaccccacagcccgcccggtcacctgcttcaccgagggccacagcccccccggggtcaggtggccacaggggtcctggccatgtgggacatctgttctgtggccctgctcaggatggcacccggcggggactggccctggggccgaggcatgggctcagccgccgccctgcagggacgtagccagggacctcttcccagcagagggactcccccactcatccccagaatactgaggggcacgctgggtgccaggctggcagggaccctggggattctgctgtgagctggatggggaaggagttccttcctaaaatgtggagtctggaggccactcttggtaaagtgctggcccccggggattctgcagtgagctgggcatggattctgcagtgagctgggcttcactcatggtgaaacgctggggtgacggcagacagcccagagcttctagcagctcatttctgtgaagcctccagaatccggcctcagcccccaaacccgcaggcgttgcgccaccgtcacggggaaggcgagtgacagcgagtgtcccctatgcccccacagctcgctcccaggctgagctctccggccatccccccccttccccattgcagccatgccacccctccttctccccacccaggaactgacagaggagaggggccccggatggacagggacagcagggcagaatcccagctcccagatccaggggaggggggattgggtgtggggacggtggtgcaaggggtggtgccaggggtggaggatgcatggggagggctggccccaagagtgcagtgttgggggaagggggccaggtgggcctgggacccaggggcgtggcttcaatccccctcccaccaggaccttgggaatggcctccaggagcctgttgtggggaggccagggtcaccagctgaaccaactcgaccagaatcgcacagcggtgcccgctcccctacagcaagacgtcacccaggggtccccacggaggaggcagggaagctcgagggtcccagaggagcatggagcatgtgccacaccacaccacactacattacacatgtgcaccatacatgtacatacaacagactccccacatcacatgcgcacactcgcacaccatacatgcacacacacacaccacactacgctatgccacacacgtgcaccatacatgcacaccatgccacactacacacacgacactacacaccacgaaccacaccacaccatatcacacaccacacactgcgagtcgatctggagatggaatcgctgtagccaggcggggcagcatgcagacaggagggcctaacacaggcaggcgcagcaggttcacagaggaggccccgggaacctgcctcctgcccagcccggagcaccaggaccccccagccgtccccctaggggcttgtgggcccagcctcttcctggccttgccggcctcacagccccttgtcctcccatgccggccccatcctcagccgcaagcgctcccagcacaccatgtggctctgctcttggtggcaggcacttccccttgccgggtctcaaaggggaccctggagcagacggtctggagaccccttcctgccagacacccctgggccggggctataagcagggccaccagggtcactccaggctggggcaggagagtgcttccctccaaaaatcaccgtggacatagcggggcctctgcacactcaccctcggtgtgctggagtcctcggcggtgctcctggctgggcgtgggggctttgctaccagtctgccctgggtcacgtctagaaacctcagctggaggcgcgggtcgtaaagtcctgacacttcctgttcctctcagctcctccttggaggaagtggtgggttgcaccaccgtggcccttcacccctgcccctctccgctctacagcagctctgatgtcagagagcggccccttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagaggtgggaacaggcaagaaaacctgggtgcgtgcacgcattgacatccacctgcatgtgagggcgggaggggacagaacagggacagcgaggaggagacactcaggtcacaggaggaaggctgcggatctgggcggggacgtggattgcgaggccactgaacaccccagggatggatggatgaggtcctgttaactagggacattaggaggataccacagaacacgaaagggaaaatactacaggctcagagagagagagaagggagaggaggaggaggaggaagaggagggaaagagattatacctagaaaaaaaacccaaatcagacatcttcagagcaaggactcagacacattactaccctaaactctgttttatttatttatttatttttatgttttcagttttttttgagacagagttttgcttttgtcacccaggctggagtgcagtggcgtgatctcagctcactgcaacctctgcctcccgggttcaagcaattctcctgcctcagcctcccaagtagctgggattacaggcacatgtaccaccacgcctgggtaatttttgtattcttagtagagacagggtttcactatgttgaccaggctggtcttgaactcctggcttcaagtgatccatccacctctgccttccaaagtgctgggattactggcgtgagccatggctcccggctcctaaactctgttttaaagatgtcttgcagaaatagacatgaagaaatccatgagaaatacaagagcagatgatacaaagttgggcaaagaaataagtaaaaattatgatgtcataacctgttgatttaaaaaatagtggtaagaatattaacgctgtgaaacaaaacgcctagaggactgggttgggaggggccagggagcacattgccgttccatcctatctggggaggaatatagatgcttgtcagtgggcattttgatagaaaatatctaagtatatatgctaacaattcaagagtctccttaagaataaaaatagcatgtatatacctgaaaaaaaatatgacaaatctttattttgggcatggtggctcaaacttgtaatcccagcactttgggaggccgaggtgggaggatcacttgagcccaggagttcgagaccagcctaggcaacatttggagacccagaccctcatctctacaaaaaaattttctaagaattcgccaggcatggtagcacgcgatatggtccaggctacttgggaggctgaggtgggagaattgcttgagcccaagaggttgaggctacggtgaaccatgcttacaccactgcactccagtctgggtaactgagaaaaaaaaaaaaaaaaaaaggcaaatcctttaaaagaaaaaagtaagggaaaatagaacaaacaagaaaggtaaataaaaaccaaacaataaaacattgggaataatttcaaacccatcaggaatcacagcacctgtgaatgggttacattttcttgttttaaatcaacaaggtcttgcgttgggttttagaaataaagagacaaaacaagttccaatgaaatgttctctgtcaagggtatcttctcattacagacttagcctagaaaataatgaagaaggacagaaagagaataccattctactacacccgctgatgacttaaagtaagcaatgaccctcgctgcgaacgtcacggacgcagcagacgttatgcacacacctttaatgaattagtcttgatgaaataacaatagaaatcaagaaaaatagaaagaacaaatgttactattgagcctgaatcaggtcgaactttttagatctacaaagaagcatcaggagggtgtgttagatgacatcgtagggatgcaattagcaaaatccaggctgaagaaaccctcacaaggcaaacagcacagtacaagaggagagacgaagggagagagaccctttagattaagagatttaatctcttaatagaaccaattgcaatgcatggaccatattttaaaatcattgttaattgttttaagtgtgacaatggtttgtggttatgttaaaaagtccccatcttttagagttacatgttgaaatatttgcagatggtgcagtataatgtttcagatttatttcccaataaagaggggtgggttgggttgggggagagtcgggagaggtgttgatacaacaagatcacctgtgagttgattatttttgaagccactgttggggacatggggcttcactaatctattctctctacttctgtagatgtgtgaaattttttgtagtaagattaaaaaaacatttcaaggaagtgtaaagttattatttcgcgggtataaagttcccgttttgcaagatgaaatggttttggagaagttggtggtgatggttgcacagtactaagtgtccttaatgccacggaaatgcataacttcaaatggttaaaatggtgaatttatgttatgtatattttatcacaattaaaaagtaaaaagtgtaagaaaggctctctatcagataaactgttaaaagagaacactgaaggctgaaaataaagaaacggaaaatacacgtatgtgctagaaaatactaacgaagatatcgtgtaacatcaaaaagatagaaatcaaagcaaaatgcatcaaatggacaaaggaagatgtagccaatgagagtcagaatccacagacagttcagcagccataatcctttgtgtgccgaacttcaaaatatataaaacaaagactgacaaatatataagcaaactgacacagccccaaacagcaaatatctctaacagatctctctcagaaataaacacatcaggccagtcgcggtggctcacacctgcaatcccagcactttgggaggctgatgtgagcggatcacctgaggttaggagttcaagaccagcctggccaacatggcaaaaccctgtctctactaaaaatacaaaaattagctgggcatggtggcgcatgcctgtaatcccagctacttgggaggctgaggcaggagaatcactcaaacctaggaggcagaggttgcagtgagccgagattgtgccactgcattccagcctgggtgatgagaaggaaactcttactcaaaaacaaaaacaacaacaaacaaacaagaaaaaatcaaatagaaatgcaaatttggcaggtagagaatttgaggaacgtaaccattcgtctccaacttaaacacaattatgttacaaagtgggacaatgataaacacataattactagaccacaagggaaataaccacatattctaaagcacaaagaccataaggaggccaaattcacggacacaattgaatgaaattagatgctgtccaaaggatggcatgaaagaaaaaaaacagcactcctgaaaagtggacccaaatatagcctagatcacatacatccatggtgccacactcacgctacggggtaatgaataagagcccttgaagtgctgctctgaagcctcgtgacccacagatccgtaacactgagattcttctgaaaagcaaaatgtagaaggaggcattgaagaataacatgcacctcgtccctgcagacccacacacccctagagcaggacagtggttacccctgaagacagagaaggctacgggcctgggagatggaagcagagggcttcaaagttctattgtagagttttctttactaaaaaggaagaaaaagttctgggcaagtcaggcaacatgttaagatttggtaagatgagaggtagctgtttggggattggtactagtgctctccatgctgttctgtattcttaaaatagtttatatcttttttttttttttaaaggagctaggaggaagtgactgcaaatgagcagaaggatctttcagggggtggaaatgctctgaaattagattgtggtgatgattgcacaattccgtaaattttctttttgttgctgttgtttctttctttctttttttaatagagactaggtctcgctacgttgccaaggctatggtgagccaagatcacaccactgcactccagcctgggtgacagagtaagatcctgtcagaaagaaagaaaggaagaaggaagggagggagggagggaaggaaggaaggaaggaaggaaggaaggaaggaaggaaggaaggaaggaaggaaggaaaaagaaaagaaaaaataaaaactgaactcacatgagaaccacagcccacaagaggcaggtctggacttgtggtctaaccctaaccagactgactgctagcaaaacaaaaagatcattgttgtccagaggattttagtagaatccagagtcttattaaataatattcaaaatgtccatgatacaacccaaaagtactcaaacagcaacaaagaaaaccttgagaacttgtaagagaaaagataactaatagatgccaactccgagataatcccaatgctgaaatgatcacacggagcattaaaacagctgttagaggccgggcgcgggggctcacgcctgtaatcccagcacttttggaggccgaggcgggtggatcacgaggtcaggagttcgagaccatcctggctaacatggtgaaacctcgtctctactaaaaatacaacaacaacaaaaataaatcaataaaaataaaattagctgggcatggtggcgggtgcctgtagtcccagctacttgggaggctgaggcaggaaaatggtgtgaacctgggaggcggagcttgcagtgagccaagatcgtgccactgcactccagcctggacaacagagcgagactccgtctcaaaaaatatatatacaataaataaataaattaattaattaattaaataaaggctggtggagggagtgaaggggaggggctagggaccgtggggcttcccagagccgtgaccttgctatggggggacccagacctccattccggggactcactcagcactcatcttactatcccccatctgatgtgcctgttgcacaaggctggaagtcagaggctgtgcacgtttttctttgtggagacaagtgagtaattggtgcgtttagtgtaaaaatatcaggtgtggctgcacggagtgaaaaatcacaggctccacggagccgggaggcctgctgccctgccctcttgctttgatgaggaaatggcgaccgcagaaggaaatgtagcagcaccggcaaccggcatccgtggggccacgccgggctgcttcccagggccctccagccaagcagccacaggaaagagtagatgttgatcccaagctaggactgaggagtccgtccctaagagccgagggagtcaggtgggcgaaactggccgcatgtctgggtacaactgctcagggtttctcatctgctgaatcaccaagctaggttctgaagccaggcgtgagtgagcaggactggagcaggattctgggaacaatcttttccctccagtcagcccagaaattccatttgcagtcactttcacttatgtattccagaaaactacctgctgtcatcaggggttggttggttgagcctttccctgtgcttgcctggcagacctgcgtgctctgaggctgcccgaccctgagctccagaacagaccatcgagttcaggagacaagcatgtcagccatgacacaaggcagatgagagggacccccagcgtccacacgtggaggcagcgggggcagccggtgagcatagatggggaaggagattcagagcctgagggctgctctcctgccctcccatcctggacactggcctgggccccccagcttcccttcgcccagcttccacccccataacacacaaccccagagcttgggaaggaggtctctctgtgacaggtgggattctggaagtttccacggaggagaccccataggagcagggtttgaaggtcaagaaagatgctaaggatggagagggccagtggggagagggtggttccaggctcacttcacagaggtgcttggggagctgcaatattttggcagcaccaagggaagagtcaggtcagtgaggttcataagggatgagaaaggagtctaaccagccctggagacccctggggtctggccccacagggagatgtccaagtggcagaaagtcccttcctgcctggagagcacccccacgaggaccctggggccacccgggaaccgctgctccctcccagtcactcaccacacttccctctcccgcccaccctccaacctgcctgcaaattcccctgcaacccaactctggtctcctcccaaccctgcccccacgtaggcctttttttttctttttcacttcttccccccagtgacttccttctgcagtgttgattcagctccctttgaaggcgggtgagaccttttgcaggctgggggcaggggcgggggcggagaagagggctgcaggcagggctggcagaggggaggaggtgacacacactccctggaggcgagtggggagggctcggggcaggaaatggagttgggtgccccaggtggggtgctccaacgagctctttctcatgggatcccccacagatccatacaaacaggctgaccatcagggctggtcccaggccaccaggctgggtgcaatgcagaaatggagatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacttctttggggatgtgtctccaagaaaagtgtgggctgccttcctcaccctggat

SEQ ID NO: 2551 - DNA, 107486 bp, Homo sapiens
  source 1..107486: mol_type = genomic DNA
tggtctccaaggctttattcaggaaggtttgcatctgtttgacaggcactgtgcaggggtttgtaacagttcagttttctccaaggtcccatggggagaggggtgcagaacaggaagagagcctctcggcaggcggggggggtcctctcctccagaacaaaaggcactgacgaggtgaccaccccagagccaggggctgggttatatacacatggggtggacagatgcagagaaactcaaagctaaatacaactgaaggatgaaagagtccatcttacagggccagggctgcttctgggctctttctaccaagtgggaaaggaagttcaaaacaaaggcaaagctttcaaggagaaacaagagtccagcctttcggtcttagtgttctgtgcaattttaaaacccaacaaaataaatataacttaaaaatgtcttacatgacactaaaggcaagcctgggaaaagcaagcagttgaagaaaccttccgagaatgctaagcagtgctgaatgccaggaactcgtggggccccccgcaggacagggcaagaggaccctgcgcccattcacctgggcacaggtacacagagtttgtcctgcctgctggcacatgcactgccaggacccaaggagtccctgtggtgacgagggctgggcaggcacggtcttccaggctgccagggcaggggttctgggagattccatttcacaatccatctatcccactgagacaaagggaagggccagatggcagggaagcgagtggcaaaatggcttgagagacagagtaggtgtagaagagaactagcacggtaaatacaaaaaaagagaaaaaaaaaacagaaaacaaaaaccctaagtaacagaataaccctaaaatgatgctacttcatactatgttcacatatttaatgtaacccacagccaagtattgccaataagaggccccatgggcctcctttaataagcacatcatttgcatattagcacattgtttgcaaacagctggtgtctgcctaaagtgcttggaacattttgttctcttaaacaggtcccctgtaatttttgttcatatcatgatttgctttagcaaacttctttcacagatggagtaaggataacttttggccagtccatattcatagaatctttacgtctgaattaatgatgcccctgccctgcaaatggctgaagcacagaccaccagggtcccttctagcccaaaagtcactatagctccagaggcccagagttgactttggctccccaacgcccccgtcctgcctgccttccagatcacatgctgccacgaggtctctcgtgctccaccgggcgcgtgtgtgacctttagcaagtcggcccacacaggagctcaccactgttttaaacaagagccaggaagtgtaagttgatttccttttttaaaatctgtacttatacatcctcatgtgtcccaccctccacccccagcaagtgtcactcacacttccagcacaaaaggggaaatgtacatgtcccgtgggcaggttgacagttccccagagaccccggggtggtggggtgggcagtggttcctccagacacacacaccttggtccatagtctccctctgtgtccctagctcctggactctcccagctcctgtacctctgacagcaaaggagtgggtggcaagccccaaggagcatggggcacagagctgggggttttgttcttaagaagtcaggcaaattttacattcccttccatatcagactcactggctttcagttaaaattgggcttaaataggttctccacgaatctccaaatgcagagacttcaggaagaggtgcctggagcacgccctggcatccaccacataccctacaagatacccacactacattggagaagcaggaatctaagccctccaggcagtaaggcttgtttcagaggcaataacaaatgatgccaggaggccaccgcggcacctctggaagccagaagcctgccttcttcctgcctggcgcagacctgagctcctcccctatttctatatctgcaagggactctgggccccatgacaggagcccatgtatgcaggcagggttgaccaactagcaccaggtaggtgagggtcaagaaaaatgtgctcctccctggggccagggcccagagactctatagatcccatcttcccctggtagcacccttggagctcagcatggcagagtgtgccttctgaactcatgggttgcaattccaagtggcacagcttctgctcgcctcctctgggaaggcctagatcagagaacacagccaagctggcttcagccttctcttggctcctgggtctggcctggagccggcaggtttccataccagatgggtggggggccttgcctgagcagccctggagaggccaccagggcatccctgaggctgctaatcggaagacactttgctcacagtcaacatgtggttccccgatggttttgtgccccaactaccagaaagccctgctcccagccagggaccaggaacccggccggccccctgggctctccggtggggaggccccggcagaaataaggctgtgcttggcagcactctaacagcactggccgccagggggcagcaggcctccgcaggtggtaggtccaggctggtgcttcctagggggctcccagaggcagggctcatctggtagggtcccctcagcagccagggaccccctccagctctacacctgacccacctctaagactgggcatttctcttctagtaggtgaccctctctacaaaaagcagtgcaaacaccacctccaagccctgaagttaggaaaatgactagaaactctcatctcctcttctacaaagtgtcttgtagtgcagttcaggagggtcagtcaggtgtaagtgaaggaaaagttaggaacgagaaaggaagcacaggaggaggaaaggaggcccaggcgggggccagggagggcgtgggcagctcaggcgagtggggcatcctgggacatctcggtcaggatgtcgacgaggttattgagccccgagaggtagccatcctcccggttcccctcctgccaggggacgtcatgctgcagggtctggccctcaggcaggggcgtggttttcccaaagtcgatcatccacactttggcctgttccttcttgtcgtggatgaagaggagggagctgccaatgacctgaggagaacatgggggtgaagggtgagctgaagcccgggcctcgccctccccactgcggcccggggcctgggtgaccaggtggggaggctcgctcaggccggacagttgggtgcctgcaattccaatccccattttcagacaggcagcagagccggcccaagaatggccatgcctgggcagagggcatcgggttccagggtcggcgaccacccttctgtgtgggcagcagcaggcaccccttcaccccctgactctggcctgcacactttccactccttccctccctctttctttccttccttcctgccttccttcttttccttcctttcttcccttccttccttccttccagacagggtcttactctgtcgccccagctggagtgcagtggtgcaacctcagcttactgtagccttgatctcctaggctcaagcgatcctcccaccacagcctcccgagtagttgggactacaggcatgcaccacgatgcccggctaactttttgttttttatttttgtagagacagggtttcactatgttacccaggctggtcccaaactcctaagctcaagccattctcctgccttggcctcggaaagtgctgagattacgggcatgaatcacactgcacctgggcaaactttccactctttctagaccacaacccaatctggggcctcgcccttccgcctcctagaacctgactcctcccaaacactctgcagggaaccacagtgaaggggaaggtgcccaggagcgtccaaactatcccggggcgggggtggtgaagaacctgtttcaaatgcacacagcacccccaccccagcagcacaacccctgcagattcagcgtgggcagaccctatagggccttcccagcctggcccagggatagtgggcaccaaagagcctgcccctcctgggtgagctcagagcctctgcatgggagcgaggcgctttcccaaatatggccacacatacccctgcatcacctcagtggggccagaggaaggccgggggcacagaaagggctcaggtgacattccagcttccagcagtgcagggcaggtggggcccctggcgaggctgagcccaaaaaaggggcttcctcttcgcaggtggaaaacaacagacccaagctgatttggcctctttctagaccttaagggagaccccaaaaagtgtagaacaaaatgcttttccaagaaataaaagcagaagtgttgaagaagggtgggaacggctttgagacagagctctgtggccttaagttctcccaggcttggcccctggggtcaggcagccaggcagcacccccatcgtccagagaggcagctggggcaaagggggctctggcaggtggcaggaggatgcttcatcaagtggaaaggagaggccacaggaggagctgagggtctgggggacaaggagagcaaagaacattccgagaaggaccgagctccctgctaggggcacagcaaagcctgagtctcctctctgggtgtgccaccccctcctcgcagccatcctctccaggcgccccgcagggaatgacatgcagagcaaggtagaccatctgcctgaggaggcctggtggtgtagtttgcagaaagatgcaccgccctgctggctgcctcagggctgaccctatgagttcctcctgctggctccgcagccttctctgtgggcataggctgaggctgaggccacctccatgtaagaccccatacaagaggacctccacaagagagtccctacgagaggggctgctttcctgaactacctacacagctgcagggagccgcaggatcccgcttcacacccacccacccatgggattagccagccccaggactgcagctctgtgtgtgtgtgtgtgtgtgtgtgtgtgtgtgtgtgtgtgtgagactgggaaaggcatgcatgtttgtgtatgagtgggtgtgcacacaaaaatgtgtgtggatatatgaatacatgtgtgtgtttgtatacgtatgacttgtgttaatgtgctgtatgaatgtgtgtgcatgcatgtgattgatctgcatgtgtgtgaatgtgtgtgatttgtgaatgtgtgtgcatgtagggtttgagtgtgatctgtgaaggtgtgtgcatgtagggtttatgagtgtgatctgtgaatgtgtgtggtataggattgatgagtgtgggatctgtgaatgtgtgtgtgaatgtgtcatgtggctggggacctggactccccatgtcagggtctcacacccctccagggaacctgccgacacctcccagagcctctctcaggtgtctcagttccccacctgctgcctgctgcccctgccaaccaacgtatgcaaagttgggagattccagccctgcccgagagtggcacctgaagacctgcctgccctcctcagggtctcatctgaagatgtaggtggcggtcggcgggtgcctggctactctagcagctcagagagcttctgccctgagaccacgggtgtgtgggatatgagtcctgccaccactgcccagaatggacaagactctggagctggaaggacaagggaggagaaagggggcaatagccaggggtctcaggcaggacagcccgtgtggtcaccccaggaagcattgagacgcagctcccccgtgcagcgagggtctggtccctgatggcctgcctctggctgcaccaccctgaaaatgcccgatgccccgggcttctggaaggagaaggagaaggcctgttggcacgcgcagcattctgctcaagagggcaaaagcccagtatctacctcgtggcacttgaagaagggagaaacttctagagtggttcgaatggccttcagccggtcccgataggcgatctgggaatagaaagaggaccagatttttaagcgccgcgtggggaagggcagtgtcagaacacccatgcggcctctagtggtccctcccgtgaatgtgctttaccctaaacgccggacatctagaggcagcttcctgcgagcagggctgctgtggcgtctttctcagcataaatgtcagtacctttgacttttgaaaggacagggtaagagagagaaccacaaatatctctcccagtgccctctccatggagccctataaacccatgtcaagctttgctggccttggggggtgccccatcttccccagaagccagctctgtgggtctcacccccgggctgccttgggaagctcgtcatacacaggtacacagagttcctcaatgcctgctggaaaagagtgacagctggccgggccagccgagcagccccctggagtcttcagcaccaggaacaaaccccaggcataggaggcatgttccatggtggccactgcttaggggctgagatcctcccctgcaagggactcaggaattggaggacttgggctacgaaagagtcaggcacattccccctgcctgcagcctcagagcttgccaggagccaagggaagcctccccagctggaaaaggaagatttcccagttccagccggtactgagtctccttggagaaacggctgcctggtccgcccccacttgctctgcagctgctgtggactgttcagaaggtgccattcacaggggctccagggcccgtgtcccagatgtgcctggatctctgactgtcccagggagccgtgcacttggggcacagtggcacaatattccctgactcagctggaagggtcagtgctctggtccctgtgggcagagcatctatccagtctgcgagccgctgcagcagcaacacacaagacagaactttgtcatgaacttgtacaacccacactcctggactcggagacagctcgccagctcttgctggcagggagcagcgtgacctcgggcacacaagatggggacaagcaggtctacccacagcaggtctgctgtgaagatttgctgcacgcttggcatgacacctggcagacggcgggcactgttctctctctcagggcatgggaaatgctctctggagctatggggccgatggctaagggagagtcagtgagtgtccgccaagcttccccgcctacccgccgcacgccagggacaagcacatcgccttcttctttactttccaagcagaagcctggggccaggatggatacaaaccttcctgggtactaacttcagtgcccttgacttttttttttttttttttcccagacagagtttcattcttgttgcccaggctgaagtgcaatggcaaaatctcagctcactgcaacctccgcctcccaggttcaagtgactctcctgtctcagcatcccaagtagctggaattacaggcatgcgccaccatgtccggctaatttttgtgtttttagtaaagatggagtttcaccatgttggccaggctggtctcaaacttctgacctcaggtgatccacctgccccagcttcccaaagtgctgggattacaggcgtgagccactgtgcccggcgtgcctttgacttttgaaagggcagagtgagagagccacaaaagtctctgccagtggcctctctacagagccctacgaactcgggctggggtgtgctgtccctgggggtgccttgtcctccccatgggcacctccagagtagacacagttgtccctccctggctggctggagagaccctctctggaggtgccagactcaccaggatgttatggtttcctttagtgaactctctgaaggcctcggtgacctgctccctcgttttggtcttcttgaagtcccggttcacggtgccgtcttctttctgagaaagagaacaccccacccaggagggggtcagcagggaccctcgggcagaaactgttctcacccacccaacaccacagagcaggcgagccccatctgaacctggggcagggccagtggaggcacccaggtgtccacgtatggcgcatggaggtggcgtgcacagcagaggggagcctgccctgtgcccagacacaggagaacgcagagggtggcgctgacatccccaggcgagtgaacagtggtaggaaaggcccggaggtgtgaagggcatccaggctgaggatggaggagcatgacccggggctggcctgtcctgggtgcaacagcagggccaagagagagggtcggcctcgacttcccactctggggcccgggccctggaaccggtgcccggaggtccctgcccgccagaggcacctcccctcagcacagggaggagagacttgctcccgccctgagctcagcttgacttcctttataatctaccatctcttctttcacgttttctgaaagccaggatccaatacagccctgcccatctctgctccctcgcccaccccactcccatcttcttggccccagcactatctctgttcaggctgtcctgggccctcatgtggggctttgctgacctatgaggaaatctgttctttagggacaaagggaatgctccaccaggagtcccaacagtgggccgtgtctgccctcaggctggagagtacttcagctgtgtcctcactgtggctgccttcgacaggactggcaggacctggggctgagggagcagccctgggtgcaggaggggccgagagccgggggctgtgggcagtgcaccccaggcagagcctcttagctaagggcggggcaggcaggtgatggtgaagacagctggcttctctctgagtgggaagacaggctgtcggctgttctgacggctggacaatagacagagaccaggagcacatcctgctcgagagggagaggtgaagggaaagtggattgtttctaataaagaaaggaaagcgagcgttaaggagaaggcggatgggtacggaatttgcatccagtctcagagctggatgcaaaaaagagggaagggctggtttcaaaagacaaagaagggggcaaatgcctttctcagcccagagctcgcaaagcagctgtcccgggggaaggtaaaaacttccccacatgccaccgtgggcagcgagccattgacagctgcggaagctacgtctaaatgccatctgaaaggaggctcaggggaccctcccatcaggaccatcggctgcccaaccctgactccaggctggacactggagatgatgcagaccatgactggacagagaatgggagacccgacaaccccacagggactgccatctgctcaagagggacagcttctgagaccctgaggggccggcgccccaaagcccggctcttgcaaatttaacagcaagggtgcacacaggggcccagggacagggagatcatccagacagtcaccaatccagacagtgccagttccccaatttattctggggaaagtaaatcaacatttgaacataatcatgtataggaagcttctgtgtgcccatagccagagctaagaactttcctgccagatacacataggtacaaagggatagaagggaaagagccatcattttgtaaaccacaaacacaaagtaaatatattaattaggggaaaattacatttacttataaagtttgtcatgttgtttctttggagcttatgtttctatttctgttccaataaatattttaaaatttccaaaaaaagatcgaagagcaaagcagagagaatgcagtttctcagagaccctggctccaacatcaaaggcggtcagcatgctcctcccttccccgaattgtctgccagtcccagtttgcagccatggcagaatgaaccagctaccccacaggcatcccgcaggtgcctctcgcctggctttcggtgccaggcaccgtctgggctaaatggagagtcctcggcagagggctgacagctgggcagggctagaagccactctgctctgaggcctgagccccctacacagccatcccgcctgaggaataggctgatgtctccaaatgtctggccttggggcgggccacccacattctgagcctgtgcctggagaagcttacagcttccaaagggcgctgagagaagccaagccccctgaggtgggcacgggtggggcccgaggctgccctcactcgccggcctcaccttgattccctcgatcctgaaccccagggtggccgtggagctgatggtctcccgccactgcatgtaccgtggcttggtcacagcccgctgtgctttttcctcctcggtgggggcctcggggtccacctcgatcatcttctggtacatgtccttccgcaggctgggcttcttccgggccttcgtgagctcctcctccaggtaggtcctacgtgggagggaaggcgacatgagggccgaggcctggggcagggctcaccagcagctcctttcctgcctggtggatgaaggtttggggcgtgtgttgcccaacagctgcagtcagctcagtgccctgagtcaaggcacgtctttccgaggggacggcagactctgttccagctggggctggctctaatttttcttttcttttttttttagacaatttttttagtagataagggagtctcgctatgttgccccggctggtctcaaacttctagcctcaagtgatcctcccaccttggcctcccaaagtgctgggattacaggtgtgcaccaccacccagcctggggttggctcttgatccaggagaaaaggtgcagcctcactgaatcggactgccttcactttcactccaagcccatcggctggcctcacaaagcccaaggagctcctcctcgggagacccccacaggaaccagcagaagaaggaagacggaggcagggcagcagggggtgtcgggggtggctggtcctgatcctgctgctacggtggagctaagagaggggactgggggcagggtctactcagggccccactagatccccttggctgcctcggcccttccataaagcgagggcttccaaagccagaacctgtcctggtgggagaagtggtctgtcctcaagtccccatctctgctgctctcaggcagcctgaaggctgagcctgcccataagtgtctctggctctttccaaagaggtgaaatcttctggagcacaaagttcaggtcagaaagtggccttggaaggggtcccagtgtggatggagaaggccgtattgtgggggaaaggcagggggctccctcagcctctgctcatcccagagacatgcctggtgcaccccaccccatcgacaccaggcctcctcataggtgagcccccagtccaaaaagcctgagaaaatgcttccaactcaactgcctcacggccctggcctccacacgagcagctccagctgaactggcggggaccacctagacactggggaaggtaacaggggcagggacagcagagcacttgagcagccgggggctgaatcgctggccctgagctgccgggacacgccacctcccccagcacacagctctgcgcttctaccttctccagagcagaggtggggtgagtcatcccacccccgctcctctgctctccttttagagccccagtctccctacacaacaggctcagaggctgcccacagcccttgaggaggcagaaatcagcagtgtcagttgcaggatggggaagttttctcccctttgccctgtgtgggcgggagctgcccacagaggccccgcccgcctgccctccacctggccctccactcttcctgcatctgtctcccaggccttgttccaacactgcccaccaacttctccaagttgctggtttgggacccagaacagactaaacaaaaactacagcctcttaaaaatgacaggctttagaaaccactgtattaattgaaatttgcacggaaagaaaagggaagaaaaaaacaaatcctttgggtgtgaacttaggcctggctggttaggaccttccaggaggtgatgagggctggagggggaagtcagtagctttgggttgggcccttgcatgcacacacaaccatgtgcgcacatacacacacatgtgctcatgcacacacatgcacataaacgcggactcctgtgcaccactgcacacacacaggtgcacccatgcaggacacgcacagagcacacccctcacatgcagagccaggtcagtggtgacgggggcattgaggcaggggctgcgtgtgcatccatgtgtgtactgtgtagaaaaggggcagccaggctgtgggagggactcctgagggcgctgtaggggaccgcatggtgggtggctgcacttctgcaaagagctctcagcacccccttaaacaggaagcagacctcaatgtgaaatcccttttcacatggcctttctccaaaaagggcccccgtggctcaaagcgggcagtcactcactgcccaggagaggaaagaggctggggggagatgtccacagggggtgccagctggatggtggggcgggatgcccacaggaaggtgaggctcagcccctccccacactcccctgcctgcccgagacaaagtcgaagctccaagccatgcagggaagcagagacctgctcgcccactcacaggacgctgggggaggaggggactcaagatcaggtggaggaagtgctcctttgagacaggccagcccagggagccaacaggtggcaggcgaaagccacccagagctcctaggtgctaggggcgggctctcacctgcactccccaggcccctggtcccaatgtcaggaagacagtgttgactctccaggacaagtcacaaatctcagagcatgccccagagccactgagcacatgtcggcgggagccagagtcccaagaagccccgacgtgcagacgccaccagcaactgcatcacattctccttagtgccacccttctgcccccgccatgcccagcattgtttggtgaccggcccttccctttctctgtgacatgtctcaaactctcttgccctgggactcagcatgtgaggtaaccctgggctccagcctcctcaccctgtcatggaaaggccacattctagaggtgaccatgagcagccagtcttgggagaggccctgcagccaagggttctggatgaacgcatttgggggaaggcacagtccatggcccaaatggaactagcctggcaccccagggaaatgccatggaagctgggtcccacacagcccccttgggaagggctgggctgcagctgggggcctgatttgcagtcaagcaagcctggtgcagaactgcaccaagctgctgcctggctgggtggccctgatgagtcactgaacctcctggtgacagaaccctcctgcttacactggaacatgacccatctcccagaatggcggtgagaacgcaatgggataaataatggaagcatctagcatagcccttggaacaagaagggtccttaggatttgtgtgcaggaaagatcgggctgggtgcaccctgcttctggggagaccttcctcttcccctccacacatactcctctctcatcctcttccctctgcctgccaagatgggttacatgggtaccagccacggtcactctagatctctcttgagagcactagggtgcaatcagagagaagctgcggaagtcaagcggctgggtgggggcagccctggggcaggaagcggggctcctgtccccagcaggagcaggcaggttctggggcagcctggccctgtgcttggctggctgtgtctttgggacagccgacttccagaaatgcccagccagtgttcttcacacaggccgtacttttttggccaggtctgagtggacaccacttggattattctccatgtggtcacctgcgaagtcctgctgctgtctgggttggaaggaagggctgggcctcccctgagaggacacattctggtgcaccagtggatgccatcctgggtcagaaatcagactcgggaaaagcaaaggcctcgggctggctgggggcatgttctttctcctccctgccctatcccaggtccctgtgggctaaagatagtaaggaacttggatggtgggagggaggtggccagggatggctcaagagcaaacagtggggcctgtgcttctccatcccccattctttccctgtgagtgatggcgagagaacacaacagtcagtggcagggtgtgattttaggacagaactcccaggaggagagagaagaaaggaaagaaggaaagaaatgctggctggcttagctctcttctctcctggcctctgtctctgtctctctctctctcacacacacacccctctttctcaatctgctcttatgagaaataatccggttaaaccagtcacagtggacacagccttctgctctgagctctgagtctccgtgcctggcctcccagacagccctgcaaggaagcatgggggggcttggcatctggccgtccagcccgggtgctgcagtgagggccagccccacaacatgagcaccgcacgctggacaccatgggggccgacagccttagggaggttcaccaagcctgcacaggggagaaggagccgtgctgtggatgactcagggtggaagggcagcagtttgagaggtaatgagaaaacccggctgcctaaaactgagccccgagatcacagcagccggcctcaggcatccctgtctgctctctgccctgcctcctcaagccccctcttcctctctcctcttccctggagtcctctccaggcttatcccctgggcaggtgtcagggtgagcctgagcccctgtcaggaacctgggggtgggagccagtcctgcacacaggcccagtgactgctccgggctcacctggggccctgcggtgacctgccatgtgggtttcttgagttccgtcaggggcttcctcctccttttaggcagatacaggtcttttttgggaaaccagcatgttctactagccactctctcttcccactcaccagggctggggaaatggaaagacctcgattcccatctcccctgcagctcacacagcaggaagtcaccatcctgcgacctccctacctggtggctccccgcacccccagcgatcccacctgaaccaagggcagctctctcttccttctctctagggggcctcagaacccagccggtgccctttttctggttccgccagcccctggcttctgctcactggagaaggaaaggggccatcatgggcaaagcccaggtcccggaaccctctgcaaataatgggagatgcctggggatggggaggctctaattggtccaacagcctcctcagcctgcccttgcacctgtgaggcctccgggaagccctgagtgccacgctgtgcacctgccatgtggcttgcactgaggcaggcatgtgggctgcgagaagcctggctcacctgattcccatcttgcagtccatcacacagggcgagtcgaagtcggccagcaggtcgtccatctggttgtagcgctccccgtccttcaccacatccccatggtaggcaggtacgaagggcctcagcacatccaccatcagccggtccaggcagcgctgctctgactcacagtgcttcttcaggatcctgccattggcagctgccttgaaactccctggagagcaagtgtagaaggttcctggtctccggctgcaggtagctggcagaggcaccctccccagcacagggtctgggcctccctggggatggctaagcctggggctgaaggtgtgtctatgtccctgctatggactgagcaccttaaggggagtgggttcaagacctagtccccactcactaactgtaattctgagctggttccccagcttccttgactccagactcctcctcaccagtgttccctgctggaagggtacagagctaggtgagagactgaggtgccacgacccagtcattccttagtgttgctattttcatcctcacctccatcatcagccctgcttctcggcaacgaaggtgtctcctggcctcagtagagaaaccctgattggacaggattcagagccaaggtggggagatacagcaggctgagaagctggggggcctaaggctcagcccacctgggtggcacttcttctgagccagaccaagtaagtattcacacaggctgtccatccatgtgccttgagttgggccagtgtggccaacgaggtaagcgaaatgcgggaccttgtgctggcctgaggaggctggtgaagtcacgaaggccaagtccacaggcagcccctgacatgtctccagatgacagtgcttccagagggtcctacatgtgggctagatggctctggggcctcggctccagatgtcccttctccccggcactgcctggactcagctcctagccaccttcctcccaacaccgcacaccgccctgcagttatggggtggcttggccgcatcttccaccagctgcaggctccctcagggcagaaactacatctccattaatgccgcaacccccaggaccatggcaatttaggcacacagtaggtgctcaatgaaggggttagctttgcctctttgtccagggtgacaaatggcaggtaagctataaagactgatggcttcatctgtcttattgaatacaacgggaagagagacagaaagaaagagactggaagagacagagataagagccagagaccgagggaggggaggatgcatgttttggaggatggggtaacacagactccagagaggtccgttgtctatggcatttacaaggcattggtaaggccgcagcctgcaagtgtggctgtgatttcagactagaaagtcttggagggaacttgctctggagctttgatccccagaatgcagcgtccagggcacctccccagagggctgagcaccatgctgggaaagtctgggagagctgtgtctacctgcgtgtcctgccagctggatccaggggtacttcttcttgaaggacatgacgaagggagaccagtgcaccatgttttttatcttcctccatgatttgctctagaaacaaacaaacaaaaagctctacattagaaagacaaccactaatttctggttaggacaaattcaaagcaaaggccctcattgcctgtggccacaagatgggaagggcccttgacgggctctgaggaccttgccaccaccatcacctatgcggcacatggtgggaggtggctttaccccatttaacaaacagcctgagcaaaatgctcaggggaactcccctgtcccaagagcaacgacccctccaaggaaggctggagaggacacaaccacccagccgcaccacattagttcatattcaattcgtagatgcggaggcaccagaggcacctcttgcctgcgagtggtttgaagagagactttaaagaaattcctcagaacagaacctgcaccgatggcttcaggtcacacaggagggagcaagcccacagctctctcctctgcaccgcgctccgccctctcaggatgtttcttcagtgaaaacagccaggactgggagtgtgcatgtgtgtgtgcgtgtgtgtgcatgtgtgtgtgcatatgtgtgcatgagtgtgtgcgtatgtgtgcatatgtgatatatgtgcatgtgtgcatgtgattgtgtgcatgtgtgcatgagtgtgtgtgcatgtgtgatatgtgcatgagtgtgtgcgtatgtgtgcgtgtgtgtgcatgtgtgatatgtgcatgtatgtgcatatgtgtgcatcagtgtgtgcatgcgtgatatgtgcatgtgtgtgatgtgtgcatgtgtgtgcatgcgtgtgtgatatgcacatatgtgtgcatgagtgtgtgcgtgtgcatgtgtgtgcgtgcatgtgtgtttggggagagcaggccctttgggcagaaaggagaactaaggtatattgagcatcttattttattttctcaatgagcatgcaagtcaattcttttctatttccatctggtggagcctgagcctcagagaggtaaatgacgaagctgggatttaaacattcatttatacaactacttgaaaataaataaaattaataaaattcttttcttccccagcaaaaacaaacaaaacaaaacaaaaaaacaaaaaaaaaacatatttttagaaaaaatatccttaagtgaactttaataagaacaggctgcagagatgaagatcaagtgtccccaaaatacacccgtcctcaggggggcgatgagaacctgaatgagaagcattgtgagttcctgagaaagtggatcctggaccagctaaaccacggagagcagaagccatgtggcttgcagaggagatgagggtggtactgcctgacagggggacacactgaagatgtggttcccactccttgccccgaagcgcccagctgcagccctcaggggtcagcggcggctgctgggtccccaaggtgaagtcaaggtgaaatcggcctcctttgttttttctctctttgctgagactcagccgcttctgtcatcaggttttcaagttaaaatctatttaaggagaggaattcttccttactaaacctggtaattcttatccccatcccagaaactctcaccccaccgccaagaccaattctattcttaagagagggcagcgccccatgaggccatgtgacaaaagggccgaggctttactgacaaggatgtttttcctagatccttctgatggagatcgccaaagaaggctagagccagcggaggcatttcttatctaagcacccagaaggctgcataaacaatcagggcacacaatgcatgagggcaacaatggaaaaacctcattacacaagatgagcccagcagtggctcgtggggacgcccctgctcagggggaagccattacggtgggtccagggggagagtgcacagccggtcaccacccgtgggtcacatccctgcagcagagctcagagaggacaggggctgacaggcttcaggggtggtgtgggaggaggggagcccagagtgtctcaatccagggctcgccctaacccatgccatgtccctatcaggggagaacacacattgcactgtttcacagtccctcctggggcctcagtttcctgtgtccggtgagggacagacagctggtataccaggctccttggatggatggacactctagggccctggaaagtgaccttccctcatcccaacagcaatggcccctccgaggaagactagagagggctactctcccagctgcagcgtgccagtttatattttatgtatacaggaggaggcaaatgagcatgcatggaggaagggtcccaggaccctagaaggcagctcactgtggagaaggagggagcttacggaggctgcacccaccagagacagctgggggccagactcagtggagagaaagagaagactacagctggcagcgggagtgtggggacaaaggcccggggactggaactgggagtggttgggaaccagacctgctatgggcatgggggctgcagacagagggagataggtgagcaggcgaggcctcgggagagcgtggggcgttgaggcaggccaacctgggcccgagtcccggctccccttttcctcctcaatgactgaccttgaacaagttcttagtccttgtttgtaaaaagagcgacacatagattcccattctcccaggagataaagctgtcaggagatgtgggtaccagggtgtctgtgggagggtctttagccctctgtgttcaaggaggggacccaggtgtctctgaagttacttcaagaatggtcagtcctgtgctaggtggagttgctggcctaggttctgaacaataaagacctcggagcctggggcagggtcatgcccatcctgttggggtgcagctctccagagacccacaagacacagtgagcagggagcctgtgacccaggaaggtgaacagatgctgggcgagacagtgtggcttagcctctgcaaggccatttgaagctaagaaacttccagttcttggacctctcccagaggctaaagaccaggggtctagaaaggagggggtgctccagggtgggggtcttctgacagttcaaaggatccacaagcctctcacatcgctgagctctgaccaaaccaggcacctttaccgcttggctcccctctgcccacacctcctccatttcttcaccatgaaaataggtcccacgtggccaaggccctgagagtcccccagtcccaaggctgctctgcctggatgagggccgtggaatattccacttgtgagaatgccatgcacttgcactggagacctcttttctctctgccagcagcagcacacagggtttccccatggtttttaaatagcagcacccaggcagtgcctaatgtcactgccaagcagtaaacagaaaaagccatttccaggtccaggctgggggaaggagggaaggagggctgcagggtgaccccaaccactccagcctagcccctaggagcagagatgaactaaaggatgggaggagattccagagaatcaatgtccttgtgatggtcggggagaccacagcatctgcctcaggaaccaaatccactccaggcacacgccgctttccaggagcggacaggctaacagccctccctccaagcactggctggaggaagccccagtcctcagaaatggactccaggcctcatcccccagataagacaggtaacaaggcaagaaaggaggacaacccagaagaatcccacccagaggggtttatcccgtgcccctccagccctcccttgtgggagatattcaagagtgagctctccacagcagcctctgtctcttctctgtctgaaatcagaccccgtcccaggtctccagcctctcaagcccagctctaggaaatacaaaagtggccttcaaatgccttgaacgtggtgtggcaaagggtacctggtcccctgcccagggcagagctggccacctgctcctgcatcacctcccagtcatcaggggaatcgagacatcccttgtggacacctcccggagtgctcccaaagctccctatgtgtggcaggtccctgctggcctcctggggctgtgagcctctctttggcagacctggggcaggtggccagctctgctgtgacccttacttcctcacacacagatgtggggtcggcctagccagtggatgtgctgggtttcttcctaagctggctgagtagtactgtgcagggggacttgctgctggccggcattgcttttgtcatctctcggggagataggagggcccatttctgcaggcgtgcaccagtaccatggcacggtgtgtacactcatacctgttaccacttatggggctctcgctatgtgacaggcccgggttagagaattatggccttgttcctatgttctagttaggagtgttttctccattttacagatgaaagagtctgaggctcagcaagttacttctccaaagtcatcccattctatgccctgccagtaggtaccatgcacatggggagcctctagccagttcacccacttccgtgcctatcaacgagtgagggcccacctccgagtgccccttccagtctcgagacagcaggatgaggggacaagaggcagaagactgggcaggaaggacaagagcaagattcctccagggcggttcccctggacagccagggtgccagcccagtgaagttttctggctgctccgttagcagaggagcccagggcccctggtgcccctaaagctggccaccgaaaccccagatacatccctccctggggctgctcaggtgccacttccggtgcagctgtcagatgacacaaggtttaagctctcccatgtgtcagatcagagcagccagacacttctagactccggatggagttctgcacttgtgatgttcttgaggacacttcggtggaaaggaaagcaccacaacgcaggggtgcccctgggtaggtaaagggcagtggagtgggctggagacacacggcttttactttgattctgggcagggtggttaaaccaactgaagaccaggcatgaggtctttcaggtaacccccggcctcacaggcttggatgcgaaccagctggggaactccctaggtggctgcactcctggttacaagagcactggtctgagctttgcttagctgctcctctgcaggcagggtgggcagtgcctgctgctgacatttgtcacccctgcctgttgcaacctggaccctgctctgtaagagagtctcgtgctgaactccagaagcgcagggaaagatggagcttcaattcactcagagaaatgtggaaagaaaggatcagaaaacagccggaccagggtgagggaggggtggtggtggtggggaggggagtgattctttgaaactcaagagaggcctggagacctctggtgtggttttgtcccctggcacccgacttgaaagagctaaaatattcagagaatgtggagagagatttgtagtgggagggaaaaaatctgacaacaaaaccccaaccatctttgcattggaggagacaggaagtcagaggcgaagggagcttgaggagccggcagacagcagccacattcccctgcaacagagagaagcctgccccagctcccgattctgctccccacgtcacctgggagtaggaagccctcgccttggggaagctcagggcatgccacattttgtctcccttttcctcttccccttttcccagaagttcctggtctgaagagcagatgggaatctactccctgggggccaaggcctacacagaatgatctcctcctgctcaacacacagagccataaaacagacccagggttctgtggcaggtgggtgtggagccttcctgggcaagcagttactcctccccacctccagcccatccttggagctgccccgagccagtggggctgcctggggagggtctgattctgtgtgtttttctggatcaagtcccaaccctcccgtgatgctaacggttcctgggtgacgccatcctccccgggtccttcccatcaggcatcctcagtcatgctgtacggaaacactgccttcaacaaatcagagggcaaacgggcataacctccaggtctagcctttgtcgttcataaggcaggcaaaaaaggactgctggggacaggggaagaggaggaaggaggaagaggaagaagaggagaagagtgaagagggggaggaggaagaggagggaggagggaggaagaagaggagagagaagggagagcaggaggagggtacgaagaggaaagaggaggaggaagaggacagggaagaggagagaagaaggaagaagaggaggtggggaggaggggaggaggaagaggagggcaggaggaagaagagggaggaaggaggggaaggagagacccaggtttaccctactctaggctgtggggatgtgtgggcctctggccaccccacttacaaaatgctttagctatcatcaggatcatctacataacatgcaaaatgaaaatgaggggtcccttgtccaaaattcagtaagaatgtcatgatggggaaagcagaacttcaccaagctcggggcccttctcatgccctgtgactgctcagccaggaaatgggccctgcctcctggggaggaaatggcccccgttaggagacagcaggtgaccccaggcctgcaggcctctgtggcctgctcacagccaatgaccagaggctcctcaatcctagggcaggggagggctcaaggccaccggcacctgtggctctctttttggggctcagagaagtcccctggaaaggcctggcaggagcggtgaggatgcaaccagacctcagccttctgcatgttgttcagagtctggccttgcttcctgtccctgcagtgctgtctgagccagtcagtggccacttgccctgcccagcccagccttctccgcaggaggccaagccacccagggccagcactgtctgatcctcagctcagcccacatgccccctggggtctgcttcctgtcttctttccagccaattcccgcccctccaaaccaatgttatatttctcagtgcaatttggggtgggtagaagaaagggttgtgacgctgggggcagacacttgtatgtcgtgaggactgcaggtcactggcagccctggtgacccccactcccatccacacatggcaccatctgcagcgcacccgggctcatattctctcaggcctgtggagttctgcaggcaacttcttgctccacacacctgtccccacgccaccttaggcccgcaagggtgtcagcttctgctattagggactttgcagaagaatgactgaggatgctcaggacttagctaactcctgtgtgtattttaaaatgcaacccagaaaccctcttcccaggaagccttccattgcccctcctgggtgcttccaaagagccctgggcacgcttccatcccagttcttctctttaacacaagaaagggaccttggtttaccctggtgggcgctcagagacccccagcaggtttcctgagtgcctggctgggcaggtgccaagcctcacagcatccaggaggagggagatcaaactcagcaggtgtgggaggggctgcacttgcccatctggagcccggtcagaggctgctgaagaaatttcacattctgggcaggtgcgggctccacttcatttccttatcagggccctgacattcctctcccggaagccacagctgtgctgggacaacttcagagaagcaaggaggacttcaggaaggcagctccttccagtcccagtgtaccccaagacagctgcccttcctccagcccccttcttgctgatttggccaggcccatagtggtttcaccaccttgcaaattaagggctgaagcaacatacatactcctctccccctccatcaagattttaaaaggcagcccacggagttggatgttgttctagaaggcaggatgatgacgcagaatgcaattcaagtgtagaggttggaacgaacctttgttctgcagccttccagctgcagcatgggcaaacctcggcgtacactgggcacggcaggtatcaatgcacacaccctgccctccccatgcagtcaccgtgagagcctgagcaggtgacaggcacaaacagctgctctgtagactgtcacagacaggcaaaccttccaggctcactttggttttttgcttctgtgtctattttcttaaattgaaatgattttttcctccaaggcatagcagattggcaagcatccaactaggcactttcagagggcctgatcgtggccagtggtgatcagatgaggctaactgtgtgattaattgcttacaaagcttcccgtcccatgcccatcgcagctccgggaactcatggggcagttccttaggcccccagatgtgtaacttggaaagagtcagagcccaagtgagtcaatatcagtttctggttcaagtcactgacgttgcaaaaagaagaatgatttcccaaagcatcttatttcatgtatgtggaactctgctaggcactgccaaagaaagatattttcaaggtgaataataagattgcttggcaaatttcattttctagagggggtttacattctcttcttagcctctttttcacctgacttgttccctcaatttgctactttttcctccagcacttctctttttatttaaatagtttgatcacttggcttttatctttagataatcgtaaagaaagagtctccctttgttgttgttgttgggtaaaagagatgaggggaaatctctaaaatatcagaaatgggaaatgatccctggaccctctaacactccgaaaacggtattgccagccgaactctgctgcgtgtgtgcaaagagatcacgttacatgtctaacatagtgttagatactaataagctaatagctcaggtaactctcacaacactgatattgttgtctccattttgcaaatgatgaaacatgttgagaggggtttagtaacttgcaaaaggtcacacagcttccaggtttgtgccacttaattccaaggattttgtctcagccaacaggattactgggctcccatcatctctctcggacctggggctatctgcttcccccctatttataaaatagcctcacataaacagcaagggctttgtcagaagagtgacctttcagatgggggaggcctgaacaaaggcctactctcccctccctccaagtctgttcccagaacgtccttactgacacacgctcggggaaggcacatctaacaaagcgtcgaaagtggatgaagaacgcccctgccaggggagaatttgttctgtgtcaaagcctttgttttgctcttgcaaaagtctgagtgagagtcattgagttttccatgtttggaaaaaatccttttttccttccttcttcatttggtctttctaaaaaagcagttagggtttccctagtgatcattatttccttcactggggaaaagcctggtgcttctcctaggctgcagagtggaggcggtggccaactttgttcattgtattccccctggcagggcccagctgggttggcggcagctgggtacaagcccaggcaggtaggggcccctggctcaatagctccctcctgtagccctggttagaaacctggctggggccaaaagcgaaacctgcccctgccaaaaaggagctgggagggaaggaggggaagggctttcaaaaccaagacaccaaggatcggaaaaattaagcccaaggacttggcaggacaggtagctccagctaaaaataaaagtctggatgtaagactaactgcctttccccctttaacaaacaagaaaatccccctaaatgccaaatgcaaaagcactttcagaaaagacccgagtaaggctttatttcatcccccgtctccacccgccgtgtgatgttcccgcaggctggatggcaccgaacatcctccacagcgctgctcaccaggcacgaggttcttctcccccgccctttatggaacccatgagcgtagggtagggattactgagcgctgtcgggttggtgaagtccctccttcagaagcaactgctgggcctggggcaggagaacgaggatgatgggtccttaccagcccctgcagaccgggaccccctgcaggggctacacgaaccagctcagtgaactagctagctaaactagctccaggtgagcgctctgtcccctccacacccaatcaggctgcgagggctgccgggtccctggtttgcagtgcgtagacctggtcgggctgaaggctggagctcccaacctggctgactctttttgagggacgccaccatggtcaatcgacccctagcagcacattctggccaaaaccaggaaaaccctgagtgactgcccagctgtctcctgattagctgccttcttcctgttgcaactagaggcctagtttctaggccaagggcagcacccagactggcacccaggggccctccatcatggccactcttcctcttccaccataagccctaaaccctgccaaaggaggttgcccaaggcccagacggcaaggacagggctccaggagcagcccagggcctcaccaaggctccctgaccacccataagagggagcagggtccctccgggatacagagccacccccagatacggccccacactcactctctggcgtgcccactccaatccgtcagggcaagccatcccatacctgccccacctccaggtctgctgtgcaggtgctctgcccagaaagctctccctcctcccttctgtgtatccacatcctacctctccttccagcagatcccctggaatctgcaagctggccctaccttgtccctgaagtctctcaggccactctagccccacgccactcctggaatcctccctgaagctggagggagatgcaggatgtggatacgcagaagggaggagggagagcttcccagcagggcacctgcacagcagacctgcaggtggggcagggaagggaaaggaagctggggtgcttcgtgattcttgtgtgccataccatgtctcccagtggcaggaaggctcctggggaactggggatctgtcctaaccttctctatgtcccccaggctgcacagccggcaggaatccaatactcccggcatctggctgataagaggaccctgcggacccagcacatgctaagggcccaggcctggaagataaagcacacctacaccaaggctcacactgctttatgttcacctgctcacacctggatttttctagagacttctccaagtaacaagagggggcatatttgtgggaatttcctgtttggtctgcttgggtttctctccaggaccccacggctggcagcctggctggccccaggccccaggggtctttttcactcaagggtttggagggcaacctttcactcaggttagtcactgtttgctcactctcccatccctcaatctgtgatgcccttgctggcaggcaggggacatctcttcgtgggcatccccagtatcctgcaggagccagggacactggagacaccagcaaagaatgctcttccttagcgactctttcaggtctgcactccttccctcatccacactctataggagctggcatcaaaggggcctgcaatcttgctaaaccagagtctttttttggttactcaagaatcgaggtgtccttcacccaaaatggaaatgttcctaaccctccctattgggcagggcccagcaaatgctccatctctggtgagaaggtcattaacttggctcttccctcctcctctctcctggattccatcctcttaagaactaaaaataatgaagggctagaggagagaggcgagagaggaagaaggcacaggaaatgctgtgctgaacagaggcctcgcagagctcacaccaggggcctcgcagagctcacaccaggggcctctccaggcctcaaaggctgctgggcccggaggctaggaggggaccaacaataggaggaaacagggagtggccaaaggggctggggaagagcacgaggcggatgggcagcctttcgaggctgacttcctaatggataaagcccagaggacagaagggctcagcctttcctctgggaaagggcgcctgggctctgcccagctggttaagggccacccctgcaacacgcagcagatcctctcccgccctgcgctcatccactcctccccagagattttatttttactttggtaaatgcaaaacaacaaggccaagttacagagggtggaaatttaccaaaggccttcactgatcggcagacaattggcactgaagttctggaacctccgagcacccgcagagtccatcttgggccgctctctcagaggcgccagccaggggactcagccccatctccacccccaacacaccttcttgggaacagcttcctggtctggggagctagagttgcttaatccttcctttatagcccacagagaggtaaggcagggcaggagcgcagcccatagcatgcgagctgttctagtgccagttcaagaaatagctcgtgtgcttaccagagccagacacagggctgagtatttgctatgtgtgtgtgataagagtctctcaacccatcacagaggtgctgtcactgtcccacttcacagatgggaacactgaggcacagagtcatgagacaacttgcccaaggttctgtacatgtgtagtcaggcaggctggctgcggatccaagctcttcatcactctgctgggctgcctcatttcctgtcatgtggaacaggtaacattatagccagataaactgagatttagatcctgccactcctggctggtggcactaggcaagttaccaaacctctctgagcttcagtttcctcatctataaaatggaaataccatgtatcctaaagtattgttttcagggttaaattaaattctctgtgtgcagtgcctggtacatacacaagagcactcaacagaggcagatacattttgcatacctctcacgtatactgtctggtctgaccccctcaaggtcaagagcctatggatcggatgaactgtatgggagacagctctgtatgagcccagcagatgttagcagtagggtctgaccacctcctcttctatccctaatcccagccttgaatcccacctttccacaaggaaagggcagaaggtgtaggccacagccaggaggaagtggatccccaatgaaaagtcctattccttgacagaaacagagtctttctggaactccaaaatgcccaggagctactttctagtcgggtgtgagagggagtgcacggacgatgaggcagcctggcaggagagccactagaggctctcgtgtttcctgaaaatccccccacccaaacctcccccagggacctgggatctgaaataagtaactctgcctgttccccgggagactgagctgagcaacagggacacaggcagctctgccaggtggccacaagtggaaacagacttcttcatcccatgctggaggatgacatttacaaagccaggaatctaaaacgaagttttctgcagaaagttcaagaatctaaaatgccatcttctctccccaaagctctcccaggcacagccctgctaaaggaaacacacttacttctgtgtgaacagctctttagtaacccctggttctttttcagagattcctgagattgaaaaaacttcaggttatacattttaaaaccttaggatactactggatatagtagaagggacaagatttcctcaacctccaattgctaaaagtttacctctctaggccaagaacattaatggacaaaacactgccttttaattagtttctgggaatgcaaaaaagaccttgtaagagatttggttaagggggtcatcctggtctaaatccaaagccagagttttgggaactcccacttaaggaatttccaacaaggaaacttttgagggaggacttgaataccacatgacggcttataagcagttatcaagctacactggtgcaattcatatttctgacagattatgctgatgtgcctgtggctaaatggcactcagcaagtgagaatgcagactcgcagagagaaccagaaaccccaagctgctttccaaagaagcatctgcagccctgccccagcagtggccaatgcgcagctctgaattctgctatgagtcacccagcttccctctcctgaccagagctgttcagggtagagaccctgtgtctcggttcagcagtcatgcatctgttcacgtgcagacctctggaagcacaggaaacgggttgccaaaaagggacaccagagaacccccaagtatgagcaagactcatcagctctcagggctcagctgtcccccgggtcatcttgacggtatgtgtgacgatatgtgtgattttcataaacagattgactcatcgcccttccccgtgcatctctgtcaaccaggccctgctagtggcagtgggtgcttacttagcactttccccacgtgacaggagcctcccagggccccagaaaggcaggcaccagtctcgcctcctattaccagagcagcaaacagaggcaaaggtgcgctcctaggtttgtgtcccaatcggggcagaccttggggtcttgcccaaactcctaccctggaagcctgcacgccctactgcagccaggttctcccgcccaccgggagcagggacaccctgaaactgtttccttcacttcttgctttaggctacaatgattcaacatttctttcttttcttttttttttatgagacagggtcttgttctgtcacccaggctggagtggagtcagtggcgcaatcacggctcacctacagccttaactttctgggctcaagcaacccagcaatcctcctgcctcagcctccctagtagctgggactatatgcatataccaccatgcctgaataatttttgtattttttggtagagatggggttttgccgtgttgcccaggctggtcttgaagtcctggacttcaggtgaccaaagaagtgatccaccccccacggcctctcaaagtgctgggattacaggcgtgagccaccacgtccaggttaacatgtcttttatattgaggtattttgcagcagcttttgggatcattacagacagcatgggttttcacaaagtgaggtgaggatctcctatgagacaggcaaagaagggctgcaccccaggtccttcctgtcttctccctcagatttacagagaagcaaaaccaagaaacagagcatcgacatccgtagaggctggtccagttttctatctaagagatcttaaagcttggcccccacaaaagtcactctcttgcctgcacagcttacagaaggctcctggttctcttagacttgtttcatctccttcctactgagttagaggaaatgaaacattattgagggaatgcaagcaggttatctgaaaaatgtattctggaatgatagaggctgaagaacgggcttaaatgacttctgggagtccttccagtcagtgagcctgaacacaggcatgagagaggcacttggaggaatggtctgctttgtgcagtcaggatttaggtctcactaagcttggggcctctaggctcaggaggcaggagctgaacgagagcccctgaccatctccaaagagagcaaacctcctttgcaatgtccatctgctgtgtgccgggcagtacacgtatcgtggtgggacgaggggagagccttggggactctgtcccagggagaaggactccagactctcacaatgaccacggcctcttgcaggctcagcccctccaaggtctctggggagagctcacatttaggaactgttaacatcatttctagggaacagaaccagctggctgacttattccccttaactttcaatgctattattagggcacatctgtctcggagtgaagtcaccaaggaaaaacccagctgaagaaaatattttcaggcagtcgtcatttgaatcttcggaaaaggaagcgagccgataaactgccaaagagccccgggattcaaggtggccaaagaggcgcatggaaagtatttgccttgggaatgtgggcagctgagctatttacacagtgtgtggccagcacgacgcaaatggaccagaagctcctagaactgtttcctcttccctttcctttccccctttcccttaacaggatagccagccagcagaggctccctgtaaacctgagtcaggaggaaaggccgtgggtgagtgactagcagccaggtgatatagggcagaggccagcagactcaccttgtttggctacattttttttctaaattagttgctaacatttaaaaatcagattccacacaaaaatccgaattcccaacttctctttgaaatcctgggcctgtaatcccggacagcggcccctgcctggggctgagcagcagccacttaagatgggaccttctcttcccctgtcactgggtcccgctgacacaggtcacctgcccggcccctggtggcatttgagtttgagccgctggatttagagacaaaggggaaagtgctgaggaaagccaaagacctccactgtagtctactcactggccatgtcaacgcgggcaagtcacctactttgctgagctgctgtttctccctctgcaaacagaaatgaaaatgcacagcaaggcctcatccccaaaactgtagggaggactaggtaggaaaacacgggacatgcttgaaaacctgaacacacaccatgcaagtaagatgtggcccttcgggtctgaaagatgaaatagaacaccaagacaaaacgggcctctctgatgagatgagtagcggaggaaacgacagatcacacaaaagctacctcggtggtcaccggcgggggctgagatggaagccaggatttctaaaccacccagccccaccaacctggccctgcctgcggtaccacctccccacccagagaagtggaacatcactgtggtcgtggctgagcagtacctgactctgaccaacctctgcctctaattagttacaacacaatttagaacccgggatggttggcgtttgggacttgcagccacggcccagcccaggtgaggcgaggagacactcacggaagcacctgtggtggggccaggaggaagcctagcatcctggcaatgaaactcaacactcaaaatgctaggagtaaatcacagggcactgtggcctctggggatttcacagtgtagcggccaactgcattttgaggggtgacccaaaagctcctggccatctgcggtcttccccaccagcctgcctaaaaatgaaagaaatgacagacatgaccgcagagggctaccaatgggcttctcagaagataaagagaggtttaaatgataaaggcatcagtcctatatctgccccaaagccctccttaaggccacatgtggagagcgagcagctgtgataccagaagggagcacatggcacggtgggatctggtgcctgtcgtggcagcaatgactcaggccacccaatcagggcaagactcagcaaggtctgccagctcccatcaagccagaggcgctcagagggagaagctgtaagtgcttgctgctctcaggagcaagaggtcatcttgcttcttaccagctccttaccaaggcatcatatgtgacggacatggctccctggtgtccaggggctccaggggctctgggaagatagagcatgtgcagcgtcatgccccagcacactgaccccacagatctaatgggaccatgctgaacatatgaggatcacaaattccatgggagaccctaagatctaccctcagggacagctaaggcgattctggaacagggctgccaaaacagccagtcaatcactaaagttcctaatttaccaccctgacaactctccctacggctagcaccccttgctcttcctatctctccaggatcacaacagcctgtcctgccttgggtgtgccttcctgcaacccactctccactcatcagccttgcagatctttctaaaacatcaatctgatcatgccaatttcatcatgtccctcccctgctttaaaccttctgtggcttccctaaagcctgcaggacaaagaccacagaccacacatggactctcaagggctctcgcctctccccaccaatgcgtcccttcactccctgggctgttgcaaaactgatctggttgtgtttgccaacacacaccacactgcttcatgctcctgaaccttttgtgctggcccctctggctggaagacccttcccctaacctaccgagagaactcttcttcattctttaccatgcgcaattatcacctcctctttgcactttttgcccaatgcactcaaaaaggctaatcgcttctcccctatacctcacacacgcatctgcttctctgctgagaggacattcacgtgatctggtgatgacatgagtgttacccccactagagtgagcattccttgaggactggaaatggccagttcattgctgaacccctaggccctacctggcacactgctttcccagagttgggaatcgataaatataggctaacataaacatgtgggaaccccgccaagacccaagagtctggttgagaaagcggaagagtgctcagaatgcctagcccttactgtggggtctggcttaagggcggggtttctgaagcagaaaggtaagttaagtaagggttgcctcacacccagaggccaagaaccagaggcagcagcatccagactcagtgaggtcccacaaccagggccagcccatcagggagagaggcaaacaagaggagctctggaaccaggacccaggcaggtaacctgggctggctcctggactcctttgtccaatcagaccacccacattttctgacatcagtgctgtccctggatgcactgggcacagctgtgagtgctttctcctgcagatctgggatagggctacaggaattcagaagaggaagctattactttgggagaaaaagggaaaaaattaaaaattaaggaagcttcatggaaaaggtgacatttaagctaagtcttaaaaagatgaggaaaatgtgtgtgtgtgtgtgtgtgtgtgtgtgcgcgcgcgcgtgcgaagtggaggttggtatttcaggattgagaaaagcataagcaaaagcctagaagcaaaaaagcaccaacagcacagccaacagcacagccaacagcacagccaacagcttggctcagctcagcactaagggcctggcacggagcagtttgccccagagggaggcaaaaagagggaaaattgtctgtaaggaatttaaaacaatactgaaactgatgggctttttaccatgaccatgagctggcgattctgatttaaacataatccaacacctcccccaacaaccttttgtctaattctgaacaattgctgcattattcttgacttttaataatatatgtaagcttcaaattcacacagactaattaccttttcataaacattacattctctatggaagttaattcaaataactcatattaatagttgcaaagccagcccctgacacccgtggactcagctacccatgtttcaagagcaagttcacaggattcggtatcagtggcactcactttggggtggctcgtcccccgagtcctgtggtacgatgtgttcctaagcttgaagaccagaccaaaaataaaggctggaagcacagtcattgtaaagacaaagaaatagaacctgggctattccatcctctcattctaccagaccacttgggagtttctatttatgtttctgacttttcaacaatgagatgttaatcaatcctgaagaactgaagaacaggactttgttgcaatgtctggaatttactgtgaaatgggattgttgtgaatttctgccaaattttatgtttaagatttatcctatttgtatatctgctgtttcaaccaaaagaaatttttcaaaattaacaggaataaaaagtgctctgcgaccagctttgagggaagatagaccaacaaatgcggctttgtctattgatcatgatgaatagggaaagatcagtatttacgaagtctgatcaatttacagaagactcaaaaccagaaactatagtttttattcattactgctacagaccactatgaaagtgtaacctttcccctttttcaaaataagcattagcgtcattaaattcattactccctgcccccctttttttattgctggcatcatatacacaaaattcaataatagaaatgtttaactgtctgaaattattttctggccattatcatcatcattattatttatttcttaattattgaaataattttgttactatagaagaggggagtattttaaaaaatctactcctgagctgggcatggtggctcacgcctgtaatcccaacactttgggaggccgaggcgggtggatcacctgaggtcaggagttcgagaccagcctggccaacatggtgaaactccgtctctagtaaaaatacaaaaattagccgggcgtggtggcgggcgcctgggctgaggctggagaatcgcttgaacccaggaggcggaggttgcagtgagcggagatcgcgccattgaattctagcctgggcaacaagagcgaaactctgtctcaaaaaaaaaaaaaaatgtactcctggtgtaaaatatgctagatgcaccactgattcagcttcccaacaagaaggtcctaagagaacagaaggtgagtcttctggaataacaaagccaacatcaccacaggcctcaactgccaggctaatgaacttggactactgtctctaggtaaataacagagaaaattaccaagaactatgactatccaaaacgtgaaaactcaaagtatcaaaagcaaagacacctgcaaaccaaagcagaagtcaaataaactgcagaaaatattttacaaaataaagtatgcttgaagggttaagttttatatacaaagaactcaaacaaatgggtaaaaacaatctcaggtgccagtagataacctggcaacatacatataattcaacatacatataatgaaataataatatatgtttgcctattagcaacaaaaaaaatgtttttttggtttgttttttttttgtttttgtttttctgagatgttgtctcgaactgtcgcccaggctggagtgcagctgcacaatcccagctcactgcaacctccgcctccaggggtcaagcaattctcctgcctcaacctcctgagtagcctggactagaagatgcacgccaccatgcctggctaatttttgtatttttagtagagatggggtttcactacttgcctcagctggtctcgaacccctgacctcaagtgatccgcctgcctcgccctcccaaaatgctgggattacaggcgtgagccaccaagctccgccgcaaaaaaaaaaaaaaaaaaaaaaaaaaaaatttcaatagtgaatcctagtgttggtgaggaggagagtaaggtgtgatacatgccaacccactgctgggaggcatccccaagacacatgaccttttgggaaagcagcccaggaatattctgcaagggccataaaaatgtttcaacctttcagttatttattttacctctggaaatctacttaaggaaatactccaaaaaacggaaaaagttacatgcaccaagatgttaattatgccattgtttctaataacaatagtagtgaaaatagcccaacttccaacaacagaggatgattaaacaaattagaggcacatccttgggatggatcgttcagtccttaactatcagggttaagaaagaaacgtggaaaatgttgctataagattaaggggcagggagcagaattagctacggaaaatatacagacttaggctaagaagaaatataccaatttataagagtagttgtactaatacgcatttctgcacattaactttatactggctttgatcaacgatttaaccctttgctctcatttctcagttattatattctattgcactacatgcatatttgtaagtatccacaaatcttttgaataaggtagaatacaaattaaccaattaattaataatgcatagaatcaagctgtttcatcattatgatcgtagggttatgatgatacctattctttttattttcgaaatttctgtagcctggttagtttgcttttacaatgtaaaaaatatacagaacaccaaataaacaagtaacataaagaaactgctaccatatcttacaccttcagtgctccttcctatatttgatctgagaacacagcactctccaaaatgtcccttcagctaagggagaaatagggctttcttcctgtaggttctgtgagctcaggactgaaaactgttccctgaatgggttgactgctccgtgaagaccccaaggatctctagaagcccaggaacattagtggaggaccattcggatgacagacagcagctagactcctagggtggaggcgccttcccaatattcaaacaacatgggtaagaacaggatcagaaaagagactgatgtgggaaacccttccacaaagaacagatcaaaggagtgagcccctgagggcagggaccgtggaatccatctttgtactccttgctacaaatgtgatgccaagtaaaagaacccaataaatgctgttgctaatggattcacgcatgcatgcacacatgcattcactgttggacaaatatttacagatgtgccactgttctagccgcaggtgatttagcagtgaacacaacgaagtccctatccttaaagcagcttacattctaagtggggacaggcagatgataaacaaataaagacatattgcatcaggcagctatgagcatcctgaagataaataaagccaggtaggggaaaagggagaaccccagggaggcggggagaggggtgtgctggcttagttggccatggtctttctgcaggaagtgaggggctgagccatacacaggcagagggtatggcactgcagacagagggagcggtcaagtgcacaggctttgagacaggtgtgtgggcagcttcaaaggccagcaggaacagcaaagtggctggaacagagtaaacaaagaggagaatatatcacatatgaggtcagttcttgcagagttttttaggctgttcttaggacttcggattttatgtcagtgagataggaagctgctggagggttttgagtgaggagtgtcatagtctggcttatgttctaaaaggctcacgctgcttctgtgtgtacacctggggaacagaaagcaggcgagaaagggtgaaaacaagaaagatccattttgaagctgctgtaattgtccaagtgagagaggaagatggatttttttaaaactctccattttagactgagaaataaaaattttttatctgagaatccaagccccctttaattatcaaacccagagaggcaccgaaatgtgacagcgtgtgacagcgatcacgtctcactccccgcctgagctaaataatcacctcttgaagccacttgctatgtgggctcaagactaactgatgctaagtagccataaaatgacatatgcttgacaccatcactcgtactccatagttcaacagtgtagagcaatcactatccaatgttatctctgtaaaccagggaggattcctgtcaaacaactttgtatcagcccacttccttgttccttttgcctttgaaaacctgcttgtaacaaaggccaaacagagcactccccaaggcaacttggaagtgtgtcctgggcagctgtcctccaccttggctcagatattaggtcgacaagaccacggctgtctttcggtgtgaggcatatggcttcttctcactcccactctaacctggagctgcaatccctgctgaaagaattgccctctaaaggcctaaggatctcagcaacagggaagtgggaggaatcttcatgccagagataaagagctggtccatgggcatgtgtgggaagcactggggtagggcgaagaaatctatctcctgggaggtgttatcactacataaatcccagatttgatcaggcaatgtagccatctcactatttcaggctgcagctgctaagacaggtgtgaagtgggcagacaaacaggaagaaggtcccaggtggagaacctgcatttggcttctgtaccccaattccagtaattaacaaagcaaaaacctgccacactgtgaatgatggcccttcccaaccagaatcctgtttctgacaagtggtgaagacactctaaaatgcaccgagtgtatgacaaggacaatcttctggatattcccatttaaacagggatgggccggatgcagtagctcatgcctgtaatcccaacactttgggaggctgaggcaggaggactgcttgaggccaggagttcaagaccagcctgggcaacatggtgagaccccttgtctctataaaaaacacaaaaattagccaggtgtggtggcgcgcacctgtggtcccagctactcgggaggctgaggcaggaggattgcttgaacacaggggtagaggctgccatgttcgtgccactgcactccagcctgggtgacagagcatgaccctgtctcaaaaaacaataaataaaataaaacagggatgaactggagaaactgtgaaggtataggtgctgtcttgcttaggggtggggatgatttacggaaggctaacacaagggccttggttagtctaaagataatcacggcaactaggtggtggtaccaggaactagtccaccaaatcccaacctgcagccaaaaagtctcaactctcacctataaagggatccttctaaattctctagatgtatggaaatctttgacaggtcttctgaagcctagagtcatcgtataaacatagataaatagtgtagatattgcatagctatagattgatatgtacatataccatatacattagatatatgctatatatttacacttcttggcctttcggctttattatctatctccacaaagtaggacaagacaagcttgtttcccatttaagtttttctatctgtactgttttgcaaatccaccagagagttgcaggacactcctgctacagaaagatttctgccaggcaggctcagagacctgctctgttactgttctatttaataacacaaacacacaaatgggggcctttcttccccatgactttcatggcatggctgggggcagagctgggaggttttcacggcccatatatcctcaaactgctccatttccccccgatctcagttgccaccccactaactccggggtgatcagctccataccacaatcatctcctggtgatagagttccatggattttaaaagctgtaagaaaaactgagacagattcagaagagattctagtaaccccaaaccagcaattacaaatattttttaagtatttatatatacacatttttttttgagacagagtctcactgttgcccaggctggagggcagtggcaccatctcggctcactgcaacctccaactcccaggttcaaaccaatctcctgcctcagcctccgagtagctgggattacaggcacctgccaccacacttggctgatttttgtagttttagtagagatggggtttcaccatcttggccaggctagttttgaactcctgacctcgtgatccacccacctcagcctcccatagtgctggaattacaggcgtgagccactgtgcctggcctaatttttgtatttttagttagagacggggtttcactatgttggccaggctggtctcgaacttctgacctcaggtgatctgcccgccttggcctcccaaagtgctgggattaaaggagtgagccaccacacccagccacaagttttagatacttaaaatacttttaagtatctaaaattagcacctctctttaaaccttttactcaccctttcctgaccctttccttgtatcccccattccctttcgatttcttcaccatccctatttgcctccttttcctcactatctacccaccaagtcctgctctgctcccatcccacttaagattttcgtgtctattctgtatcacccttaatgatccactgaggctgtgagcttcctgtttacccacaagcgttcagcggatccagccatcctaccaagggttaaagatgctgtagtcctactgtgctgcctccgacccagttccttccaaaacaaagcaggatgacaaggtgactccacgagaactgcgtttgacctctgtgtgggttttctgtttccaaggccacagcagggtactctgaaaactctaaaccagaaggaaaggagacctagccttcagaactctgtgtgtatgtgcttacaggcaaaaaaaaaaaaaaaaaaaaaaaaaggaaccaatgaggttgtcagaaggggatactctgctgtaactggtgtttaccacgacccaccgggtgctgaggaggaagtggttgctataaccccaagggggaaacgctcgcttgaaacaggaaaatagaactcttacaactttccattagcagcgttcaagaagccggccacactgggaaacacttgcacaagcactccccagagtcctgagacgagtgtcaagacagtccaatcacgaagcacagatcaggacacagatacaggtccatgttttttccagaacgtctcagcactggaaaaactctcatgatcacttcccttacctccagcaggctgaacttgcaaggagctgtggggaggaggaaggaaggggaaaatggcaggatgacatattggaaagaacgctgggcccagtgagggtcagaagacctgggctttagtcccagttctgcgatttactagtggtggaactttgggcaaattacccaaccttcctgcttctcgatttctacttcctctataaaacagggatattgtttactgctctgctcacatccttgggctgctgtgagaatcctatggaatccttcataggatgaaactcgtatgtgctacgcaaatgcttgttatcaatgtaagattcgagtctgcataaagccttcttgagtcccagcctcttgctcctcaaacgcatcctctcggctacacttccacctgtgcacttcctcaacccaccttacttgtaattctgcccacacttctgtagaatttctgtagaagatcccatagtctggtcagaggagtataagcaagtctaaataaccaaagtggggggatctcaaccaaatcatttgactctgggctctgtgctcccacattctctcctctccagaggtgaagacttcatcctcaatggctaatttgcctgcttggaggctcagattggcccgtgttctgagtcatattttccatttagtaaaatgaacatctggctgctgtatgatgccttttgtgtaccatcacctaagccacaattacctgcaaggtaattcataccactacagcacggtgcaaaaacagggttggtttgggatggtgaaagtcagccatcttagtgtcaatcttgcatgcaaattctaatgaagaaaagccactaccagcaggtccacacacactcacaaagaactcataaattattttaatccaagcgttcaaagggatcctgggtcccaggaaccatcctgctgtttcatctcagtgagaggcaagatggttaaggaaaaacagctctagtttcctccatccccccaattcccctaccggtgtgaccttgactaggccacccaaccttctaaaaaccttggcttcctcatctgcaaaatagggataataacaagacatgcccttcccggctcccagggttattatggcaaccaagtgagaaaacagatgtgaaagtgctttgcaaaccacaaaacaccgtccaagtgtgaggtattgttatctagcaaaagtgccttgagaataacacagaaatctggaagtattttaattcgttaatggacttataccacaccttgacttaaaaaggacgtagggtaactgcctggaggaattctgaaataatttctaaataagtttatccaagcaagttgccaaaacaatccactgaattgggtagtaggcttttggataataggaaaactgcagatcgctgttctttattcttatttcaccttttgagctctaaaaagaactggaaggaccatattgtgttgtcttttacgcaagaactaaacagtctctttgtaccctccacaccctccctattctcacttccatcccctgagcacctgggaagcagctccttctccaaacctgcaaaccctcctcccagagcccaggctagcttggaagcctggagcaatttgaaacgccgtcctaagatcttgaggccaaaggcatccccatcatccttccaagagggtgttacccccagggacagcaggagtttccagaacacacaaagacttattctgctcacaaggatatttaccgaatcagcccacaagaatttgccaggatcagggcagaagaacagagctgggacagccttctgattcactgcctggcagattcacccttctctattattagcaacccaggcacgatgccaccagggctggggagagaccttggtgtcagggtagagaaggcaggaagaggtgtgtgtgcagagggggaagtacacagagctgcctgaggtttcctccagagagagacagcagaggggtgggttaaagccttctccccttcctccttagttctctaacctcctgtgaatctcagacaagcccagccccaggatcagaagccctggaacccacatccaccctgaatattgctggaggtactccctcttccccttaagggcccagctcagagctgcacagcactgcttctgccggataccactggactctgggctgtgccagaggctgcaagatggagaagcaaagagaaactgacgggaaaggtggagaatttctcttcccatggcaaaaatgcaacttactgcagccctaatgcacatgtgttccctcctcataacaatgactaccactgaaagagcacccattacatacatcacagggcgttcgcctcctgttataggcaggaaaacaaccatgtggaggctcagcaggctgccctggagaacgtggctaatgctgattgagagggacaggactgaaggaggagacgaggagcttcaccttcatgcatcttgtattatttcacttgtacaggtatttcgcgtgcattatttaacgtgctatatcaagcttgtacaggcattacttgaatacattgaaaaccatgaaacgaaggaattaaaaaaaagaaagacatgttgccagtcaatagtagagtctagatttggatagatttgtccaactccagaatatactctctggccacacctccacaatttgtccaaataccaaaccaggacatggacgctaacaaagactatttttctaatgttattcatgtgaagaattttacaaaataaccaataaccaaataacatttggttattaaatatgataaatgtggcctatggaaaataaaacgacacaaaatgaaaactggctgccatgcaaacttaggagagggcaaaggagccacagtgaccccagacttgctttccctaaagggggaggaaaatcaaatcccctgcagatggctgcagacctcaaatagagtgctgccactgagggcagaggccgagcccctggagcaggctgattagtctagtctagtggttaggaacatggtctctggagccaggctgagtgtgaattctggctctgttcttcatagctgtgacttcaggcaagcttatctgtgccccattggtttcctcacctgtgaaatgaatttgggacactgtgtagattaaaatgtaaagtgtctagcactaaacactacctaagtgttcattattattatcattatcagtcctggccagagagaaaaagggagaattatctattccaaaaggagccaggactgggataaggctttggtgagctttttacgtggtcttgacaacggtgttcatgataggcttattctaggccgctctctgctgtcaggaaggaggtttcctgtgtgaagagaaggcctcccaggaagtgacaatagaggtatcaatactcccagcaagagaaccacaggcccagagtggatgtcagaaagaggggcatctcagggagcacgcctctgcggagggctactgatgaggaagagaccacatggttgcctagaaggcaggcctgcggggaagcactgacgccagcactcaggctaggggagtccctggggtcaacttgtgcagagactggcgctcatatcccaaagaactgggtgcctctctaagatagagctccctgcctcccagtatctcttcctgcaggtgttttgttccaatggctgacagcgtctattcagaattcttaaaaatgtcactttgtttccatctgtaaaaaggaattaaaatgtaccaaaattccaaagaaaattgccccttttcagatgtggctccctgtctcccctcttcccttttctgcttttgatcttatttaaaatctctgacctaaaagtgaactctgatattccatgctcctggagttttgggaggaccctgacttcagaagcagaactctttgagttcttctggttccagctctgcagctaatttggaaaccccaagaaagttgtgtcacttctgtctcagtccagaaagtggaaagattaaccacataaactcaaaaatactatctggctctgaaatgctgtgttcttgggatagtctcaaaaaagctgagttgtggggactaacctaagtcgatattctacctcccttttgaactgatgttgaaagaagaaagacgataaaagaaggttttcctcatcagtcattcaagactatacttaaaattacattttgcagaaataaaagcagtatttttaatgttaggaaaaagtctaaaagggtgactacgggtgattttcatttctttatagttttctgtatttatccaatgatctgtaatggacatgtcacagtttaaaactcaacttaaaggttattgctctaaattcgattttgctggggagaaggttaggagtctggcttctgaaagcgtccttttcaccagtgaaactgccctcactcccaaccctgcagcaaacccgggaagagttaaagcgcaggccaggcggagagggcagggagaaaagggaactgcaaaaagcctcaacacccagtagatttcctactgctgctgacactttggcccagcgtctgcgcctccgaccagcttacggaaccaaccacacctcgatcctaacacatcacctgtgagagcagggtcaactctccagcggcctcagatggcctcaaactaagcttggggaggggttttcaaccctgaaagcccagaactgagcctccaggcagcgcagcgcccgcgaccacgtgagcacggacccacctccccagcctttccatgacgtgactgctggggcggggatggggcggggcacacccagctgcccaaatcagcatgaccccaaaagagcaagcgagttcctgaaattccttgaggtttgaaagacagcttagagatcctaagtcccttttggcagagaggggggaggtagggaagcctgagggcatcccagaaccagcaggaggcacagaaatgtgtcagctctttccccaagagaggaggcaatgctgaatgtgttaggtagggtccttttccgggaccagctggtgaaccgatgtgaagagtcggctctaatgattacttgtattaagttatccacgattcttatgaaaaaggaaagcaaatatcccacagtacaagaaggaaagaaaagggggccccaggcttttcagcaagggcgtttggaaagagatggatattgatgatagggacttttcagagaccaggctcagcccagttgggatgcaactcaggaaagtcagatcgagggaactaaaccaaggtactgttggccaagagacattttaaacgctttttctcaccaggattcataaagcccttttgccttgaagcccatagggcacaggagagctaccctgtccctgggacaaacgggaaaatgttcagccccatcctgggtgaatgcaagacctctgccacccccaacacacacaccctgtgactaccctaagtggatgtgttctttcacgttgctaagaaaaagtccgcagctatgaagtggtcagcctctgaggtccagtcattgccctgacaagactttgagatgcatgctctctgaaactcccctcccctcacctggcaaaaattattcatgccatccttgatagcctttcagctgagcgccttggtcagaaaactaaccacctgcctcttctcaccatgtcaaacccagtcgtctggtgagaagacctaacgtggggtgcttctcagtccacagacagtgttgctggttccgaggccagattgttcctttcttcctagcctgtgaataacactcccacctagaaccagcccttttgctcttaaggggttacacttcatttccctttgatttagccagaaagtttaccattgcagacacctccatctgtaaaattgggcagagaaggcagggaaagcaattaatatgtgttgagtgtgttctctgagcctaccattatgcaagacagcttgtgtgtccattctctaagttggtcttcacaaccaccctggcaagggcacagagttggtaagtgcagaaaatttgataaatccagagcccaaatctaacccaggatttccctatgccaggctgctttcctgcaatcgcctggggcatacagaaaaatacctatattgaggtaaaaggtttgatttaaaaattaaatataaacattttcttttaaagcccaatttgcatatttttgcattgtgcagatttggatctgtgcttcatcctctcccacctgcaacaacatttaaatgcctcagcctgggcactaaaaaagggagcaaatgcaggtctactagctggccatgtttttggcaaccctgcaaaacaaaatttccaactctccagatgatacccctgcctcctccaaaacaaatgcctgtactccagcatctgtcactcaggagtccaagctgggagttcagacgctgcttataagctcataggctgaatgagggcattacataaaaaggctcagagctatgtggaagcagtgtagaagcaatgtcagcagtccacctaaaggcctggctgaagaatttctcagcctcctaaaggatccccaggcagctgccaccatctcatctccagtagtcaaaggaccaccactagctgaaggctgggagggcaatgcagtggtccttgaccttggctgcacatcagttatcacctgggagttttacaaccattgttgcctgggtccccccccgccccgagattctggcttagttggtgtggagtgtagtctagcacagggatttatttgttaagctcccacatgtttccaaagtgcagtcttggcaagaaccactggacaccattggtcaaagtggcccaaaagagctaggaaaatataaataacattcagcaggtcattcagggttcttgagaacagagaatgaccgaagggacttctgtgtactggcagtgcaaggcaaggtagcaacatagagcaaagggtttggagcaaagcaagcagaaatttgagtcctagctccagcattttgcccaccatgtgacctgggtaaagccactcattcattctgagccttagtttcctcacctgtaaaatgaggctgcttcccttgctggactgtgctaggaattagctgcactagggcattgcctggcacatacaaggtcttccataagtgacacttatgattgttaataaacaaattacacctgggattgactggtgtttggtatgaagagaggctgtgggctgacagtacccttcagaggggacccctttagtgaatgagattcagacttccttggggaggagctgtggaagataaaagaagctgaaagtggtataggagacaggcagggcagccactccagcatctggggcacctccagcctttgttctccatctctagtccctttttctctgcaagttgagcctcaggaggaggtgtatatttacagggagagtctagctgtatttggccacgttctacctaccaaagtgggtagcaatcagactggattgtgtcaccctggattgtgtcatccgaagcagctctgcccaagacaggtctgtctgcccacagactcacacctgccttttccctcctactttacaccatgatgctctgagggaagccaggccctagaggggcagccagcactgcaacctgtcactgtgctgtccacgcttgcataaacctgggtggaagacacagaccctgggaatgtgtgacaactgtcccaaggcagagagggctggggaatcccaactctgcaacacctcccccttcgtgctttgagcagcccagcataaaggaacccactgcctacatgattctttctccttttccttttctctcctttctcccctaacacctgtagagttgatggagctctttctcatccattatttcttatgatgttcaaaacagccctgtgaggcagctgactgcaggaactaagatgacctggattcatcggtaagaaaacagaggctcaggcagatgccatgacttgctcccagtcacagaactcatcagaaacaggatttgaacccatgtatatgtaccaagaacccattcttctccaccatgctatgccccatgaccgcctacccatgtcaaaggccctcctgcttgctgtgtagtataagacatctgtgaagtggagacggtggcgggggaaggggagtgtagacatgcaactaatctaagctctagctgaactcagagtccccccgacttgatgctccattctaaaactgagtttgagcaacacatcattccctcttttctatgcctctctcctttcttcatctgagaaaatggcaaagccagctacccaaggacaggctggaggaggactcaaaatcaaccaccaaacatcttacaacatctgtgcctcagaacacagctttcatcttaccaaacttcactttaaagaaatgaaggtaccacaaggtaccttcattacaaagagattttgttcaattgctgggccaaagtgggaaatattaaattccagtcaaagaaggtatggatatcctgctaattccctgaggcatgttccatactgacaaaccatctgactttctgagtgtcagggaaatttccaatccaaagagtaaatgaacttccgtgagtagaaaaatagcctcttcacagcacccgattctctcccaccaagaattctctctcacctttcgcatgcagtactgacgttggggccattaggaacaaaacgaaggggaaggaaatggcaccagtccaggtgttaccagacggatatgtgaaagcaagtgtagaatcacccccaagaaactcaaagtaggagaagcacttgctcatctgttaccagatactcactgtccagctggccagcctagtgcatgcttccagaaggagaccagcaccagccagggagcagagcagtcaacctgtgcaccccaccatcctccctcgaaagcctgcatggaaggcctgcatttggattcacagagcagccattctttcaatgagcatagcagagcaggatagagcaacactttttttttctttaaccagggaaggggacccacagaggcagtacatacaaacctgaaatcagacttgttctagaactggggtctcttaaaagcccttcttctcaggcacagggtcctttccacaatagagaacactggtgaaccagctctgggaaaggtcagctaccgaaatgcagatgattgcatgcaaagatctcaggccttgtgcttttcaaatgatatcctcatatgttctttcatttgctctgcatggagactccagaaggttaagcagtcactcatatataacttacaggtaacaaaacccaagtacagagggccccaaagacgtccctagaggcacacaggtgggaccagagtccagatctgccaaggccactgagctgctctgcccatcatggagggcccctgcctgcctccagcgctccaccgttcacacccctgggtcaacattcccagggtggcagatgctgaacccacaatcagccaactcacaggtcctacatggggagagtggaatggggtcaggaaaaaccattgctttccttttccctttgaatgcctgagtagacatttaagccaagctggggaatgaaggagttggcctctgccccaagagggaaacagcccttcaacgggaacaacacagtaagagattcatccaagagtccctgtcttcagagctacctccctacacctccatctgcggacgcccctttcaaaactcaacctgtcctcttgccatccacaggatgttttaatttccttagaatgtggcacttcaaaattcagctcgtgctgagctcagtgttcagcaccctggctccacgcatgcccgctctgccccacccctgcccctaagtcctggcgacattgacccactcaccatttcccggtcccgccacattctctcgggtttcctggccattgctcacgtggaccttcaacttggaatcatctttccctccctgtccagccactgaagtccaactcaacagtaaagatgttattgactgtcccctctcccacagagcctccacagatgagctctgggcctcccagcaggctccagggcagtagctgttcttccctgtctgcacccacacggcatgaccctgccctcacaggcctccctgcagcctctacccaacgactctgtgatctgactgcatgtctctgtgaccagtgacacctccacgtcctcaagggcaggcaccagggcttgctgggctggaatgttcagcatgtaacaggtgtttagttcattgtttataaaatggacacatgagttaactaattaaaagctccacaacattgtacaaggaaaaaaaattccactttctcatccatgaagctctggagctggggaaatgaagcggctggctgctgggtgccgcggtgagctgtggggcagcacgaggaaggttctgagccaatgaatgtgatgcaagacaagaaactgaggatgggggaggaaacgagaaagagtgagggagaagaggagggggatgatgaagattccaacctgagacattattgcagaaagcaaccccaggttaacaaggcaagttgctaaaggaaagggaatggcagataaagcgaccccccgccctaaaaggcttaccagggcacttcagcagaacccaagggaaagccatgtgggccagcaggcttccgaaccagttctgtctgctctaatgaggccatgggggtggatgggcagggggcaaatcacagaagcatctgctcttgaatcaacagtgaggctctggctggctgaagaatgtctccaactccctagtcacccagtgggcctaatttcattcctggacatgtctagtatagattgaaagggaagccatagtcagtttcaaaaagaagtggaaaagttccctggggttcactgagataccattattagattggggttcccaggagcatttcttgttaagtgtcaagtccagagtttgacctttggggaaatgggggaaattcaaaaggatcaaagcccccaaactccctttagctcagtgggaaaaacccaaagctcctgccctgcctctgtgcatcctctggggccctgaaactgcgtcagcgtgcggtgtaacgtgccctccatcccagcacagacataacacaacgtaaaactcattaaagaccagaggactctgtacctatctggcactaaaaggagatctcctgccacatgtctcccatctggattctttcatgaaagatcatgtgtagctgtgcacaatgtcgaaaaaggacatcccaaagggtttaggtgtgtgtccgtttttcctaaggcttgtcctggggtgccaagtgtgcacatgccactgtgccctgggggccacatatggctgacttatctggcaatgggaggggacagagcagaactggaggtagagaaaaacgtgcagggagagtgagttattgccaagaggatttgactgtgctgtgacaacagaagtcccctgggtcttcaagcctcaggctgggatgctataatctggaacctccagggagtaacatcaccaggtgctggcagggactaacgtcctgcctcactgatgtggcacaagtcatttgctgccttgggtctctagtactgtatatttgtagtcagtgagcaaaaaggaatatttaaaaaaggaatctttctatagcgtcatttacacttgggccaaaataagatcagagtggaacaaaataaaatctggtcaagaagagaaggcagaaatagtgcagaatgctgccaaatatttccaccatgagatatagaaccgtaagttattcataagagagctcttcagagtcatgagtctatggcttccatcctcgggatgaaaacaaaaatctcacccactgtccacagtgaaacaaccaaaagtgggccttaaaggggaacactagggtttggagtcttctgtgccatctgccctcccacatcacaccctgatcccttgtttccagcctccagctcagaggccaacataggaacagcctctaccctctgtccctggaacagctttttccactgagaccaagggtgctgcccgctgtaaaggaacatgaatgagctcagaaaccacatctgcttttgcacttgtcaacttgaggctggcaaaactgaggggttccatgaaactgcagccccagcagttccagcactgtagggagcacttacctagagacacagtgccctcctgccctcctgtggccttgcttggcacagaggggccacacagataccaactgtgggaaggatctctagctgggcagcatcgccattgctcctcattgtccaggggccttttgtgtgtggctctctactcaagaccatagggatggaggtaaaaagattaaaaagatactgcttccgagtttcctcaaggagctcaccaacttccccaggtgtctggggaggaggaaagagcagctcctacaacctcaagagtctttgccaggaccagccaagggagtgtctgtaacaactatttttaaaaagaaaccaggataaagctcccaattgccctacgttttccttaggagaaatacacccaaagtagaagccataccaagtctcaggcccaagcctctggcaagaaaaaacaaatgggcttagcacttctgatagggttcacacttctgatagggttcagcaatgattaagcccctatgaaatggcaaatagtgacattatcatacaagagatccctgcagccctggagggttccagaaaagagcatagccttttaaactgcagctgcctatatatggcaggtaccatgctggcactggaaatgcaaagacgaattagacaacatcccttggggagctgttttgcagagctgttccgggaaactcagaatgtaaccacccccactcctgaccgccccccatcaggattgtctcgtgtgttcagggtcccacagaacccaagccaagagtcacccccactctgtatctttggcattagatagtaatgagggccaagaggagaggacagaaaaggaggtcttccatctgcaaagcaactcttgacagcagcagcccagctgctcggggccactgcccaaaatgctaatgaagccagtcacaattagcaggctactcaggggctgcccagaccacagagctgctgccacagtcagctgtgccagagcagcctgccgggtcccaggcagagcttttatgctagcactttctccttcccctttcacctggcatttggaatccaccaacaatctttgtacccttctctctgcctgacccacaaaaccacccaaggacgctggtatgactctcactgataaagtcaaagacagatgggtagggatagggatgggaattgggagaagggtccagaaaaaatgatttggactctttttgctcccattaccaaccactccattttcccccccaacaaacaagtgcttccccactttactgacatctggattccactggctagttccactagcttgggagcaagtttgctctccgacctctttagagtattcagcagatggtgatcaacacagccctctccaaggagagacgtttagctttatgaaaattcctaaagaaagccactgggatatgttttcgtgccaagacatctgacaactggcctatttttaaagttccaaccaataatctctcaaaagcactctacccacagacaaaggggcaatgacgaaaaaagtaatgaggccagtattatgtttttgtttttcaaacaatccagaatttacccatccaaataaataatattctcttcaaagcctacccccttagaaagctctgtgctgattccactggggctgtgttttctcagaacatttttggaaagtcctattgtggagcagcctttgtttcccagagagtgtccaggataaagttaataagcatccaaccagcagccgctgctgcgggccaggtactgtggtaggcccagggaaggggaatcctataggtaaatacaacaaggtgtctccctggcaagatgctcactatccgggtggagaaaggaggagaaggtttttgtgggtttttttcctttgtcggaaggttttatttgtgtgtgtgtgtgtgtgtgtgtgtgtgtgtgtgtgtgtgtgtgcatgcatatgtgtttgtgtacttttaagttcagaggtacatgtacaggtcacataggtaaacttttgtcatgggggtttgttttacagattatttcatcacccatgtattaagcctagtacccattagttatttcccctgatcctctctctcctcctaccctctacccttcaaaaggccccagtatctgttgttcccctctatgtgtccatgtgttctcatcatttagctcccacttataataacatgcagtatttggttttcggttcctgtgttggtttgctgaggagaatggcctccagctccaaccatgttcctgcaaaggacatgatctcattcctttctatggctgcgtagtgttcaatggtgtatatgtaccacattttctttatccagtctaccactgatgggcatttgggttgattccatgtctttgccattatggaacagtgctgcaatgaacataaacatgcatgtgtctttataataaaatgatttatattcttttgggtatatacccagtagtgagattgctggattgaatggtatttctgtctttaggtctttgaggaatcgccacagtcttccatagtggttgaactaatttacactcacaccaacagtgtataagcgtttctttaaggaagagaaggtgttttgaatacataccatcagccaggcaccgggcaacagcttttgacatgttacatttaatatggatcccaaaatcctcttagatgtagacaaccaggctcagaaaagttaaagtgacctagccaaagtcacacaacaaagaaattctgagactggtcctgatctggggctgtcaggctcccaaactggtcctctcatccccacagcagcctgcagtaaacacactctccaggacaggaggctgaggcaggataactcactcctcctacgtcaagcactcacctcctgtttaccctttcatcaagaggctctgacaagccagtgggcagggagagtttcttcagatataaaacaggacttttcataaccctagtatttacgtcaactgagaaggacagacactcagacacagtcgcacacacttcactcacacacaggaccgtcaattcaacgtgtccacctacctcacaagcaggcagggaaatcaggcctgcatctcaacacgtcaaaactagtttcctgcaatagccaaaaggtggaagcaagccaagtgccatcggcagatgactggataaacaaaatgtgatatagacacacaatggattatcattcagccttaaaagggaaggaaattctgacacatgctacaacagggatgacccttgagcacattatgctccatgaaataagccagacacaaaaggacaaacgctgtatgactccacttatcccaagtaccgaaaataggcaaattcacaaagacagaaaagtagattaatggttgtaggggcctaggagagaggggagagggattatttaatgggtagtttcagtttgagaaaatgaaaaagttctagagatggatggtggtgatggctgcgtgacagtgtgaatggatgtaatgccactaaactgtgcacttaaaatggttaaaatggtgaattttatgttatgtacactttgccacatttaaaaaaaaaaaaacctctgttttttctctttggaaatatggatgtataatctcttcctcaaacaaactctgggcacatgcatatgaccagtgtcttctattctcttcccagcctcagcccatgaggcttcagatgacagaggcaggagccgtgctggggtggggcctggctggggggactctgcatgcacagtaagcaagcattctaaaatcggccccagaaaatcccccaaatgcagcacagaacgccttagactggcctgagtcaacagcaggaaggggagggcccacaatgagcagccgcatcccctcccctgaaatttgcaaaacagtattttggctggtgcatttggcccaatatagagcagagcaaaacatttttatggaggaacaatgaaaagagactgctagtcctaagactgaggtctttaggaaaacttcattctctgacccatttcaactttccctaataaataacaatgctgtaatgccaagcagtctatcatgccaccttagcagctgtgctctgctcccaaatgttctgtttatgtctccccatcatgtcattgtgatggattcaattttaaactaccccaagctaatagcaaatcccccagagctctggaagcagctctgtgttgcgtgggccctgatcatgaaggtggattcagtggtcacccagggcccacctggagtctgtagcactctttttcctctgggctcccaggtacctgctgaaccccaaatgggtgcctacaaaggtccagtgaggaaaagttaagagccccagaaaaaacaaagataaaacgcctgggagggaatcagtatttatcaagggcctactacatgcaagagccttcaaaaccctgtaactttcaagttttatacatgaggaaatggaagaaattcagcaatatgtccaaggagcagagctaggattcaactctaagtcatctgactctaaagcttacactctttccattacactaggctgcctctcaaaatcatgtgggttttttttttcccctggttcttgttttttataatcctgcttgcctggcttctaaacttctccagcttttccataggccctagcccaacccaactttccatttgggtaaaaggaagatcatcccagctgctgtgtcccaagtcacatgaaatggcgggaagacatttcataaacacaagttcaaaagcccctttaaatagataggaaagtggaaattatttttaagggggtaaacttctaaagaaagcattcccattctgcagccctggacttcttaacataaaccaccaggtccaattctcaccctacactgccacagaacagctgacgctaaacttgggctccaaagcctctgtcttcctccagagagcctggcagtctgtgtaataagtgtgctggctatttctgagccggccactaaaagggaaagccacccccaaatcaccactcagcttagtcccaagaatgagagctgaaggtagcatgtcacgcaggggatttattcttcaaatgtagaattgttagtgctcaaaatataaatactcaggtttgaagaacataccaacttctttaaaaaaagaaaagggtaaaaaactcccccatgcaactgtgaatatactctcatttctcctcctcctcctttcctgacaagagccaacaatcagcagacaacaaaatctcaacatctggctcctaagtccacagctttcagctttttcctgggcctgggaacttttgcctcaaacaaatccctgatgagctgcttcaagtgtgatggtaataaggttcggctgctcagggagcaaggcaggcatgtgagccgtggcttgggtgctctgtcctccagggtggtccagaagcccttgaaggtagcacattacaagagccacttctggtcaacttcggtgagcagacagcacccagctctgctttctcaggagcaggactgcagtttctgttgggaatagtgacagccaaaaactcagaagcagaacacacaagacactgagctgagatctcttcgggcttctggaagcagtcagaccctccaccatgcccttcctttccctagctggtctaaactgctgtcgagcgatgatgggcagctctttgcacacagatattaggaaaacccctgcctaagagtcactgctttagaatttaatttctagactttagaaccacttcctactgggtccgtagagatcactgcctgtccccctactgacatgttttattgtaagcaatctaatttatggtgtgctcagtatattcttcatatacccagacacatacaactgaaaacaaaagtttcacacaacagtacttaccattgctttgtgcaatgaatgctgttattttctattctactctatcatattctattttattaaaatctattggttgtaaccatctaaattgatccccatttgaagatcacaatctgtagttttaaaactgctgtggtcataggagccagtcccacgtttttgaattaaaggcctgtgctgacaccatgggtcagagggaaggtgatttgtaccttattcccctttcctggataactcaagtttactcaaaaagctccacatcaacacttttaaaagagaattcaaatgatccatgcggccctacccacaatgggttctcacagcacaccttgtcttcaaggatagctctgaaagaactcaactctgcattcacagaaccattgctaataacctttaagaggtgtcagaggactaaagatgggtaactatttgcctaacattttgccaaattggattctggaagcttcagactggcaaacatagggctggattacctaacaagtgatttgtgagcatttacagggaaagatagaaatcactaaaaatatacatgtgttcattaagaaaaagtttcaacaaaccaatctcatttcttcttttgatgcaggatacaaaatcaggaagaatgccataaagaatgtgttcagatttcaccaaggtgcatgaaaagacagaaaaagaaaaatctgtgtcaaagtatggttgaacagttttgaagctgttagaacaactatacccctagaggctactgataacagacccttaagaacattggaaattgcttttattaggaccctagaaggttcttttctgagactgatcctagtcaacctttctatctatgacttctttaattagtgacagcaacattaccaattggtatggcgtgtcctcaataacaactgatcaactgatgaactgggtacccacagagcactttgcagttttatcaggtacttttacacatcttatctcatttgagcctccaagtcaaggagctaggtattattatattcatttcatagtaaagaaactcaggcttagccatcagtgtttctcaacctcagcaatatgaacattttgaactgggtaattctctgctgtcctgtgcactggaggatgtcggcagcatcctggcctctacccactatgtgccaggagcagtaccacccttacagttgtgacaaccaaaaatgtctccagacattgtcaaacatcccctaatggccaaaatcactcctgttgaaaaccactgggtaaatcaaactttgatctggcttgatcaaggtccacagttaaaaagttaaccagggcagtatttgaatttaggtctcctcattcttccaactctttcaaaaagctggaaggtattgggcaccgtggctcacgcctgtaatcccagcactctgggaagccaaggtgggtggatcacctggggtcaggagtttgagaccagcctgggcaacatggtgaaaccccatctccaccaaaaatacaaaaattagccgggtgtggtgatgcacgcctgtagtctcagctactcagaaggctgaggcaagagaattgcttgaacccgggaggcggaggttgtagtgagctgagattgtgccactgcactccagcctgggagacagagggagactctgtctcaataaataagtaaataaataaataaataaatgaaagctgggagggataatgaacaggataaattacaaaaatcaagagtcaaaattatcttgattgacattctaggccaaaaccaataataaaagactgaaggtccatattttggttttaaataaatcaattgtgcaaagtgagactggcactcatggcattttatggcagttaatgtatggaaggttggcaaagggggttggttaaccttcagcccagagactggcagtcctgcatgactccacagatgccaacataatcttggctgcactgacagggcaagcagtccaggcatctctcacactcccacccaggccagctgcccgagcattgaaccccgccatcctctctctcttctcacacctgccgcagacctgacactacctgtggggcctccccctcccctacagaacgtggctctgctccatcctcactctgtcctctggcagccgcagcaagagtcggtgtgcagcagaattggaagacagatggcaagagggaagagaagaaggacaggagggagaggacacgggggagaagacaagaagggaagtggagaaattatggcagggcccacaatgtcactgtgagccccccaaacccagggggcaagacagtaagatgagggaagagagggaagcggggaggagggggaggaaacggatgcaaggccagcaaagggaagaggataagaaaaaggcagagcagagggaaaagactaattactcccagccctccaatattcacttacatgctatgctgcttcttcttccattcagttccttcctgctacttgcccggggcacccagcttggcccattacccacccattaatgcccctacctgggaatctctggaattcactatgctggattaaaaccctggctctactagtcactagctgggtgaatttagaccaattacttaatctcactaagccttagtttccacatctgtgaaatggggataataatatctatctcatagttttggtatgggattaagtgagacttaatttgaaatatatacacacatatatatacacatatatagatctacgtgtgtgtgtgtgtgtgtgtgtatatgtatctctctctcaacacagatgcttggcccataaaaggtgctccctggtagctagttttagttataatgtacatccctggcacgtagatagcaacttattttactatcttggacaccggcttccacttccgacaaggccaaaacttagagacgaaatggcacatgcccggcccctgtattttctactgttttctgagaacataatttctagttggagtattaattactagcttggagcattactagctgctgctatttctcagggtccccttggagaccaagcaaccgctaagatggctggctttctccatagaactcacagctagcaccagcaatgaggaaatacgcacacgcgcacacacacacacgcagtctttacatctggttagggctccaagtatttcctaagtgtctcatcacacttactaaggcctgagaatctcagagctgagacactgcagaggtgatgtagcccaagccatcccctgaggcctgagtgtcctctgcagcacccgactaggggccggggggttagcacaacctgtccccattcccaggaaaaaacccagcacacagctcacactcaatgatgtcagcttcctacaggaaggacaggtacagcatcactaattaaaaagaggtcacaaccacgaagttcattcatccaggcctcttgggaacaaatcatatcaacaaccaccaaacaaatggattcatgttaatttggaggtattcttatctgagagcaatagaatatagttcaccaaagcagaaacctgggcaagcgtcaactaaatgttggtgggtccaggaagaaatccactgattcaggctaggtgcctgtcacaacttggttagcctttctgaacctgtttccttgtctgaaagatgaaagtagcaatagttgctgtgaggcgtgattaaggcatgatgcattcagaggcatagtacagtgtctggcaaagattcaagaaactttagactctttcccctttctgcaccaataagcaaatctgaaaagatcatgaatacacagtgctgcaaaatgagaaacagaatttccccctttagacaagagagcactgtgatgcagacacagccctggcatcagcaaggaaggccctggttccccttctcatcatccctggagagatgggtgtcagaggtcaggtgagggaatctctttgtgcgtgattctccaactctgcaaacaatagctggccatttcttctgaggaataagctgaaatcaaacatacctgataggcgaactgggcttgatgcagtcccaagcactctgctgagcactgaagccacttttcctcaccacaactatgggagctagagaagggaggcgattagtggtgaagacagtggggacctgccccaggtggcattagtgaaatagacaattctctagggtcctctgcaccaacccagaactctccacataagagctgccctaggaacaccacagttctgtggcctgccctggcagatgtgccctcacatctgggtgataaggggtccccaagaggagccaaaccccctgggggcagcccggtcacagccacaactggctgcccacaggctgggagccactcaactcagaggcagagtcctatgcactgcactctccagacagatggaaggacactccccccggggcagaacagcactgtagactgaaggacagctttgaatctgtctgcccaaccggttcaaatcttgttttctgtcccctaaatgtcaccagtgtaactgtcaaggggccaaggggaatcacccaaattggacagcaccttcagggcagaagctctgtttgatttatcttttgtttccacagcacctagcctactgcctggcacagagtggatattcaggaaatttctgttcatgtgaaagatgagaaaggtcacagactccttaagatccctaaagcagctacgacagctcatttctggactgagcagagctgaccttagaggccagaagggcagggctagggatgctgactgctagggggatgagaaacctctcttaaatcagagtatggaggcactgggccaattagaggaggaccaacctttcagaatcgtaagactggaaagtgtgtgccttcacgtttcattttgcctctccccagactaaaccaactaaaccatctctggaaaagacagaggccaaggtgacaggaattgttcatttatatatgaatgaggcgttgctaagtcatcagaggctggagaaaaatggaagactctttttcccaggttgccaacctcaaagttaggtaactattggcagaggtcagactaggaagaggacaggcatgatctgcaggaggttatggaaagcagcatcccagatggggcagccctccctgctccaggccactgggctagagctcagctctggactggcttctcatcctgtcctgctgactgcatagtcacagatctgctgatagtctccagacaagactagctctgctaccctggtcatatctcaggctggtaccctctccaacctgttgcacctatttgcttaaaattaagagggctgagctgggcagtgcaagaaagaactagaaagccagtctcacctggaaactctaccaactgctatgaaggacacagggaagaggtggcaggcaggaacaatgccttaagttttccccaggttccttgaactctccatggccctctggcctcccctcacccccactacctctcataaggaagcagccctggctttctagtatgctgataataaggtcctatcaggccaactgagaaaagtctcatctagaaggaaagtactcagtgcgctatctgttctgtaggaaggctgaaggcaatgcctcctggtcacatcagcaatgctatagagaaaggaaaggtgcaagagcaggacagagactgctctggctgtgtacctggaggatgatctctgaggatctctgcaccgccaagcaccctccgggctgctgacgacacggtcagattccccagtgcgtgagcctatactacagcagtgtagactacagcagttaagagcccaacagtgcggccaggcaggtctgggctctgaagaactgtgttcacatactagaattttcttggacaactgagaagtcatttaacacctctggagtctcagtttcctcatctgcaaaatagatatattaatagcacttacctcacagggtcattaggaggactaaataagccaaaatattcaaaccacttagaacaatgcctggagcatattaagcattcaatgaacgttagtcagtatcatctttactgtcagctttttgagaatagccctttctgggatattcttcatagcacccagtacagcagagcttcattaattaaaaaagaaagaaagaaagaaagaaaaagaaagaaagacagacaaacactaagctattctattagtcagggttctctagaaggacagaaccaataggatagataaatatataaaggggagtttattaagtattaactcacatgatcacaggtcccacaataggctgtctgcaagctgagaagcaaggagagctggtccaagtcccaaaactgaagaacttcagagtctgatgttcaagggcaggaaggatccagcaagggagaaagatgtaggctgggaggcttggccagtctagtcttttcgcgtttttctgcctgctttattttctatctgcactcgcagctaattagatggtgcccacccagattaagggtgggtctgcctttcccagtgcactgactcaaatgctaatctcctttggtaacaccgtcatagacacacccagcatcaatactttgcaactggccagacacggtggcttatgcctgtaatcccaggactttggtaggcccaggcaggcggatcacaaggtcaggagatcgagaccatcctggccaacatggtgaaaccccgtctctactaaaacacaaaaaattagccaggcatggtggcatacgcttgtagtcccacctactcgggaggctgagacaggggaatcacttgaatccgggaggcggagattgcagtgagcccagatcacgccacggcactccagcctggcaacggagcaagactccgtcaaaaaaaaaaaaaaaaaaaaaaaaaaaaaaacccagaactttgcaaccttaaatccaatcaagttgacactcagtattaaccatcatcacagctattaatacgatttaatatatatgtgaggcgctttacacacattgctgagttcccacataaacccaatgccaaaagtgttttcacagaaaatagcttgcctagaatgatattagtgattggccaggctaggattgaaactcaggctctgactccagagcctgcttcttcttcccaaaggttacactgcctgcagaacaccaccttctgagcccctctacctttatcagaatgagaagggagtgggggcccaaacaaaattcaagcaagagaggaagagaacacaaaaagagatgctgggaagctcagaagaaattcaccaccttgtcaaggcctgtgtctttttctggatctgggtttgtcatcatttgcagcttttgctttgactctggatgttagattacgtagagcactacatggagcacacggtgccttcaatgagaaaccagcaagcagtcagtctgaaactgtttctatagacgtggacaagacttctcacaatgtcccagctacccaatgacactgattctaatgctaacacacctccaggcacttcaaatgcttttggcactctgaccagaagctagccacgcagggtctgtgtgagccgcagcaaggctgtctgctatataagctcagaactcctgcttttggaagaagtatcatttcaacagaacagaaagtgacaccccaacagtagaattcctacaaattctaactgtgctaacatcttcctaacaacagtcctacttaaaaacttcactttggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccgggcgtggtggtgggcgcctgtaatcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaaaaaaaaaacttcactttacccattttctccaaggacttaatctcttaagctccacagagccatggagacgcacacagcaaactgtcagcacacagggagtaggaggggtgggacagtcttcccaaattctgctgctggctgcgcctgaaatgagtacacacacttcaggggcgctcactaacccacccagttgtgactgcagatgtcatgatgactgaatccttctgactccttgtcagcatcagcactccctaattctgcagaataactggtaccaaatagccatttcctgctcattcacggctcccttaacagaaaactccctcctccttcctcccctaagtcccatgcacacacagagagggaatcagaaaaggcaggaaatgcttgcctaagaccagagaaaatgccagggaagagagagacaagaaaattccaccaggtctatgttgagcagggaaattattcccccaagagaaaagttcaacttggcccggcacggtggttcatgcctggaatcccagcactttgggaggccgaggtgggtggatcacttgaggtctagagttcaagaccagcctggccaacatggcaaaaccccgtctctactaaaaaatacaaaaattagccgggtgtggtggtgggcgcctataatcccagctactcgggagactgaggcagggagaattgctttaaccaggggggcggaagttgcagtgagcggacatcacgccactacactccagcctgggcgacacagtgagactccctctcggaaaaaaaaaaaaaaagggaaagttcaacttgacggctacccctatttcatcatggtgaggtacagaaaaaggattcccttctgcagcgctgcctatcctcttctgatgacctcactgtggctatctggttacaaaggcaggcaacaactggcactaggcctagagagagatgaccaaaattgactacgcttgcacagtaagggactagatttaatccaatcatttggctccaagaaatgcacgaaatacaactactggtattctctttattcggcagatggtaatgaagacccattgggagggtgccttcccattttgtcagtctaggacctgagtggagtcccaaccgggaagcctggggcagtgtgctaaaccagcagccaacagatactgcattccaatagtggcttcttggtcccctggcattttttgtgcttacctttaactaactgttccttgcctaagctccttccaacctcaaggaactaagagaatttcattcctttctaattaaatatttttcctccaatagataatccacactgaccctatcgagggaaaatctgagctggtgtaactgcaggaggtggtttattttcataacagtaaaacatctaaaccaaatatgccctgtgtttcagcagcttaaacattgaggtctgacaagaacccgagattccactttgcctgccaagggctaagtgtgtatgctgaagcgaaagaaagtgattatgaggaaaaatggggaatgtctgagtgggtgaaggaaaaaaaaagtgcaagatattactagaaaaacctgactgcacacacaatcctatcccctacgcaggagaaagaccgagtgctagcacccggggtgtgaaagcctgcaccaagggacccaggaaccaggcgtgcctccatttctcactcgatttgtttacaatgaacggacggcgccggagtccctccgccctcagctcaggcccggttcccaccgcccgacgctggctggccgaggcaggggcgcggcgggggatttcgggcagggcggtgaagcagggcctgctctacagggggcttttcttcgccgcggtttcttcccctgtcgctgcccggcccccacctcctctctcctcccgcgcgcgctctgcccgccgcccacgcgcggaagcccgcggccggggagggggcgccgtctcccggcatgctcggcggcggtgccggtcacgtgacgggaaggcggccgcccctgtcgccttcgccagcgctagcgggcccgcagcagaggcagtagcggggcttgaaatgctgacctgcacccctggcttgcgctcccccaggcgggaaagacaagggggctgctgttgctgcttacgaaaagaatctcagcgctgctggccgccagcttccggcttgggagaaaggatgtgtttcagtctgggtttcctcatttgcaaaatgggtatactttttgtagggttgaactgtaggtcagcaggctcccaaatcctgtctttccttgtccccctcacccccaagagtaacaacttttaattaattttgttcaagagctaataaaaaaaaaatcttcatttctttggatgacactgtgcccaactccacggtcagcttgcagagcgtagcggttctgcccgaaacccatccgcccaaggcttttattttcctagatctcaaacagtgggagggtcggactctaaatactatttgtttagacccctgaaaatttttgataattcaatcttaagccgaattccgtttacctttacagtatgaaaaaagagtgactacgaaataaagaatataaacattaatagtacaagcacttcagaaaaatgtttagcatgccgtaaaataccaattacaaagcattgttaactctcaataattagatctccgatgtaattatacatgaccaataaagtaataacactacttatctttaaaaacattaatataaccaagactacccacattgcaacaggttatcatacctggtcaacacgagaattccctgtaaaaaagcttctcgtgtgtgctaatgaagatgtgtgagaatggagaataactcagctagtttatttcctgggcatttatgaaaaactgaattgagcgggcagcaatgaaaattgtcattctggggaatgcaatatttttccgctttggggaaatgagcaaaaacatgtgacaaaagcactggagataaaagtgacactgggaaagacagtttacagtggcttgaaacaaagcagtgcatcattctgccaactttacagccaagcttttttcagagatcattggctacttaaacagtaagtaatggacgttcaacaatgctgtgcccagtctaaaactaagaggcttttatctctaccgatgacatgagaaaacctgtgactacacacagcctcgacttcatttgaaatcttgagctggaatgacttttcttaaagtcagaggctcctttgcacagtggaacaaactcctcataaaatttacaacttgaaagaagtactggcaaaagcttgtactttttaaaagaatcacagcattgctcttgcttggccaaatgtattaaatgttcagagatgaattccagaatagataggagataagaacagcatcagtaactgggataaaaccagaagggcctaagaaaagttataggtcagttactcaaaggctccccacattcaggccactctcccacagagcaaaattatcctaacattatgtaaaacatttaggtgctaattcctttatccctcatctcacatttttgatgtgagaacattctgatggccagaggaagagaggagagtccagaaacatacaacttgatgtcggtcaggcacagtggctcacacctgtaatcccagcactttgggaggccaaggcgggcaggtcacctgaggtcgggagttcgagaccagcctgaccaacatggagaaacctcatctctgctaaaaatacaaaatgagccgggcgtggtgacgcgtgcctgtaaacccagctactcgggaggctgaagcaggagaatcacttgaacctgggaggcagaggttgcggtgagccaagatcgcaccattgcattccagcctgggcaacaagagcaaaacgccatctcaaaaaaaaaaaaaaaaaatgatgtcaaagcttctgattttctccctccttccccaagcttcctgggtcaaatccaaatatgcagatgtgcctatgggcacatacgggcctgaataccttcaatttcccaccaaggagacttgtatctgtgactgcctccaccccattccgggaggctaggctggcctccacagttggaggttgcaggcatcccctctccagctatatcaacttatactgcatgttttctcctgacccctgaggacagatctttgaggcccgaatcatttcttaggactccctgtcaggcaggtcatttgaggaattagaaactctgaagtccctgggaaccatgcaagcccagagtgctgggaaagcacttgtagagccatcagaagggattcccctcacatcttccaactcccaagcacccatatgttcacataaacatcaacccaaccagtttgttgcctcttattccaagctgctaaagggctggaagaggaggctgagggtcagcaggcagaggctagtatctgctgggaattgccagaaagatgatccccctcctgtgaggtgaaggtcaaaaccaagtaaatcccatttccactccacaaacctgtaagagttcaattgtttaaatcaaaggcagtacgaaatttagaaagattaagatgatgggaaagaacgtggtaccacaagttgaactcaatcctggaaaataataaatgataaaacaataaataaaaatacttgatagtgaaacccattgggctggacagtggtttcctccaagttaagtacaagagactcccttttatccatttccatacctagggttcttgacagaaaactttctagaatgtgggttttctgagctgagagggacttcagagatcaacaagtctttgggttccaaacctgaagactgtgggctaggatctagacaggcttcttgttatcaatgtcctgaaagggcaacatggcctgtgaaatgtgcctctctctggaaaaagggtgtgtggctttctaccactttccaaaatggcataagacccaaaaggggttaaaaaacactgatttggtccagctcttggatttcacagataagacccagaaaactcagttgagtgctccaggtgacagggcaaattatatgtcaccttctaaagctggttggggcctgtgggaggaggaggaggataccactcgagctaacaggtcttttccatttctaattacaaggattccatgaagtttccagccgccagtctgtctggctttctgggcctgggtgtgtcagtcgccactctgttgccgaggtgcacagatggccaggggactggggtggctggatatggccagcagccagctggctagcatccaggcatcagctctcagccaaatttcttcctgggggctcaaaaaggggtttccaaaaagtccagtccacagaatgaggcacagttcaatcctctagggactcatcactaagggtggttgcataagaaaaattatgaaaaaccatcaccctccagtaccatatgggctctatttccaggccagcgcaattaagaacaatttcacaaggaaataaagggacctagtagaataattcagaataaaaacattattgccaaataaagtacaatctttttttattttttatttatttatttatttttgagatggagtttagctctttcgcccaggctggagtgcagtggtgctatctcggctcaccgcaacctccgcctctcaggttcaagcaattctcctgcctcagcctcccaagtagctgggattacaggtgcccaccactacacctggctaatttttgtattttttagtagagacggggtttcaccatgttggccaggctggtctcaatctcttgacctcaggtgatccgcccgccttggcctcctaaagtgctgggattacagatgtgagccactgcgcctggccaataaagtaaaattttaagagaaaaacatggaatggaagaatatttgtacattaagtaactgacagcttactatataaaatgccatcaacatgttcgggcagtgggggctcaatggggataaataggcagtgtacacatgagtaactcaaggccatcatcacaaggaaacatgtagagtccctcttgaaaactaaagaattacaaattacaacttcaagggacagtaagacaatatcaaactacaaacaaaatccaatggtcgtagggaaactgcagcacttagactttacagatgaccccgtaattggctcagtctttccagagagtagtgtaggaagatgaaatatgctatacatcattcttggtattggacgttgccccagcagtaccactgaggggaacacttcccaagaagtcactaaagggagaagaaaagaggtcattttaacaaaaatactcatggctgcatatggcaataactgcaacaaaatatggaaactacccaccaaaggtaggagtaagatgatgtaaatgatgtagtagctcaaagttcacactcaggaatcagaccacacagttgattactgtatgaaatgacgttaaaacaataaaagataaaactagtacaatcagattgcaattatgtaaaacaaaattaggcaattgatcaaagaccaaattggatttacaacgattgtaaatacctagaatgagttaaatcattcatttagtcgtggttatcattatttagtcatggttatcattagcttctttctctgtaatgtttaagtttttgttaaaaaccaaaaagaacaaaaaataaatcaaacctgcctcaaaccgttggtagaataacagctcaagggacctaactgagacccacccaaatgtatgctctttggagctactcccagagtcaatactaattgttataagccactcccatgccagaggctgacttaggcacgagtaactcgagacattctggtcaatgagacacaggggatatctgctgggagccttctgaaaaagatgtctcggccttagacaccatgaagagccatcccctttttcctccaagggatattatcatttccacacaggacacgaggccctgtagcacccatctggcaaccacgaggaaagatgagtcaacacgttgtgagacagggcagagagatgcagaggacacaggtctttcagtaactctgctatgctgatgaattagccaatgctagaactgcctgtgctgggacttactgatcaaggtgaaagaatgtgttttctttattgttcaactctactgggttgcagttttctgatacttgcagctgacagcatcttaactcgtgaggcagcaagcctgagcagctttctgatgcaggcctggcaggccatgctgccctaggccagtattctgccaggcccctcactgtattccattctgggggagagcctaagggagacggaagaagacactggtgaacacgagttacaccaggcctcagaacaactccagatggtacagcaagcaggtggcagcagtgggcagcagagccccagacgtctggcccctcaataggggacctccagaggcctctgggccaccagctgtctcctttctggattcacccatttcacaaaggctgtgacaaaactgccttctgggttagagctgccagaaaaagtacaggatgcccagttacgtttggattttagataaacaacaagtgactttttagcatgagtatgtctcatgcctttattctggctgcaccccctccctggcgaggcaccaggctagcaacatccagaaacagagatggcctcccctgccctgggctgcctgtctgggctgccgtgggtgtgtctggcccagtggtaggaggatgtccagtgtctggcctctccaggtctccgatgggtctaggaatgtctgatgtgcattttatagtaacagacaagaagtggctaacacttaaaatgtatgggtggggtgggtgtcactgcggtcctgggacacttggaaactatgcagcaggctgtggaggggactagggtagaggcaggcacagtggctcctgacatccaacttccccccaacaagaacttcctaggtaaagcagaagacgtgatacttccctgaccttcctttgtctaaatatgaaacttccatgactggggaccaacggtgagaagcggcagtgggcagggcctagccctcacctgtccctgtctacaggcccacctgacctgcaattaggtttcctcactgtcattctctcttgggccatgtcttacggcatgatactcctgcccaaggacagtgcttaacttgtttggtgcagcactatctccctgcttgaagagagtcccttagtaaagcttgctgatgagagcagagcctcatttcttgcaaccttgctttatggttccctgtctagtatcctgacagcatcctgcctggggccagcactagctcataactacctgggaagaaatcactccctaatgggaagattcacaacccacccaccacaaaattcagccacatcccagtgacagataaatctgtcttccctgcccctgtctcctctcccctgactcacggcctccttcagaaggtgccgtgctaacaggtagcattggaaaagaagtctggggtggggcagctggtgattggctggtgataatgtccctcagaagaacagaaagggggaaacaaatggaagcacctgtgttcatggtgagcccttttaactagttatttctttttagaaacgggagacagaaaataaacagaaactgcagatagcaatgaagtaagcaagtaggggccagctacgtaagtttcagggcccagtgcaaagtaaaaatgcagcgcccttgttcaaaaagcaggaaaaaagtgccataaaacgtactaaaataaaccgtttccttcctttcttctgcagggtttctctcaacttgatacagtgtttcttatttgctgtttaatgagtgcagagtctcacaagatgctgggatcccgccccttgactctggccactcttaagcgtctactgccgtcctctaccaggtgctgggccaggagcagagaggtcccctcttcccacacacctgcctgggcagacccaaagcgattacacactcatgctgggacacgcttggtatttggatctggagtgagctggattctcatgcagttgtccactttttggccctgccagcctggggtagggatggccaccacaccctgccttgggacaccagtgacgccaactctatccctccctgaaccttcacccaggcccctgatgggatcagaagagtcagtagttgccaggggtggggagaaggaagtcaggtgggactggagcccagagaattcatgcttcattgtcccactggacttcacttacaaacaccaactcaaagaattattaagaatttcaaggcagcaatgggccaggcattcaaccccaaaagcagggcccttctgagcatgcggcctgtgcaactgcattcatgaagctggccccacaggtaatagtgcttattaagagacatcttattaagacattcttattaagaaagaatgaaaacaaagccaaacaaaatgcacaagattctccaattaactgagggtgctcagtcaattgggtgctcataaataggacaaaaaaaatgaaaattcttcacttaaaaaaatttggccaacaccatgtccaagctgacaggacatttctcagcctaacatcctctacctccttcctactccacctccccaaaatcctttgactccagttcgatatcctcttgagatgttgccaaggtaaataattccttgcagtggttcctaaccagatgcagtacctgcctccagccctagagggtgttttgaaagagagagagagagagagagagagagagagagagagagtgtgtgtgtgtgtgtgtgtgtgtgttgtgtatgttgcacaatggcaaatagtgctccaaggcccagatgcccagatgctcagtgaccttcagtgtgctggacagtcccaaacaatggggatcgtccgaccgaaaatgacaatcatgggttgtttgaaaaaactacccagggaaattgcaaggaaccaacgcttaaatggaaacctcccaacctggacctcccatcatttgtcctggcgatgacgagtgctgaacagaagttcctcaggagtgttgcccatccccatcccctctggagtttgagctgaacccactagggtgtctgctcatacttagcatccctcaccaccgtgtccatccctgacccagagactccatgttaaaaggcaaaagggggaagatgaggggcttccctgtaggctggtaccatgttggtccccagctcagctagtgggaagctcactagggtgaggttgggcatttgcctggacatttttattctcctccctgttctgcaaaaggcctccctgcggggaaggttttctctctcagaaggcgtccctcaccctggcctcagagctccgggagaagggcttcaggaaatgttctccccggtggtgtacagtaagccgcgagggtggaaacttagcaagagtgagataatagtcttagttttatatatagcacctgtgtcttccggagacctcagagcatggggtaagggcagggtttaaaccaccttcccaccgcacgagagatgggcagggctcactgcgaggcaacccctctctctgagtcctgctgctgccccctgtcctggcagcccagacccccttcctgggaactggcaggccctcgtgaggtccatagccatctggctccccagccttcgtggtcactgcaggcacagtcctgatcctaggatacgtgaagggtaagtgggtgttcatagctactccacctgaatggacaactgacaaggtgaagaaagccgaggctgtgtgcgccactgacaaagggccttctttactcaaattcccagagcctgggcacttgcaaacacttcctacatagctgtatgcaacatgcccattttacagccgggaaacaaagacgttgaagggaaggtggtcaccgtgaagggagcgctcggctggaaggaagtgggctggcattgccctagccctgcactccctggacggcctgtgaccttgttcaggcccgtctgtctgttctggccctgagcattaaggctcctcttaaattatctggtcctgtgtttcctgcttaagcacccagaagggcaatattgctctccgaaggagaaaagaacaatacagattgcaggtgtgaaaatattagcgtcccggtgcatcacggagcaccctgagtgtctgcttggggagggaggaaacacacaacccagattaagcagctatcagcaaaccacaggatggtcagtaacgctcacgcagctgcacacaacttccatcgcacccctccagtgggtgtacgcatgtgcccacccacacttatctacacacccacatatctacacccatacatgcatgcatgcacgtaaacacacactgcacacttacccatatacacacatgcatgcacacacacatacacacgtgcatatgcgcaaataaatatacacacatatacacacacatacatacacactcatgctccgctaagacaccagaggtgaggagactccggacccagctggctattcgacctcttcgcatttctagaatgcccccgcccccggttcccagacggctactaattctgccttcctttgagttgctgcctgtgtccccttcctcccactcccacatttaccctggcttcctacacaccatggggcgaaacagttcagaaatagagtggaaaccaggtttggagagaacactttattagggagggaagtggcaaacaattgctatttttatttttgtttctctaaggcctctgtgccccctctgtcaaggggcgacaaggacggcgtcctccccacaggtttccggtgtcatcccgttttagatccactacggccaggcaccctatctcctcaccccagggccagggccagagtcgtggtctggaggaatttctaacaaggagaatgctccttggtgtataaggaatttgttcggggtttactaaaatcatccagaatgttctcagtcgctactgttggcatctcttcgctctcagactcagccccataaattcagagttcacgaaggacaccctcctgctgcttgacacttggctcaggctttaaaactgttctttttactacagtgacagccaaagaaagcatcctgggtgttcagataacaatcagtgtcctgaacaactacccctccacataaaacaatctaccacatccaggctatattgacttcaatcagttctatcactcccaccccaacatcctgactctaaaaactgagggcttgtgacctggtcccacaaggactttccttgacttactcagataattgatattttttaaaatcttgaccgtctatggcaaagggcccttcttgaaagccaagctaggaggctctcagagagcagacaatgagttgtgtgtgcttgaacatttcaggtatgagcctctgacatctatggtacacctgagtgctgtccccaaatatttctagttctcctgggcacatggtaggactctactctcttggccccttaaaattaggtgaggacagcagacttacctggccaattaaatgtgagcagaagtggtaagtgttgcttgtctggaatgtagctttacaagtcagtatgtgattcaccatgttctcattccctctgtacagtaaccagcaccatgagaccacagctgacccagatcaggtatgtggcatgagcagaaaataaacctttcttgttttctgctgccaattctggggctgtttgttactgcaacataacctagctcatcctgactaacacaacacctttgatttgaagtaagaatgacatgaagagctgctgtaaccctggcttgctgtttgaacagaggaaacaagagaacagcactgaagagtaaattaaagggtctatagaaaactacctgtcatcctcaaggttgccctgcttcctcctgctgccatgcttttgtgcacacacatccctttactccagatagtcttcctttttctctgactacgtgaatcccttcaaaattcaactccaatggcaccatatctgagaatatttctcttctccaccaccctaggtagtgttggcatctgtcctctgctgtcagcaggaattgggacttcacactgtaaacatgcttattctctcccatagcattcactcatctgggaagacagtacagagtggtgggcacaagagcaggctctagagcagtgcttttcaatcaggggcgattctccccatgggggacatttggcaatgtctggagacatctggttgtcacaaatggggggaggtgctactgaccagagatactgctaaacatcctacagtacacagagcagccccacacaactgaaaagtatctgtccctaaatgccaacgatgagaaactctaagaatatcttggttcatagcctgactcttctattactatgattttagacatgtcacttaacttctccttcaatgactaccacataataaaagcataataggtattaggtattacaatctgcctcctctactaaacttcgaatccctagaaggtaggaactaagctatgcttgtacatgtatccctactgccagtacaccatgaacgtttgtgaactccatgggtaaagcgttagttcactcttttctgaaagctagttagtcgcaggtagtagataaaaccctctaccttgcaccaaaaagacaaggcctgtgcgtgcattctctttagcaaaacctctgctggttttaatagaaagtatttattctagttcattgcgaagcacaaatgcaagtatagtaactctgacccagaagatttaagaaaccagaagatcaacacacacaaccatcctggaagaatgtaagttcacggaaattaaattttataacaatgatgccatctggagaagtaacttgaatcaaaatgaactaactactcaccaatggccataatatattttatgtattcaaataaaccaaacacaaatatcagattgagtcaggaatgtaacaagaggtttttgtatagcaatattttgttttatttttcccattcaacgtcaattttctaggtattacaagttttctttctttattaaaccaagtcatttgaaaccttcaaaacgtgcaagatttcctgattcacactgtaatactctattgcttttatttttatgtatttatttttgagatgaagtctcgctctgtcgcccagactggagtgcagtgacaagatctcggctcactgaaacctccgcctcccaggttcaagtgattctcttgccttagcctcctgagtagctaggactacaggtgcccgtcataatgcccggctaatttttgtatttttagtagagatgaggttttgccaagttggccaggctggtctcaaactcctgacctcaggcaatctgcccacctcggcctcccaaagtgctggcactacaggcgtgagccaccgcacctggccctctattgcttttacatgccattttctgagcttataacatgttcatacacttctaaccagacgacttaaagtagtgtggttgatgtggaaaatactaagaaatcccaagttgtggcatgcagtaaaaatgcgtaagaatagttttgtatatctcatataaacccaaatcatcttctgtcaaaaattgctctacccagagaatttctgttcttcccatactctaaaaagagattctgtggctctaaaatctttttctttatttttttctaaaaatcttctctttttattttctttttaaaatgtttttattttatttgaagttctaggataaatatgcaggatgtgcagttttgttacataggtaaacaagtgccatggtggtttgctgcacctataacccatcacctaggtattaagtcccacatgcattagctatttatcctgatgctttccctacctccacccgcaaaaggcctcagtgtgtgttgtactcaaagttttttttaaaaaatctgttgaacaactgcaaccagcatcaaacctaggttttcaaaacgtaccaaaacggaaaaatattctgaaccaaaccatcatttgattcagttccaactttggtcttgagcccaatcaaataaccactgaaacatgctggacaattctagtgggccacggggactgggtggaaagcctgtggtcatctgtctccatgagatgatttccattccccaggctcagggaatacatgggaaaatcctctgcccattttccaaaaatcctttaagcccatatagaaaacaatactttctttgtgatagattgtttatacaaattcaccaaaggagattttgcaaatattatatagacttcatcataccgagggagaaataaccatgccttttagtttcttctgattcactgaaatgaggactaagatgctttatttcacacactaccgggttcatgtatatcaccgggcagaaaaacaaacataaataccttcttaagcagatgacatcttcccctgtttctcgatggagaccaaatcctcccgcaggtactcaaactagtagcaatcccattaactctcaagactactttctgctgccccctcctgagacaggagttaaaagatggcaaggacatgggcaagtggcctagggtgcaaggtgaaatctagtgctagctttaaagagaaaattccttccatctctgtggttatgagtagttctaaattacataccccatgtttcttttttggcttaattacaataaaaaggggaagcatctctgggaccttcagcatgactatgttgcaaaactaaacccaaagcacaggcccaggctgcagagagacaaagggaagcaccagtggcggaaaggaagcctcacccagagtggggcctggtcctcagccaccatctcggaggcgcccagagggaggtggcaaggagacactctgcatctgcttctttgtttttctttttatttccaggccccaacaatcaataaacaactttccttaaataatacagcacctgtgagtcagcctgggtaagctcctgtggagacggagctgggaggtgatggcatgtgggcaggggccgccgtccgggcctcctacacaccacagctcccaccgggctgcccgccaaggggcatgactctatcctggagtcagaggacactgggagcaggaagcgacctcagagatgaccaaacaccttcacctgaagccctgagaggcaaagcccaaacaggaggccaaggcttttgacaccctgcccgtttttatagcacctctgtggaattgttcattttctaagccagatcattccacagaaggagacggtaaataagccagtgaaaaaattaacatcgccagccattagagaaaagcaagttggccgggcgtggtagctcacgcctgtaatccccaacactttgggaggccgaggcaggcggatcacaaggtcagaaattcaagaccagcctggccaacatagtgaaacctcgtctctactaaaaatacaaaaattagccaggtgtggtggcgggcacctgtagtcccagctacttgggaggctgaggcaggagaatcacttgaaaccaggaggcggagcttgcagtgagccaagatcgcaccactgcactccagcctgagcgacagagcaagacttctcaaaaaaaaaaaaaaaaagagaaaagcaagttaaaactgcaatgaaggctggcgtggtggctcactcccataatctcagcactttgggaggccaggagacttgagaccagccttggcgacacagcaagaccccatctctacaaaataattttaaaattagctgggcatggtgctgcatacctgttgtcctataaatcgctacttgggaggctaaggcgggaggatcccttgaatctaggaagtcagggctgcagtgagccatgattgccccctgcaccccaacccgggcaagctacagaacaagaccctgtctcaaaaaaaacaaaacaaaacaagacacagaaagaacctacaatgagatggccttgcatacctgcatacctaccagagtggctaaaataaaagtagctacttagctactaaataaaacgctggcaaggatgtggagaagctgcagcactcatacactgctgtgggatgtaaaatggtgaagccactctggagagcagtgtggcagtttcgtaaaatatgaaatgaatgtgcaactactgtacgacccagcaactgcactcctgagcatttatcacaaataaatgaaggcttacatcacacaaaaatgtgtacacgaatgttcacagctgctttattcaaaatagccagacctggaaatgacacagatgtcccctcctaaaaagtgaatcgggggccggcacgatggctcgtgcctgtaatctcagcactttgggaggccgaggcaggcagatcacttagaggccaggagtttgagatcagcctgggcaacatggtgaaaccccgtctctactaaaaaacacaaaaaaagtagccagttgtggtggcgtacgcctgtaatcccagctactcgggaggctgaggcactagaatcacttgaacccaggaggcagaggttccagtgagccaagatcacaccactgccctccagcctgggcaatagagcgggacaaaacaaaacaaaaaattgaatctgaatctctgagggtagcatagcagagactgaggaatccaactttggtaaggaatcctggtggtcgctccctgctgacttaccgtgccctgtggtcggtcacttgccgccccacatggcctttacgatggaggccacagcctcacttggtgaccgcagctgtgctcctttccagggaggtgccacacccttcacctctatcacctattgagaatatcacctattgaaagcctgggcattctgtgtcctggcccctttaggccctcacccatgtctcctaatttaaatgaggatttaacttaatttacctggaggcaggtaactcaactcgattgcattcaattcctgcttaggtgctgacattataagcccacaacagcttgtacctgttggactcatgcgcaggccgtgcagctccaggctgcctgggtgcttcacagtatagcagtacctagcaagccccacgcagcacagaggcccacgatgctctctctgggtggcctgaggcatctggacacgtgcagatccatgctctgtatctgctgaaaccctctttcccgtgggcagatctgcccttctccctgtgggaggcaggctgagtccctggggacccggattacagagtgagtgccttggggtgctccccttttctgctatcaggggcttattgccctgctatgtctgcagcaatgaggagctttaaccttttcctgccctttagggttaagagttctcttccagttcatcagcctaaggaggcagctccaggagctcacttttgctgcagttgcatctattacatcccttttttaaacaaaggcccattcatttataaggaaaagaatccactcttagttccacctcctcaagtagaaaatttttaactagactaaaacggtactccaggggacctatgtgaacacactctctttcccccggggtccagtatttccacggcaacaaccaatcctaattccctcagccacctcccagggctgtggttcagaggccccattgctccacccatccacctctgcattcagttcagttagtccccagtccccctaaagcacaaggcccagaactaaattcaaagccaccttcctctgttctccaggcgacagctgatgggtggcagagaggacagggtaggaacttgggagattcagatgagttaaaatcccagtcctgccattgatcagctgtgggcttgggactaacaatttatatgtctcatcctcatctctaaaaggaggaaaataatgaatgccctgcaaaaattacataaagtatttgacggaacatgcctggcacataataggcacttctgaaatcattgctgctattatttttattattattgtgcatcctaagactgtttagtattttttacagccgtaccacctgttaattcatattgaactggtagtaaaattataactcccagtgaatttcaaaagaaatattggccgggcgcggccgggcgtggtggctcatgcctataatcccagcactttgggaggccgagacgggcagatcacgcggttcaagatcagcctggccaagatgctgaaaccccatctctactaaaaacacaaaattagccaggcatggtggcacctgtctgtaatcccagctactcaggaggctgaggcagaagaatcgcttgaacccgggcagcagaggttgcaatgagctgagatcatgccagtgcaccccagcctgggcgacagatcaagactccatctcaaaaaataaaataaaatattggccgggcgcagtggttcacgcctataatcccagcactttgggaggccgaggtgggtggatcacctgaggtcgggagttcgagcccaacctgaccaacatggagaaaccccgtctctactaaaaaaaaaatacaaaattagccaggcgtggtggcacatgcctgtaatcccagctactcaggaggctgaggcaggagaatcgcttgaacccaggaggcggaggttgcagtgagtcaagatctcgccattgcactccagcctgggcaacaagaacaaaactctgtctcaaaaaaaaaaaaaaaaaaaaagaaataaaagaaatattgatgagccaggactcctccatcctatcctttgggcaactgacttttaaatacctttatggggaacttatgttcccttttatgacatctggtcatggggtcatactgaactattttcttttttttttgagacggggtttcgctcttattgcacaggctggagtgcagtggtgcaatctcagctcactgcaacctctgcctcccaggttcaagcaattctcctgcctcagcctcccaagtagctgggattacaggcgtacgccaccacgcctggctaatattttgtatttagtagagacggggtttcaccatgttggtcagggtggtctggaactcctgacctcaggtgatccacctgcctcagcctcccaaagtgctgggattacaggcgtgagccaccgcacctggcctttttttcttttcttttctttctttttttttttcttgagatggagttttgttcttgtggcccaggctggagtgcagtggcacaatctgggctcattgcaactcccgcctcccgggttcaagcgattctcctgcctcagcctcaggattagctgggattacaggcgcgcaccaccacacccagctgattttgtatttttagtagatacgggatttcaccatgttggccaggctggaatcgaactcctgacctcaggtaatccacccacctcagcctctcaaagtgctggggttatagtcatgagccaccgcacccagccataaactattttctgaagttgctcaagtcttctttgcaaagtcagtgttcccaaactacagtcagaggccaggctcaaggttcctagcaacctgccacctggtacattcagggcactcgcccttcaagcacaacatggatccttggggctccttgccactccaactcctaggagactctcctgccttcccctgggaatgtggtatttgaggccaatggtgactgaccagaaaatctaggccagttcaaaatgccaaagacaggatgccaggaaggacccagaacctgcagggctccgttcagcttcttggggttaaccagcagtctgcagaggcgggagacggctcggctctcaggagagagcagctgatttttaatgtacagtgtaataccgcaaggtaaacagcatcccagacgctgctccatatggctttaccctgagatcgaaactaattaccattctgtgtatatttccaggttggggcaataagggagttactgtccagcacattcgccatcagaccacccctgaggtcaacactgccacgtgctaacaagctcctttcgtggtttcaatcctcccagacatcagtcccttcatcctgcaaagggcagaaagaaactggggcttggggaggtgttagggcaggctgagcctgagacacatatgtctagaaaggggcaacgtctcaaaactgcacattcagagcctggaagctctgtacagatgcctaatgggtcctggggctagaaaaggtttgaatagatcatcctggacagaaaagatgcaaacccccaggggtcaaccctgcaggctacctgctccccctgccccccacccattacagctgaaaggaaggagagagttccatttcacacatcctgtgtgtagcagagtagagaccagggtttggcaggcaggatgcccagggctgtggtgacgccagtccgtgctgctcagatggaacctgtagccatccagcccggatcctgcatgggttccagtaggccctcctgggacttggaagtgagctggtgtgctcggggttcatcagctccgtccagtcacctgactggcttttccttccactccaccatcccagcccagatgacaagggcacagtatggccttgtgacttgggaagtcctgggtaggttctctgtggctcacttcaagaggaggccagggtgacgcacagtgtacttcagagaccccagagccacctggacctgagtccctgtgaatggacacgtgacgggcctcactgggtgtgcagtaagataaaacatctccttaatctcagagagagcctgtgttaataagcacgtgcctggcctggcaccagatgcggcacagagaagagacgaagactaattaaatcacacacgtccagagacctccttggtaagaaaagccacaccgatacagagtagtgttgttctacacacacacgtgtgtgtgggtgtgtgtgtatagagagatatatatgtatatatttcattggctctcttatgagctacagtgactctaaaagatgcaccaagaaagcagaggaacaaggggaagggagggaagggacagaggctttcacaccccaaatgctgggcattttgtgtctggatgacctcagccagtttccacctacaaaacagaataaaaagaggctggtccccagggtgtgtaacctgacacctcttgccggcagctgaatacaggggattgtttttttaaacttcaagttccaatccctagtaacaaagtgaggcctctcctgcaactaaagaacctccctggaaaaataaatcctgctgcctgttttgtcatcatcttcgacaattagctgtacttgggacaacgtgactcgagccaattggtgaaggcgattagggcatccacttaaaaacgctcttcacaactggtggaggggtgtcctctattccacccctgttctgcacccggtacttgagctgcattatctcctttcatcttcacagcaccccctgagagaggctcattatcctcatgttagagatgaggacactgagactcagagatgttcagcccacgccaaggtctaggacagagtgagggtgtgggttcaggtctggctggctcgggctccacactccccagcagaccatcttgcttctgtgctcagcagagcaagcctcccccagcacacacttcctacaaacctcaatgtcaaagagctcccagaccccatgacttctcctcttccaagggaagaagtcagcaacactgcctcagacacccttattcactctcacccaatcaaagagaatggtggaggtcgcaggttcggcataaaatactaacaaatgacaccacagctgcctctgaggtccatgctattgtatcgagcatttagtatgtccagacgctgtgctaggcatttcccacattaccttgtttaaggctcacagccttaaggtgggtattatcagtcacatttcacagatgatgcaactgaggagcagaaagttttctctagggtcacacagataggaagtaacagagtttagactcaacccaggactacacctcagggttcttcccctccccctagagctcttccatagctaagactctataacgtgtactaagcagaaaaacccctgccgagctctcctgaccatgtccttctggtcaatcggggtcctcccgagagcatagcaacagtgcagctgactgggctctgcaccgtgcaactgctgagcatcaatttgtgcagaatccaacgctccaaatcaagtactggggcaggggtgccctctttcattccagcctccgtgagcctctggatccagaacagtctctttgatctaccacttctaacagagggagcaaattcctcaagacctttaccccagactccttccctagaggctgttgcccaaatccagttcctttactccctgttccaca[450 bp omitted]ttcactttccatgacacagaagagaaaaccactcaaggtactggaaaagtccatgcccccattaagtaccctcaaactctagagtgcagtgcagtctccctatcatgattcagcagctggcagccctgttcagggagcatgagacccctgctttggggccccctccttgctcactccagccttccctggtgtctgttacatctgcatgcccactgacgaatgggcaaaccacagccggaggaggctgcgtccacagtctacaatggccgagatggtcacacaggcaagaggagacgatgctgcggctgaagtgaaaccggggcgttatccagaatatctcctcatcccaacccgacctcactgctccgtccacctcagaactggctctgctgtggacgcagagattgcttttaacatagtccttagcaatttcttttcaagcaacaaggtcagaatactcttcatgagtgagtgcttgcccttgtccatcctctttttgtaaaaaagcaaagtcatcgtactcataattaaaaactcatttaggcaggaaataattcactgtccccaaatgactgtatacacgtcttatttggactcacaaagaccacatgaggtaggaagactatcaatatacccattttacagattgaggatacccaagtccaaagaggcccaatgaggtcaagtgctggatctgagagtcacaagtctttcaagcacgttcacttgttaagcacaaaaaacattctcagaggaggtcttgagtctcctcaactacttgcaattagccagatggtcaatattaatgagtgtttaatgctgtgatgactatgatgatgatgaaggagaaaggttaagaaaaagagaaggccaggctcagtggctcccagctgtaatcccaacactttgggaggccaaggcggattgggaggccaaggtggaaggatcgcttgagctcaggaattcgagaccagcctgggcaacatagcaagagatgtctctactaaaaaataaaaaataagccaggcatgatggtacgagcctgtagtcccagctactcgggaggctgaggtgtgaggatctcttgagctggagagatcgaggctgcagtgagctgtgatcacacaactgcactcctgcctgggcgacagagtgagactctgtctcaaattcataaattttttttttttgtaaaagaaaaagcgttcagcggccgcatatagactaaaatatcaattataacacattcaaaatgtcccctacactggcgaatgtttaatccataaggtttttttagtagtttgtcaaacagtgaccttctcacttcccagctgtaacacatagcaaaaccaattttcctacccttggctcagcaatctgggtctcaggattatttgtgcccaacaaaatctcttagccatttcttaaactactggcaggtagttagattttccacttgacattgctaagagattaaaattgtttatctcattgtcatacacaggccttttcagtttcctgctagcagattcaggttagataaggattacagaagtgatactcccaagttcctctctataacagtcgtcatcctttccccataatattatgaggtatattttattaaatctatcattcagatagctaacgcgtaagagcattatataacatataaaaagcattatacctcatgcataagcagaggcttagacaaacaccagctcctattcaactggggaagaagcacttcacaggagatcctgctgaattacacagtcagtcatcaattgccatagagaagttgaaaacaaattgagttgagcccggaaagaatgtcagtgaaattggaaaaaacacttgctgggaactgcctgggggtgcagtgacctcccttgtaattgcccaggtcccaccaactcagcagcataccaagagagatt[450 bp omitted]tgcctatgtttgagatgctgtatcatttcattttccctttccacccagaatcttaccacaaaagtaaaatgctagattaacaggatagcagtgagcttcacgaggaaggattcccttcagctgaaaattcaccaccaccaccccaggttacgtgagatgtttttctacttattcaaagatggggaaaaaaaacatctcctcccactccaagtgaaatcatacataaatatgaattgcagaggttcattctgcttccttattgtctatagctcctactttttgcttacttataaaacttaccagctgatgtggggcaaaatagaagtaaaaatctcagcaaataaaaaatgctgtattgactagtggcctgaagagataccttttgttgaatgggtttctactaagtgatatcaaatcaataaaatgcccaagtaaagctcaacagaggagaaaagatcagatttctaacagtgaattcttaatggagttgttgagaaacacgccagacaagttagtcaaaagcctgagtgttggcttgcctgtgaaatgattgtaacaagtcattccgtatcagacaaagttggaagaccctgcctttaagtaagaaacatcagagtggtcttccccgcacaaacactttgcaaacgtgtcgtggttgaccttgtcccttgaggctggtgtgcagtgtgcacttctgctgaccaagcaattcattcctatcgctttgagtctaagccttaaagtaatccccaaccctgcaactgaacaaaaggaaaccactactactacacccctactatgtaccaggtacagtgctaggcacttttataaacatgacataattgaacgctcaccactccatgaggtcacacttactctccccatttttcagagagcttgctagccatgtgtagactggaatttcacccaagtctcctaaacccaagcctagcacccttatccctgtggcagcagtcacaggaataagcaacaaacttgcattcccagggcttgattccctttctttgttcttcaccttccagatggttctgtatttcttttatgggtagataatgcagcagggattttttctctccttcattcattcacccattcctttaacaaatgctttaaaagcatgcactgtgttcaaagctgaggtggatctgcaaaggcgagtaaggagcttatccactgaggaagtttgttagttgaagggtgtaaccatgggtcctgtaatggtattgactattttccacccttgctttcctcctctgtaaaatgtggatattaaaggaaatgaggccaggcgcggtggctcacgcctgtaatcccagcactttgggaggccgagatgggagtatcacaagatcaagagatagagaccatcctggccaacatggtgaaaacccatttctactaaaaatacaaaaattatccgggcatggtggcatgcgcctgtagtcccagctattcggaaggctgaggcgggagaattgcttgaatccgggaggcagaggttgcagtgagccgatatcatgccactgcactccagcctgggtgacagagcgagactccacctcaaaaaaaaaaaaaaaaaaggaaatgagctctaaagcctgtcccagacccagatttcgatactgttaattatggaagctatcgaaaagtttttgttttgtttttgtttttgtttttgagacagagtcttgctctgtcacccaggctggagtgcaatggtgcaatctcggctcactgcaacctccaactcctgggttcaagtggttctcctgtctcagcctcctgagtagctgggattacaggtgtgtgccaccatgcccggctaactttcgtatttttagtagatttagtatttttagtagacgaggtttcaccatgttgactaggctggtttcgaactcctgacctcaggtgatccatccacctcagcctcccaaagtgctgggattacaggcatgaaccaccacacctggcctagtttttgttattttttaataggaagcacagaggcctaacttcctaatgagatcatatatatttatggtgtctgtcaaccaaggagacttgaactgtatttaagataatagtttactcctggaaaaatggatcagggctgctgtcttcaccagaaagttggggtgaatgaagggggcccagtgagaaaatgaagagctgtctggcagaactttagctagtcaaatttgactacaaggtcaagggaccaggtcagcagattcttccagatcaccaaggtagccctccacagtcagatggaccagacccatgggtctgaaggagatgctgattgtttctgctccatgttgtttgggactgcctgtagcaccatcgtcacttggtttggtaagttaacacaggaagggcaaccatcttagaactggtaatacaaaatcccaaacaggcagctgccactccacttttcaaattaccaaagagttcatagttgggtttggtgtgacttttgttaacaatgagctcccctgatggctgaaaaatacatctttcatgatgccaattctacccagtgaggaaaagaaaaatcacagcaaggccttgtcatggagttgagagtaccatatgcataaacctaccatcccaaggtctcctctcccaccaaaatccacagaaccttctaccctgaggctgcgatcacaacatgctttagaagacttcccaagttaattctgaaccacctcctgattatccaaagtctgtagttttttttccaccaagatataaaattctttccattaaataccttaaaattctacctttagataactaaattgagacctgacaaaataaaataagcctaaacaatgttgtcaatactcctaggaatataaataaactagccagtactaatctaatctggaactgcatttaacaggtatgtgccaacaaaatcagaaaagtgactctgtagcaattcagcacttaaaaacaaaaattctgaaaatgacttatgtaacacctcaaatatatttctctaaaaacaccgactgactggtttaatgttttcttgtagtacctaaaagcgggtgagtcttgagctgtatgttttgcaaagtctaagcatttgcatgataagtagcaacgcttagaatcaatctctctttgtctgtatacctcacctttacttgaaaatgttttaagctggctgaatacttttatctttgataagacaaggtctttgaagtgatgttttggctctgtgtgggcaaggcctcagtttctagacttcagtatctgaggggggacaatgccctgctttttgtttttaaacagaatgaatcttttactgttcaggttaatgttctggcatcctaccagctgtctctaccaccagactaattattaatgataatcttaggtatggtactgatgatttattttgatgatactttttcagtatgaaattacaaagagcctttcttatggcaaagagatagaagataggcagatcaatcaattggtctcaagcaaaagcacaaaagtaaaagtgcccagttttggcctcagtgccggaaacccacacctaagaagtcttgtcgcattttctgataccctaatacaaacactaggctttaaatcagatgtcttcaattacatagtcacagacagaactagatgaccccatgagatcattcccatacaatacccacattttcagaggagaaaactaagctagagaagcagagcccatgagtgtgtccttggttccctttgactttctgagtgtttatttcctcatccccaaacagatcagtcatacccagaacccaaaataaatgactcggggtcctcccagatctcaaagctgctgagcccttgccagaaagatcctctccatgtacctgagagaagaagggtaccccatcttcagaaaacagcatatgcaacctgagctcataaccccacaaatctgagctttcaacattctcatctagaaaagaattttccacttaaaagtattcaccaacagatgcattttttaaagtgcccctctaggcttttaaattttagtttggtttaccccaaactaaaatttttacacacttttcaaaaccacataaaaccatgttaaactgtttggattttttactatgtgtatgagttcgtttttcactcagaaaaaaaaaagacaacaaaactagtcaacatcaaaaaaaaaaaaaaaaaaagcgaaggaaacaaaattccaatggcctttaaaaaacagtaagcaccatgaagccaagggttttgtattacacttctttatacaccccacaggtaattaggccagtgttttttgtttttgttttttgttttgttttgaaacggagtctcactctgtagcccaggctgcagtgcagtggtacaatctcgcctcattgcaacctctacctccagtgttcaagcaattctcctgccttagcctcccaagtagctgggattacaggcgcccgcgaccacgccagctaatttttgtatttttagtagagacggggtttcaccatgttggccaggctggttttgaactcctgacctcaagtgatccacccgccttggcctccgaaagtgctgggattacaggcatgagccaccgtgcccagcgttcttttgttttttttttttttgtacatataactgacagaacaattttgaaataaatcaataaaaatctatttttaaagtaaggtacttttatatcttaatacaacattttaagcctggtgtctcaatggtccagattctcttaaacagaattatatagggaagtaaacaaccgctggttaatttttagttgtcagaaagaacaaaagattgagcactatccttgctcagtgcaatttgattttgttcagatctcagagaacagtaagcatgaatgtgcctgaatttcagccattgcacactgggcgtgtaatgcaactatttctgagcaaatttcaagtgtctgatccctactaagcagatatactgtcaccccctgcctgcacaccaagtcatacacactcattcctcagcaaggatgaagaaagcgccacaggaggcccgaaaggcttaactctgtgggaaggtagggcagcacagaaacaatctcagtgtctagtgtgggtctgagggccaggggttggttatgtgactggaacgctgaacatgccatttcagacctgtgtgagtggggtgagcaagggggaacctgtgtgagcataggagggtaagtgtgagcatgtgtgagggcatgtgtgagggcaagtgtaagcaagtgtgagcaagcatgagagtgtgcagctatagcgttgtgcagtagctggacagacacagcaaagtccagaaaagagaatgctacatcagtttggtagaacctcagacagagctggtggggcttttatctatcaaacacagaaaggcccagccaaaagactcactccatcaagatgtctggccttctgtagacaaaatatctattgcaggtaatcaagtgatttttgacccaatgagctgatgtttgggtgtcacagataaggctccagcgtaacaatctgtacaagaagaaaactttgcttatcgtgcaagcactcaaccaaagctcaaaagtccctaggatcccataatttccagttggttacccacccttacccccctacacacacacacacacacccaccccacttcccaccagtctcatgtgattcagagagcaaagccggcaggggatttttccctggctctgctctgcgggtgtctgaaaacctgtttaaaggtgggaggtagactggacaacaggctggcctcgtttctacctctggatatgttcactaacttaaaaacaccacttaaccctctggtttctcaaatggcatcgttctggcaaatggaaaaaaaagtcacctgtcgttattgatctccctgttaattctcttctagacaagagccgttttcaaacatcgggacacaaactgttttgacaaccagccaatagaagttgctaatctaccactagaaagggtgaatggacagtcagggaacaagttaaagtgactttggctgtttcagctatgcttcaggagttcaaaagcaactgggagggatgggacgggggaccatctcttattcagtagacctctaactgctgggcagaaagagaaatctggcccatgccttcagaaagaagtatttcccacctgcccttgaccaccatccccttccaggtggaccgcttccccctctaaaggtggtgcgcctatgcctgacagcaggtgcataatgcccaggggccctgtcctagccacaaaatgccaggctgattggggcgattttgcatacacatttgcctccagatcatcagcaaaaagcagagtttcatgaaaaggaatgcctggtcttcaaaaatccagactgtgattcgtgaatagggaatcagagaggagtatgttttgtggtccaaaataccttagtgaagaatgcagagtagaaacataaagctcccagtcgtggtggagaaagttattgaggtacagtgaagagtatttgatattcaagatgaaatcggaaggctacctactataataaaatgcagactttcccccaatatagcacaaccacccctggcacactgaactaggaaattccccatgctctctggaaaagctaagagaaagcccagaccttttcagaagtgctagcttcaactcctatgtcttctgtaagatactctgatcctcctaagagtaaaagcagcctacaagttcgattaaccatgtaatagaaataaactcctgtctactgccataaccagaacaagatgtcagtgtgatgacccaaaccagaggcacgtgaaaacatacctgaaatgtcaacctgtaccaactgacatgtacatccattaggaggtacctactccggagataacactcaggtgcctatgatactgaagaaaccatctgcttagctcaaagtatggttttcatttaattcatacatcaaactgcaccttggttacactgaccacacaaatattgcaatggtctggcttaacttactgaggctcagtgattcctcacccagttgactggccacaaccacatctacaggtttcagggtcctgtcatagattcacatcactcattttcctggcttattagtagaggctaacttaatttgatgatatccttgtcaattttctttggcctgaatgaaacacagagttaagtgtttcacctgatcagacaaaaactacactcagtagctcagttcactatctttggggattagtccagaagtttttggtgacatttatgaatattattttcccaagaagcgtggtgacctacatgaaatacttttaaaacttgttttttaagatatgcatggaaatagtagaaagactcagattcactgtccaagctaaaatgcatggtcagtgcctctgcttccacctcagcaaacacacctggacagaattattcactgtgactgtcccagggccctggtctgagttttcatgactgtgtagaaagttaagaaaaagggatgcatagggcatcaaaagtctgctgaaatcagcatgagttctgggcaaatctcagagcaagacttaccactctaggtttctgctggtccagggtatgcaggaaggctgagttggggtccagggtgcgctcagggtcactggagatgtcctcctctgagtcttcgtaggatgaggagaagcccgtggaggaggccgaggaagaggacagtttcctcaggggcaggttgccccgagggcttccctgcgtctcctccaaggccccatcctcctgggtgcccatgtctgtaatgatgacagcaggtatgttgctggggctgcaggccttcctcaggaaaggcttgtccggatcttggggtagcagctccggacttgggagggcatcactgtcctgccgctggctttcccaagtcccctctgattgcacccctgtgccacgcgtccaagccaaaccggctttctccatggtgccctgccaaaccctggagttcccaggctgcacacccaccctgtccccaggagggcactgaggttctttcagatctttcgcagcgtcccaacagggcaaaggctccagcattctgccagaaggaattcccgcctccacattcccggtccccggctgtgctgaggggctgcccccaagcaagcccagcgttggggaccctccctccactctgtcggagagctgccaacgccccccgcccacgggggccccacttcgggcctcctcagggcctacggaggccagggccctgggcagcctggaccagctcagggaatcagaggactctgcgctttgcacgctcacagtcgtctcctctggccttttgcccacttcaggctccccagagcccggcatgccacagggcagatatcctttccccatcttcccagggggttctccatcgcggggcccgcccctttctggggctgggcttgtctcactgcccagaaactgcccctgcctctccaccagggcctctgggggctgcaggtcctcaagctcacgggctctcccagacggctcagtgagggcaagatcctgtggacggtgtggcccagtggatgtaactctcgctgccacttccgtggccatcgttaagctagctccgaacagccccaatgagggagctaggcagctccgagttcccggggtaggagagccccttttgtcaatttccatagctgtgggtgagccacagcggggactggcagggatacccttctccatccttacaaaagcggatggaccctgagcctctgatcctgtaggggcagcccggccgggaagaggtggcattcctttcttcacctgcgaggagcataggctgggccctcctttcctcccggagtcggttcctgaagtctctggacattgctccccccaggactttgtcctccgttcctcgctccgggcgccctgaaccaggacccttccagggggctgactgctgctgcggaaggggcacggggagggcgagcgagccctgcccaaacgcgggctgcggggcgcttgaatggcggagctctgtgcctggatgtgcgcctcaaacatgcccactttctggttcacctgcacgttctgcaactcgcgctgcaagatccgcagcttcctcttggcctcctccggccctggcggggagagggtaccggctgccaccacctgctgccggtcccctcgcaggcgaccagcccaacttgggctgctcacgctactgccgctgctgccgctgccactgccgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcccttcaaatcccaatcctaatactcgtctcgcggaccggcgagaagcgaggtccaagtccttggctcctaagtatgctgtgtgcggggcgcggctgactcagctctcccgggctgaggacaccccagccaccgtctccgggtctccccagcctgagcaaacattggctatccagggcaacccggcagccctcgccctgggcttcagggtctccctgctccaccctctcggggcatcagagaccgaccggctcggagggaacctaagcgggacctgccttgcccgagccgctgccagcgcccggatctgggagggcgcccgcgtgcccgccgtttaccttcctgaccctagccttggggctgtgtctctcggcctacgaaggcctgggcgggcagcggggccgcagccgaagcatttttcagggctagccttgtcgcctatccctagacaagtgttttgtgagtgtgggcgcaccgaggttctacacgttctctttaccggaaccagtacttgctgcccccctgccgtcgtcccctatgggggggtgtctgtgagtgtgtgtgtatacacgcgtgtgtgtatacgccgcacgcgcgcggagcgagtccgctctcagcgcgccctgttgccgaggacgcgactgcccctgcgggctcccggacccgcgcccactcggaggaacttaggggcgtgcatggctgcagccgggcagcagccctaggtgcacagagcctctagctctgcaaacctcccaggagccggcgctctaacaccccagggcagcgccgcggagcgcagggcttctccgcatcccgggcagcctcgcccggcgccagcagagccgccccgagaccccagcctggggactcctggagcgcgctgagggaggcggcgcggagtgagcggcccggaaggcgggtaggagaaatgcggagacctcgtctctccctattttctccccaccgccactccatgtcaccctccaaaatcaaacccccttccctgcctccccagcccacccctttgccctgtttcggaaccaggaacgccgagattcgctccagagcagaaagtgagggaaaagagggttgttcagaggcgagagccattaaaaggccgccaaacttacctgcagtttctcagattctcaggtcctgtgtagactacatgcccagaggcgcaaacctcgtagggacgagatggctttaaaagtaaaaatgctcagaaattattttctcacaagctatggaagacaaaaaagagg

SEQ ID NO: 2552 - DNA, 196019 bp, Homo sapiens
  source 1..196019: mol_type = genomic DNA
gagcgagggagggagcgaaggaggtagagaagagtggaggcgccaggggagggagcgtagcttggttgctccgtagtacggcggctcgcgaggaagaatcccgagcgggctccgggacggacagagaggcgggcggggatggtgtgcggggctgcggctcctgcgtccctcccagcggcgcgtgagcggcactgatttgtccctggggcggcagcgcggacccgcccggagatgaggtgaggagagggctgcaaggcggcggcctggaccacgggcggctgcagcgggggcgggggtcggcgcgggggtctgcgcgatggctgcccggggcatccgtcccgcgcccggcgcttgtctccccggccgcccttagcccctcgccgcgcgcccgagagacggcagcggctgcccctctgccttgtccttcccgtcctcgggggtggcggcggagtggcgggcggacccgcactgggaggccgggggccgcggtgggccgtggggtggcggccgcgggacgggcgtggggatgaatgggcgccgcggccccgccgccgagcgggctccctcctctcgcggggaccccgggcggccgctccttcccgggctgacctcgctgccctcggccgccggcgaggggcggcccggcctcgcctcccgccggcctcccggggacccgcgttggcgggagcggcgccgcctctgcctggagccccggctccttcctcggcccctcgctcgcaagcctgcagaatcctgggtcagtgaagggcaggcaatgccgttcggccccagggcgcgccgcggggccgcccctgaaggcatttaaaggggagcgtcttccgcgccctgtgagcgcgtccccgggtccgccgcgtcccttcccttcttacgcaccgacacggttttgtggtgtggacccaagacacaattgcagtcccttgcttgcacgaatgcaatccgaattcccaaaaaaaggaaaccggcgaggaatcggccgcaccttcctgcgcttctgcttgccttgggattagaaaacaacttcggagattacatttcctatgggcaatcttttgttgtgattcagactcaagaaggctttgctttggaagaaatagattagcggcttctctgtggagttggaggctatagagatttttatagcctcttcaatatgaaagtttcctctagaactttgccatcatcagtgctattctgagggcagcagcaacctggaaatttagatacatgcaggctccggccagatgcgtttctttgtgcttgtctgttggcattcttctcttgctgctcctcttgatcaaaacgtacagataataaaggcaaggccaatgaagagggtagataataacagcaaatcccatacaaacaaatgcctctagaaattctcagttctgtcagcggggaggcagttttgctaatcccgtggaacggatgaaaagaaaggcacagagatctcatggattatgtagtggacaggatgtgagggcaggaactggggccaggacccagcaggccagctggtttgcatggtgccactctaaacccccaaaatatgaataggaggaatgtatttgttgggatacctttatttttagatgactttaaggttgagagtgcagaagcttaaacatccttcatagttattatttcttagtttatctctgagaacaaaatatgtttctgtttaaaatttcttttactggtgtgcttgaaacgttattttgatgggagtttccttgtaagtaaaaacattgaaaaatacatacatatgaaagaaaaatccttagtgcagatgggtttgtaaagaatccagggacttttaagtcatataaattaagaagtgagggacactaatttgatgatggtgttaaaattatttcagacacctttaagtagtccagtggagatcatttctgatagtatgatctttttttaaaaaaatggtatttctttatctaggaatgcttctgttgaaattgctacggcgcatggtaccgtcacaaaactcttttattattctgcctgagtaagagaggaaatgaacaaatttttaatgtactttggaaccctgcggattgcacagatactaagcattgtgaaatagggcataaaatgagtggtagcaagttagttctgtgaaatgtttgtcgctgttagcatttttttttttttttggcagtcgactagcaattttcttttccctaaagcttatcttcaatattggtagtagaacctctgctcaagtttatcttttccccaagtgcctagactgggacaaactatcaagcctcctgtaagagattaaggaggagctgctggtaaattcctttcctttttttttttcttgaggcagggtctggctatgtcacaggctggagtgcagtggcgcaatcttggcatactgcagcctcgacctcctgggctccagtgatcttcccaccccagcttccagagtatctgggatcacagatgcacgccaccatgcccagctaattttaaaattttttctagagacagggtctctctgtgttgctcaggctggtctaaaacgcctaccttaaacgattctcccacctaggcagcctcccaaagagctaggattagaggaatgagccaccatgcttcgtccaaattcctctactctaaattatctttttaatttgctaacatttgtgagttgtagagaattgatgacacgagagttgggattatattatgcacctcaaattcttctgccatagagctgttcccttctgaatgatcacttcctcctgaatggctccacttaactggttgggtttcttaaagtgtgggcctcagatcacttacatcagcattaatggaggcacttgttaaaaatataggttttgggcatggtggatcaaacttgtaatcccaacactttgggaggctgaagtaggaatagcttgggcccaggaatttgagaccagcttgggcaacacagggaaacctggtctctaaaaaaaaattttttttaatattctgggcttagtgactcgtgcctatattcccagcttttctagaggctgaggtgggaggatctggttcgcttgagcccaggagatggaggctgcagtgagccatgattgccctactgcattctagcctgggcgacagagagagcgagcctgtgtccaaaaagtaagtaagtaaataaatacataaaaataaatacgggtttctgtcacctcgcttcagaatcagacagctagaggtggggccctggaattggtgttgttaatgcattctccaggaatttctcctgcatagggaagttggaaaccactggcttccttctctctgagcatctcctgagactagctcctgaagtggatagaaagtttttcaagtagcagattaagttttatcccttaggctgctaataaaaaacaattgactgtgattgcgtaattttacctgtcgtacacctttcagaaggcagaggctttggttcacccctctacctccagggcctaaaacagtgcctggaggaactcaattaaacatttgttgagtgaatacgtgaattacattgcagcgaggccaatcttttaaaagttacttgtcaaattaatctatcagttagtggcatattaaagcccagcatattacaaaaaaattttttttagtagtcactgattttataaattaggagccacaagcactataccccagtgacttctgtaagtttggttagtttagaaaggagagagcctttcccaggcgtagtgtgctcaaggtgattagccagaaagaagattcagaacaaagcatttgcttagagagtcaaaatgtaaatttaagtcacagtgtagtggtaaatcatatatcaaacttatatttggtatattgtcttatatcaaaatatcattttataaaccataagtccaacatactgctataaaaattggtttctagcaaatagagaaaattgttatgttttccaatttcacttttcatactaataaaatttgacctttacaccttcttttcaagagttcaccacagggcaccatagatattatgtagttaagagctcaaactttggagaatattgtgtttgaccacacatagtcagggagtttgatctaacctctcaatgcctcatttctcagctgaacatggaaatagtaataataaagttcacatacttctaagtgcttacctaagtttttgagacacatccacttaataaatggtagttacagtgatgataaagaattggggtgtataaaaatacctaaaactcaaaagctaacccatttaattattgtactactggacttttatgatagtaagtagaaatctgttgcttaaaaaagaagtttctttggtggtgtgcgtctatagtcccagctacttcggaggctgaggtgggagaatcacttgaacccaggagatcaaggctgcagtgagctatgattgtgccactgcactctagcctgggtgacagagcaaggccctgtctcaaaaaaaaaagaaaaaaaaaagtttattgctaactccttggtactatgtataatttttttaattgaatgactagactaaacattgaaagtatttaataagctatcaaatatgtattaatataagttttgaaaataaatactaaatctcctgatctcttttaggttaaaatatagtttatgatgagcaactaatattctttgtatttaaaaagataattgttttatggtagaaaaattgaaatacagaaaagtataaagtagaaaactatgaaatacccgtaagtctactacctgcatacatatttcttcaaatccttttgtgtgtgtgcatatggctattcatatacaatttctggtaacaaaaatgggatcttgctatacatatggttgtaacctgctttttttttgcttaacatcttgtcatgagtgtcttttcctatatatatattgcattataacaattttagtaaccaaataatattccgttttatggatctatggtagttttttttttaatttttattttttcagacggagtctcagtctgttacccaggctggtgtatagtggctcaatcttggctcactgcaacctacgcttcccaggttcaaatgaatctcttgccttagcctcctgattaactgggattacacatgcctgccaccatgcctggctaatgtttgtatttttagtggagatggggtttcgtcatgttggccaggctggtctcatgctcctaacctcaggtgatccacctgcctcagcctcccaaagtgctgggatcacaggcgtgagccaccacacccagtcatggatctctggtggtttagccaatttatttttattagacattagtttgtttatttttcctccacggttacttataaccctgcagtgactgtccttctacatatgtctctgaatgtacttgtgagattattttcattaggataaatttctacaaatggaatttgcaggatcaaagcctatgctaaattttaggattttttaaatccgtatttccaatttgtcatttagaaagattgtatcattttatactcttaccatggtatatcagacttccagtctcccagccccttgtaccttcccccattttatggaatgacttaaccagtgacaaacctagtgaatttttgcttttaggaagaagaatggactgttagtataatgtgtttagtagtgtgatatggaaactcagaaatcttgtgcatgggtaatagtgatagctaatgtcgattaagttcttttgcagcatcttatatacattaactcacttcacaaaaaactctcatcttacagatgccttggaaactagggtaccagcaattagagagccagcaagtgtctgagcagatttttactgtagagtccaaaactcttagcctgtttcctagacatgttttataggcatttgggtactttttatgttctcgattgctgttgtggagtaactaagaggttctctgacatgtactaatatataaactgggtggggcacaaatttgaatccctttcactgaagagttggtcacataagttagctcagaaattagctttgggaccggtgctgtgggtcactcctgtaatcccaatacttgagaggccaaggtgggagcattacttgagcccaggagttccagactggccagggcaacatagcaagaccctacaaaaaattttttaaaaagtagcccagtgaggtgatgcccacctgtagtcctagctactagggaggctgaggtgggaggactgtttgtacccagaagttggaggctgcagatgccacagcactccagactgggcaacatagtgagatcttgtcaaaaaagaaaggggagggcagggcaagagagagagaaaagaaaggagagaaagagaaagagaaggaaggagaaagaaagaggagagagagaaaaattagcctcatcaactgtccagcattcatccttaaagtagtcttgttatcctttactctgtagtggttttcctaaagtacccctgcatgaaaaacaggattagagtgctagagaagactagtgaaatttgaaaaggcagttcacttgtgatgtggacttgtcttagaaacgcaagactgtacagaagtgtgatgagggagacagctgggtgtgtgtgtccaggtagttccatgttggcgagtttggagatagaaagtggcctaaggaagtttacttcctgaatgtgaatgttggccactttggagatagaaagtggcctaaggaagtttgcttcctgaatgtgaaggcctcagtgtagagagatatcatccactgggagatcactgaaaagtaaaccaaaacatttttattaatacatgggatggtagaatgtcactccagttttgttcctaaagttcgtagctctctaagaaagtgaattttaagcaagttaatctattttaatgcatcactgctctttcggtgtttttctagtagaattaatgataggtagcttgctttattagcttactgcccagagagaacattggtgaaattgttttggcttcagctctctggactgagtttggctgcctagctcagttttcagttggtcaccaaaacctgtcattgtttttgtgtggtatggggtctgctggagtcatgtggtagtgcgtttggcccttcattgagtggtggagccaggagttgagctgagggctgtggcagaattttgaattcaagtgaattcgaatgtgaaaataacaatgtctggccgggcgtggtggctcacacctgtaatcccagcactttgagaggccgaggtgtgcggatcatgaggtcaggagtttgagaccagcctggccaacatggtgaaaccccatctctactaaaaaatacaaaaattaggcgggcgtggtggcgcacaagtgtaatcccagctacttgggaggctgaagcaggagaattgcttcaattccctgcttgaacccaggaggtggagatttcagtgagctgacatcgcaccattacactccagccttggcgacagagcgagactctgtctcagaaaaaaaaaaaaaaaagaaagaaagaaaataacaaggtcatagcaacacagcaagtggtcagaattttacccttggtggttaaaattaaacatcctctttttaatacaggaggacaatgctcttgctcctctgttgcactggtgagcatttgatgtgttcctccttgcattatgtctgcaaatcgttctggtgtctggtggcatgcatttgcaagacatggatacagttcatggacgtggacgaggtcagctggcttttagtgtcaggctttaaccaacctagttaagaaggacgctgactcttaccataaaagcactgcaacaagattggaattggagctccaacgaattggagccattcgttttgtgtgtgtgtgtctgtttgcctgtgtgtgtgtacagggttaattacttctctgcaaggcaaatttcctgaccggttttattgttctaacacagacaaaatgttgtgtaaacacatatatcattccagtgtgttatctataataggagtgttcattgtggatccagtgtttcacaaaaatcaattcatttccgctctgaacttaagatagtagattttaaaaccaagttatctttcaatttctgaagttatctgaaactcagctgccccagtcttgcagaattggagaattgcattttggccactgatgaatgaaagctatatagctagtaatgagagaaaccttgaaaaattgacaagaaaatgagtgccattcttggtatatagcagatttcaatgaatagtagttccctttgcctttatttttcctctttcctgcacttaatataaagagctaatattaaagtcattaaatgagaatagatctgtattataggtagcactgcttatttttagaccccttcagatacagttattacaattgttgttttaatattctttaaatgattacaggaggaagaaacttggtagcggggttaccaggatgttagctccatgagggcagggagtgtatcgctgttgtccagggggctagccccaggccctagagcagcgcctgctgcctggcagacacgcaagggttatttgttggtttattaaatcaaggagtgtttgaggtccttcaagcctggaggcccgagggctctgagctggtacagagcaagtgctgggggcaagagagacaggtggggagtgaaggagagaggcccacttgggacttgactctgaatgtctgggaagtaggaagttaatgtaagttttaagcaggggagtcccatgatgtgcttttgtttaaaaatctccttctgagtatcatgtgggagtggattggaggatggatagagaggaacattccattgactcggcttccagctgtctatggatgttgacgtttctacctagccttctgctttatctttgtgatgaggataatgtggtgtactttgtgaggtctcaggaatggtttgagatgaatggtaatttgtgtaaactttccggagtttctctgaggaaaagagaaccccataaaattattactattgatcaaatgaaatagcagtgtaagacaaagatcaagaattatttagctttataaacaaattaattgaggttatgaatataggtttctataggagagattttgtttcctttttttagtgaaagaaatcttaaatgtatgggaatgaatccttaaaatagcaggcttttgcattgtctatagaagctgttctctttgaggaagatctgttttgtaaaatgctgctgttgtctgtccaatctggagttttaattagtatcaaagggagggaaatcctgcagtaatcgtaaccttactttaattcttagttcaattagttttaaaccacagtcattatctgttatctttagttgttttgatcttggtagatgaagtgattaatattacagttgtgatttggtaatttaaaaaataacatgttttttcctactacaaaaggaatacatgtttattgaagaaaacttttggaaacatatataaggaaagaagactaaaagcctaccaagatcttaccatccagtgataatgactgttaataccctgtgaaggtcaacatgctcaaattacccagcaggtgcctggtgtgaagctacttagcccgggagagttgaaggcctgttagggaccacgagcactgaaggtggcaggacggtccagggccagtcaacccagacctttgtggttctgggaggatgcgtcctggtgttactacaccttatagttatttaggagaatgtgggtttaatatgaaatcttctgatttttatgtgggccacactttttattgttaacacactggggttcaaagcatacctgagggctggattcagtcttcgttgccttgccagtttgtagcctcaggtacgtacagttttgtagcctgtgtttttcacttaatgtgttgtatttgcagccttttttgctacatcgtcatatatgtaatcagtcacttattgctggacctatagattctttgtctttttgctttttaataaagataggtaaaattcttggaccaaaagttgtttgtaaagcctttgcagcataccgctctcagatgcattccccctatcatgtaaaaggtacttgtttcctgttctcttaccaggactgggtaaaaccatctccaaaaacatcttagccaattttatttgttttaacttgcattattttctgtattaccaatgagtgtgaatgattattaaatgcctattggccttacacaaatttatttggtaaccaacttgtcttgctggaactctaagttccagcaatgttttggtcttgcattcaatgcttctcagtctttgtgattccagataatattagtactgtgttagtagcaataattagtactaattgtaggcatcgttccccaaaactgagggcatcagtatctttggcacaactataatccacttaaagtactgtgactgggaagttctttttttttttttttttgacagagtcgtgttttgttgcccaggctggagcgcagtggcacagtcttggctcactgcaacctctgcctcccgggttcaagtgattctcctgcctcagcctcctgagtagctgggactgcaggcatgtgccaccatgcccagctaatttttatattttcagtggagacggggtttcgccatgttggccaggctgatctcgaactcctcacttcagatgatctgccctcctcagcctcccaaagtgctgggattacaggcgtgagccaccgcacccagccgtgattgggaagttctgagtttagttagctgttcagtgaatgtttgagtacacgctgtatatgcctggcattgctctaggtgagtagccttgaaccaagatagaatctcagccctctaagacttctatgcttttttaaaaattctcgagtttttcatacagaccatcatgtttataaaggaccattttcattcctagaatttataatttatttttaacttgtatttctttcttttttttcttttttgagacagagtctcgctctgttgcccaggctggagtgcagtggcacgatctcagctcactgcaagctccacctcccgggatcatgccattctcctgcctcagcctcccgagtagctgggactacaggcatcagccaccacgcccagctaattttttgtatttttagtagagacggggtttcaccgtgttagccaagatggcctcgatctcctgacctcgtgatccgcccgtctcggcctcccacagttctggaattacaggcgtgagccactgcgcccggccaatgtctttcttttttttgagatgatgtcttgttatatcgcccaggatggtcttgaactgctgggttccagcagttctcctgtcgcagcctcccaaagtgctgagattataggcatgagccaccataacttgtatttgtttattggcatggaacttctaaaacagtgatgaatgcttgttaccctttaattccttccttctttccttcctctttctctttctttctctctttgtctcttctttctctcttttgtctcactctgtcacccaggctgagtgcagtggcatgaccatgattcactgtatccccaaccttccaggttcaaggaatcctcccacctcagcctcccaagtagctttgactacagccacagccacgcaccaccacacctggctaatttttttttttttttttttggagagacgatctcgctgtgttgcctaggctggtcatgaacttctggactcaagtggacctctcgcctcagcctccccaagtgctgggcttacgggcatgaaccgctgcacctggcctttgattttttaaattcactttaattatcttaagttctgttatactctagactcttagcaagagtctagaatcaacgttagttattagttccgtattttgattatgagacaaggtacaaagctgagactgtgtgatgagaacctttggaatgtatatctgacccaacacagatcccctaagtgcccttcaacctacacatccaatttcttcctacctccttctctacacaaaagacataatacattgaactcgggttgggcacctgaccaacctggcccaatcagtgttcgtttcttccctggaaatttgaaactaggctcaatagagaaggatttggccttaatatgctcaaggaccctaagtaaaggattgggagttataagcagttatgttctgctgtctggggactaagaaagatgatttatggatggggagaataaagtaactgtctaaagagaagcagagagaacactacctgactctctgacagcattaagccactctcttccagtctgttcttggtccagctgcattctcgttcttgagttcttaaggttacctccttccccttgatttaggtagctggagtttctgttactgtgaactaaacattcttctcattcttaccacaatattctttttatgatactaccttgtctctttttttttttcactatgtctagggacgttgtgaatttgttattattttctccatataataacatcaacagttaaggatagcaagaaacatggaagtaccaaaatttaatctaattcaggcaatcacaatttgattggaaaggccattttacaaatgcggactctggctcggacctgttttaaaccggtgtagatctctagctgagggaaaacaggaaggaagaaattttgaagttacttttaaatgttgcagaatttcagtggtgtcatttcctttcacatccatataaaatgttgacctcctgcaaaaaccaatactagggacattcacagtgtacagtattatgtgcatctgtatagggggtgagtctgaattctgttcaagtgtgtagccactgaaacaagattttttttttgtttgaggcagagtcttactctgtcacccaggctggagtgtgcagcggtgcaatcttggctcactgcaatctctacctcctgggttcaaacaatccccccacctcagcccccagagtgggtaggattacaggcaccaccatgcctggctaattttttttttttttttttttggtatttttagtagagatggggtttcgccatgttggctaggctggtcttgaacgcctgacccaaagtgatctgcctgctttgacctcccaaagtgctggaattacaggcgtgagccactgcgaagggccttgaaacaagactctaaagtgtactgtcgaaataccaagaagttgaatcacagaatagtttacctggggctgggcttagttcttagattagctttctgtgtcgtggtgatgtcatgtatcaggaatccttaacttaaaaaaaactcagtgataagtttaagtagtccactatctaaatgcagttgggtggggaggtggaaaaagtgatagggagagaaaaaagaggattgtaggagagagaaggaagaaaaaggaaggttgctttattgccacagttttctttattcataattgtatttgtatgagctttttcatttccaagtggaagaagcacagcattgaaatgtagtgactcacatacctgtcaagtccaaggattctgattggcctggcatgatcgtgtgtctgaacccatcatatgaccaagggaaacgtgtactctcattggctctcctgggccttgggtctaccttttcccccagttggtgagaccagtacctaaactcgtggaattaacagaaagcattaaagagaagtaggatctgtcaagaggagaaaaaaacgctaggcaggcaaaacagatggcctttactcagtgtatgatcagtgtcatacaaattaataattaataattgaagttacttttaaatgttgtagtatttcagtggtgtcatttcctttcacatacatataaaatgttgacctcatgcaaaaaccaatactacagacattcacagtgtacagtgttgtgtgcatctgtatagggggtgagtttgaattctgttcaagtgtgtagccactgaaacaagctttttttttgagacggagtctcactctgtcacccaggctggagagtgcagtggtgcaatcttggctcactgcaacctctacctccagggttcaaacggtccccccacctcagcccccggagtaggtagatcaggtctgtggcgtgccacttgttttatttatttatttatttgtttatttatttatttggcagagtctcactctatcgcccaggctggagcgcaatcgtgcgatctcggctcactgcaacctccgcctaccaggttcaagcaattctcctgcctcagcttcccaagtagatgggattacaggcgcctgccaccacgcctggctaattttttgcatttttagcatttttagtagagacggggttttaccatgttggccaggctggtcacgaactcctgacctcaggtgatccacctgcctcagcctcccaaagtgctgggattacaggcgtgagccaccatgtccggccttttttaatttttttattttaatttttagattcagagggtacatgcacaggtttgctatgtaggtttattgcatgatgctgaggtttgggcttctaatgaaccagttgcccaagtagtgaacatagcaccagataggtaggttttcaacccctgcccccgttttggaatccccagtgtttattgttcttaattttgtgtcagtgtgtacccagtgtttagttcctacttgtaagtgagaacatgcggtatttggttttctgcagaagctttcttgaccttctccttttatctctgattgtcagtttcctcttagtttcatttctttccataagcagctgtgacctcagcatgggtcatttcagctatttccttgccctgttgctctgttacatttaggacttcccaattccctttgagggcttcttatccttaaaatgttgctgtcgccagggcttttcataccctcttttgacatttcactggtcttccacggcagtcattttcactgtatttatctgtctgtacctggagcggtgtctttttttctaaccctgcatcgtgtaatgatgatgttctgataggtgattttgtctttgtgcaaacatcataaagtgtatggttgacctttgaacaagggagggattaggggtgttggtccccaacacaggcaaatccacatataagcagggctccgtggcccttgcctgtaatcccagcactttgggaggccaaagtgagaaggttgctcgagaccaggagtttgagaccatccaagcaacaaagtgagactcccatctctacaaaaattttaaaaatcagctgggcatggtggtgtactcttgtagtcccagctactagggaggctgaggcaggaggattgcttgagcccaggaatttgaggttacagtgacctgtggttgtgccagtgcactccagcctgagcgacagagccagattctgtttttaaaaaaaatcatataacctttttgactcccccaaaacgtaactactaatgacctattgttgaccagaagccttactgataacatagtccatgaacgcatactttgtatgctatatgtatgatatattctattcttacaataaactagagaaaggaaaatagtattaagaaaattataaggaagataaaatatatttactattcattaagtggaagtgggtcatcataacattcttcatcctcattgtcttcacgttgagtaggctgaggaggaggaagaagggttggtcttactgtctcaggggtgacaaaggtagaagaaaatctgaatatgagtggacccacacagttaaaactcatgttattcaagggtcaactacttatacaaaccgaggtggtatagcctactatacacctaggttatatgtatagcctattttgctccttggttacaaacccctacagcctgttactatactgaatactgtaggcagctgtaacacaagtatttacagtggtatttgtgtatcgagacatatctaaacatagaaaaggcacggtaaaaatatgctgttacaatcttacgggaccacgattgtatgtgcagttcatcattgactcaaatgttactggctgcatgactgtacctactggatccattgggcgcttaaaacttcaatacatctagagcattgctcacctgccacctttcttctgaccaacctcttcctctgtctgtatatcccatcttggtgaatgatactattatctatccttttgttcattgtttcagcagttatttattgattacttactgtgtgtcagatagtctgtggtataattttatatcattttgttcctgattcctagcacatagcttccaaaatctttggaatttcctgagtggtgggagtgtcttcttattcataatgagtccttttggatcttatctgagttcatgctaatgaactggctcctggggatgaggggctggacaccctcagaattgggggtggtccggaggaagcagtcaggaaactgcaggattggagggttggaactttcagccctccgccaccaccagctccagggaagagagagggactggaaattgagttcagtcacgtggtcagtgatctacttaatcatgcctatgcaatgaaattgcaaacgaaagccctggaactgtgaggttcggagagctgggttggtgaacccatgatgtgcagaaaggtgagtgcctatattgcacagaggaggagagggcatggaagctctgtacttcctctcccccatgctttgtgcagtgagtctcttccatttggctgttcctgagttgcacagagcttttccatgttcggtgagttgttctagtcaattacttaacttgaagtggagttaggggaacccctaaatttgtagtcagcctggcagaagtgcaagacttgaggctggcatctgaagtggggaagtcttatgggaccaagcccttgatttggggagtctgcactaactccggtagtgtcagaattgaaatgaatggtaggacacccagttagtgttggagaacattttttagaactcagtctgcctatagtatttttgaatactgtgtctatacacagtatagacttagtacctgcccttaagctagataggtgaacaagcaattataatttagctttgtaagctattcatggactaagtcagcagcctgtactttttttttttttttttttttttttgagataaaatcttgctgtgtcacccaggctggagtgcagtgagatgatcattgatcatggctaactgcagcctcaacctcccaggctcaggcaatcctctcacctcagcctcccgagtggctaggaccacagttgtacaccaccacacctggctaatttaaaaaaaaatttttgtagagatgggatctcactggtctcaaactcctaggctcaagcagccctcccacctcagcctcccaaagtgctgggattagaggtgtgagccactgcacccagcctggattctatctgatgctgaagtcggtggcttgattctgtcaattcagcctctgaaaggtcgtttgaattcaccctttctagccccactgctctggtcttagtccaggcctttatatattttttcactttactactttgctcttaatggttgctgcttcctgactcgtctggcttctctgttccacttcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaataacatttttatgaaaactgttcacaaaacaaaaaaatttagtgaaaagtggccttgttttacattttttgcagatctctttcatgcctcactgaataaaaagatggctgaattccataactgctcctgtagtcagtttgttgtgaaacgttgttttggttgaaatagttgaagaaaatctggccttatacagatatgtagttggaaagaacaggagtcttttagtggcatttccagaaaattgtggttattttgtgatactgtaccaaaacttgacactgggtagtttcttaaggattggttgcagtgtagaatctgaagtcatataagtgaactttttatcctctgttacaataaaatctgttgatccatcctatactttgaatggctattttacccctgtttgatttgaccaatacatacaacatcatgtattggtcatttggaaaatactgggtcactgagttatgtaaatcttacaaatgttgacacatttcattaaacaatatcacaaaatcgtgtttgttatcaccacccatcttattagaaaattctttaaatgttgagaagcagtctagctcataatggcagatacaagttttccaaaattctaattttcaccccaaattcaaattttatcatgaacagcaagtactgtcagttgtttttcttgcagcatcaggcttgctttatttttgagaaactgtgccagatacccaaatctgaataatcatagttttttttggttgttgttttgccaaataaaaatcgagttcctgtaaaaaaaaaatggctagtttagctcacaactcaaatgattgcacagtgattttcttggacattgttgtttggtgtagcacataaatgctttgagtatctagtcatacaagcattaagcatgtgtactcaagggctgagatttaataaagtaataatttttcatgattcatcaaagacatcctgttgtaaaactgacttttttttttttatgtgagtgtttggcagtgaagaatccagtgaccacactggtacagtttggtgccactgctaaggtgggagcagttttacccaccattgtttttgtatcagtgtaaataaaatcacagtgaaaagagcaggtcttgcctgagtaccatcatgatgatatggtttggctgtgtccccacccaaatctcatcttgaaatgtagctcccataattcccatgcgttatgggagggacctgatgggagataactgaatcatgggggcagttcccccatactgttcttgtggtagtgagtgagtcttaggagatctgatggttttctaaggggtttcccctttcatttggctctcatttctctcttgtgaccgccatgtgagacataccttttgccttccaccatgattatgaggcctccccagccacctgtaactgtgagtccattaaacctctttttctttataaattacccagtctcggtgaaaatgaactaatacacgtaagaattttgaccatctgaacccccatgaaagggtcttaggactcccagggatccacagaccacaagagaattgctgccttgtaggataaaatctaaaccttcactcacagtttagagtgcattatgctgtatccctgttgaccttccccttttcctcttctatttctcttccatctggatctcaccatagaatgttcttttgtcactttagctttacagtttatttcccttctgcctccccctatctgtcccttatcctttaggcctaactgggtgttactgaagtgaaaatacccgtacctgccgcagctatgagtcattttccctttgatttccagcactgaacttttggctctacctctttccatctattttctagggacctctgatttaaagttccgaatttacaaatcccatcataacaggaaagcattttacatccctcttgtgacttaaacttaatttatactaatatttttcattttgaaccttcttatacctaattaaatgaaacatttgagcaaataggtgatggggtattgccttttttggggtcttctgttctgtcagaaatggtattatagttaggtctagcccagggaaaaaactgatttcctttaacagttatttgaatgatacccattttcctaatcaggaaggtttcttggtattatctaggtactgggttttatgctgccaagttcatcagttaaatggcctttagataaaggacaggttggagttgtgctcagctcatataaaatgtgctttagaaggacttctggtattatctgacccacactgcccctcatgtcacacatgtttctgcacgtacacaggatgagtactgagtacccttcatgtttcagggattctgcaggtctttcacatatgccatctaaaatttgtttttcacaattttgtgaactagatgacaagatccttgtgttacagatgaggacctcgaatttgctgccatttgtgtaatgaaaatataaatggcatagtgagtagctgaacttaaataaaaaatcattgacttaccacataaataatagtattataacattataaaacaagatttggtataaatgagctttcatcagtatagacacatctcaggcattagtctaccttgcctagaaggagcaggaattatttattgagcactgttttggatatatactgaagttccctcaaattctaatgtctcataactcttcaggcagttatagtaattgctggatataccaggaagttatgcctgtaattactgctcagaaatgaaatatgtaaactctagcattatattcatactggttttattatgagatatattaccttttagatttcttataagatctattttttagatttagcttacaaagccattaactgttataaaattatactgtaaattataagctttagttagatgggccgttaggcatagctttgctggcaactgtaaccttttatgattgcagtcaaaatgtaatccagatgctcttcgtaatagaccattgagtcagaatatcctgaatattgttttgcaggttcaaaatgttggaagagatctgaatcaggatgataaaatgacattcacccatctgattttgggcttacttctttgtgacatacctaacctggtgattaaattctttttttttttgagatggagttttgctgttgttgcccaggctggagtgcaatggcacgatctcggcttaccgcaacctccacctcccaggttcaagcaattctcctgcctcagcctcccgagtagctgggattgcaggcatgcatcaccacgcctggctaattttttgtatttttagtagagacggggtttctccgtgttgaggctggtctcgaactcctgacgtcaggtgatccgcccacctcggcctcccaaagtgctaggattacgggcgtgagccaccacacccggcctctgatgattaaattctaaaaccaagagttatttaaaagattttgtagacagtgggggttggaacttgaaagtgacccatcagctatgtagctactagcattttcctaaaaagtcctcagtgaggcagctggacaaggttgagaggcaggcagcatagccaagggattctggagccaagctgctcagctactgtcttagcccacttcgtgttgctgtaatagaatatctgaggctgggtaatttataaagaaaaaggtttatttggctcacaattctgatggctaggaaggtcaagttagagcatccggtgaggtcctcaggttgctttcactcagtgtggactcctgaatgtgatgtggatgtgaagaaactggaatcctcatacattgttggtgtgaatgtagcttggtgccgctgctgtgctaaggggagctagagagtgcagaggtcacatggtgagagaggtagtaggagcgggatgggaaggggccaggttgttaacagccagctcatgtgagaactaagagtgagaactcactcactcttggggagggccttaatctattcatgaaggatccaccccatgacctgaaaacacctcccactaagccccacctccctacactgccacagtggggaccaaatttcaacctgagatttggtggggacacatagcagttactagctgtgtaaccataagcaagctatttaacttttctgtgcctcagtttcctcatctgtagaatgaggtcgatcacagttcctgtctcataagattgttgtgaggatgttaaaacagcgcagtgcctcactaaatagtaaacactgtataagaaatgattgttattattcttatcacctgtgatccaagcctggaatttataatttaagatacgaatgaagttattatatgtagttttgttaccagttgattatatgacctctcttaatttctcagttgctctttccatcatctggaagcttcgccatttgttttaacctttgaagagatgagaggaaaagatgcatgataggcttaaattgctctcatctacttataaaaaataattagacataacgtggccaggcgcagtggctcactactgtaatcccagcactttgggaggccgaggtgggtggatcacgaggtcaggagttcgagaccagcctggccaacatggtgaaaccccgtgtctactaaaaatacaaaaattagctgggcgtggtggcgggtgcttgtaatcccagctactcgggaggctgaggcaggagaatcgcttgaacctgggaggtggaggttgcagtgagccaaggccgcaccattgcactctagcctgggtgacagaatgagactctgtctcaaaaaaaaagaaaaaaatagacataatgcaagataacgtcattaaaaagtgggcaaagacctgagtaggcatttttccaaagaagatatccaaatggtcaaccagtacatgaacagatagatgctcaaaattgttagtcattagggaaatggaaatcaaaactatgagaataccactttacaaccattagtatggctatcatttttttttaaaaaggaaaataacaagtattggtaaggatgtgaagaaactggaatcctcatatattgctggtgtgaatgtagcatggtgccacagctgtgtaaaataatttttcagctcctcaattagatagatacagagttatatggcttagcaattccattcctagctatataccaaaagaaaacaggtgttcaaacaaaaacttgtacataatattcatagcagcattatttaccatagccaaaaggtggaaacaacccaaatgtccatcaacttttgtgcatcagtggacaatgtggcatattcatataatgggatatgattcagctataaaaagaaacgaatgatatatggtacagtataaacgtaccttgaaagcatgtagaataaacatgaaaacatgtataacatagatgtaccttgaaaacatgctaagtgaaagaaggcaatatactgtatggttcctttttttttttttttgagagggagtctcgctctgttgcccaggctgaagtgcagtggcatgatctcagctcactgcaacctctgcctcccaggttcaagctattctcgtgcctgagcctcctgagtagctgggattacaggtgcccactgtcgtgcccagctaattcttttgcatttttagtagagacagggtttcaccatgttggtcaggctggttttgaactcctgacctcaagtgatccacctgccttggacttccaaagtgctgggattacaggtttgagccactgcacctggcctgtatggttccatttatatgaaatacccagaataggcaaatctgtggagacagaaagcagatgagtagctggggcagagcataggatttctatttggggtgatgaaaatgttctggaactagatactggtggtggttgcacaacttcatgattgtctgagatgtcactgaattgcatactttaaaatcagttcaacagtaaattttatgttatttgtatgatgctgcaatttaaaaaaaataaatatttcgacatgacgttttttccaagtttaccttagttgtaattttgccaaaatactttcttaaaccattttattgtaattttaggctaagatcatttgcactttatatatagttgaatgaaatatatcgtagttgttttattctcttgtaaatctagaaaagatgaaaaatgaaagccatgagagttttaagtatgtctttgccttgtgcagatattctcaaagggtattgtggagcccttggggctccttatgaccttttcaaagggtctgcaggttcaggttattttcatagtaattgttgagagttatttgcttttcaaatttttatttatttatttatttagagacggggctttgctctgtccccagcctgcagtgcagtggtgcaatgacagctcactgcagcctcgacttctgggcacaagtgatcctcctgcctctcagcctcccaactgggactgcagggaggcattgttttacatttacatgccaccatgcccgctagtttttttatttttcatagagatggggttttgccacatgttgcccaggctgatcttgaactcctgggcttaagtgatccacccccatctcggcctcccaaattctgagattacagaatttgtaagcataagccaccacacccagcctatttgctttttttttttttaaactctttttctccacaggtgtaaagtgtagttttccaaacgctctataatatatgatggtgtagtctctttgttggctaatggtctatgtacttgtatatgtctggatttttttgttttttttttacaattctctaaggtaagctctttgtgatcctcaataatttttaagtgtataaaagagtcctgaggccaaaaagtttgagaacaaaatgtcttggtaaaaaatgtatgtgccaataatgaaaaagcatatacgaactacttgtattatatatttttgaaaacagaaggaaaataaattgtaagccaaatgactcttttggctgcttagcttttatcatctttactgcttcagaggttactagatttggaaccaaagtgtactttttgggatgcggtaggtttctggttttaaaaaaggatgtctggtattgattaaatctatagttttgaactttctaatccagcagctctgtggagtaggtactgatacttggattttataaccagggcacaaaatggttaagtaacttatctgtggtccgacggctagtaagtggcaggtctggtgtttggatccatgaagtctgtttcctgagtctgcactgttcacagtatgcgatctatgtaataccgctccttatgtacattgtataataatagctccctgggaatgtatgtgtgaagttcccatttggaaggctggcatcgtagtactgcactgatagtggtggcagtgattgtgaggtgggttgggttctggtgcctatggcaggggctccagcaagcagatggttagaagacagatagggagcaaggataggaggatgggctgctataggggccagacctcctgcccaggatatttctggtccagttcgaaagttggacctttccttcctagagattggctccacttatggctttataataggacctcttccccttctggagtcctttggagcaagatgcattttcacagttttctcccaacctctttacttgagtctagcacttactgcctttgaacttctctgagggtttttactaccaactagaaatgaaagaaaaagttgaagagggagatggtattcaaaagataagtgatacaaattggagtcttttaggattcatattattgaaacgcaatttgtcaacctccctaagagggtcacatcactgtggtgtgggcccccccaaggcatgtcatcactgaggttaggatgggctctctgccatgaggagtaagccagtgcctccagctactggctagaaacagggagtgttgtcaggagatctgcactggggctgaaggacatccccgcctacttcccttttgctcttcttactatcagtctttactaccgcagatccctttctagggtccacgacctttgctggggtaaagtgggatgcagggatggggcctggggatgctctaggcagtttgcatgaaggagtggctccattggtgttaaagattaggccttctgatactttcttctccacttgtactttgagttaaaggctcttacctcaagagattttctttactctgtggccatatctgtaactgtccttaactctctgtgcatggcagccccaaaccttcccagtggaacagtgcaagctcagagccttgcaggtcagtgaccccacacttggcacaggaattccagggaaaagtgtgaaagggcagtaggtggctcctccgtcctgcttctttgaaaacctctgacctaaaaggtttttgaagctgaatatttaaagaaaatatgtatgagattgtagagatagatgcctaggcggctgaaggggatgtggcaagtggatggcctccctcagggctcctttccacctgtggtggccacaggttcaagactcctgtccaaacattctggtttgtttatgtgttccagaaacagacagagaagaaggtattgtattttttgagacagtcttgctctgttgcccaggctggagtgcaatggtgcgatctctgctcactgcaggctccgcctcctgggttcaagcgattctcctgtctcagccacctgagtagctgggattacaggtgtgcgccactatgcctggctaatttttgtatttttagtagagatggggtttcaccacattggccaggctggtcttgaactcttggcctcaagtgatccacccgtcttggcctcccaaagtgctgagattataggtgtgagccaccatgcctggcccaaactggtattatatctgcatgaaaaagggtcactgtgccaatacttttttcatttaagtttttttttttttttgagacggagtctcgctctgtcacccaggctggagtgtcgtggtgcgatctcggctcactgcaacctccgcctcccgggttcaagcaattctcctgcctcagccgcccgattagctggaattacaggcatgcgccaccaagcccagctaatttatttgtatttttagtagacatgggggtttcactatattggccaggttggtcttgaactcctgaccttgtgatccacccaccttgacctcccaaagtgctgggattacaggcgtgagccaccgctctcggccctcatttaagttttaatatgtttgtgggtagaaaacgtcttaattttttttttttaatctcagaaaatgacatgtgttggtgttgagatctctcttgagtggcttcatcatttgttcgtatgcccaatgtagaaccttattctttatcctgaattccttcctcccccttacacctgatttaattgtgcactattgatctggcttagttctggaacttctctcactctcactcaggtgttgccctagactcataggtgctctctctccagccagttttgacctctccatatctttttccattagagcagtagttgtcaaactttttgattaaaactgagaggccaggtgccgtggctcatgcctgtaataccaacagtttgagaagcccaggtggtaggatcacttgagcccaggaccagcttggacaacatagtgagaccttgcctctaccaaaaagtaaaaaaattagccaggggtggtgacatgtgcctgtggttccagctatgtgggaggctgaggtgaaagcattgcttcagcccaggagttggaggctggattgagtcgtgattatgtcatgacactctagcctggattacagagcaagacactgtcccagaaaacaaaacaaaacaaaatctgagaaattacttattccctaatttatgatttggttattaacttatttaaaatgaaaaataaacccatgtaaagttagtatacatagctttttaatgaaaatcgctttttttttttcccaaaacaacaacataaaatgtagtcggaagagtggccatcgttcacttatgtgttgcagacctccttaatgtctgcctggatggaagagtttctcatccagtgcatacatgcatgaatcattgcagccaggtctcaaccctgtcagacaacactctctttttgtagtaagtctttggtaatgcttcttttattcttaagaaatgtattcatctcagaattcaaatgaaagtaacatactaacatgataatagttcagtgtgtcagtgttgtctcagctacactaggatcacatgctcactaggtcaggtgcactgagaatgcagtggctgcaaatgcacacggtagaggtacattacttggtgattcaaatatcaagaagggcattagatgtaatgacatgttctctaaaactgtgagcaacttttggtaaaatacaaaacagtcttttgatttatgtggtaattatattcctagcaaattgaatgtgtagtgaaacttggaaaaagtcttttgtgattctgtgtgaaatggaatttggttttaggttccgataattatacatggggttttcccctacattactatctagagaaacattcaaaagtcgtatgggacaattcctcatatgggactgttctgcacaacctgttaaataaatgccagtggtgcctcccagcgaatgagaccaccaaaaataccccacggattttcacacatccattagggaatggtacatacctattaagaacactgataagtggaatcttggctgtattttttttcttgttttttgtttgtttgtttgttttgagacagagtttcaatcttgtcacccaggctggattgcagtggtgatcttgactcaccgcaacccccgcctcccggattcaagtgattcttctgcctcagcctccggagtagctgggattacaggcgccggccaccacgcccgactaattttgtatttttagtagacacgggtttcaccgcgttggtcaggctggtcttgacctcctgacctcagtgctgggattacaggtgtgagccgctgtgcccggcctgttttgtttttttaagttggatgataatttaaaaaataacttacaatacagcctgaccaacatggtgaaaccccatctctactaaaaatacaaaaattagcaggcatggtggcgcacgcctgtaatccgagctactcaggaggctgaggcaggagaattgcttgagtgaggttgcagtgagctgagattgcgccattgcactccagtctgggcgacaaagcgagactccgtctcaaataaataaataaataaataaataacttacaataataattacttgaatctcaccgttaatcagtgttaatattttgttgtatatccatcttgtccttttttgtacatttgtagtttttttccattcaaaaatgggatcatttaaaaatttaaaaagagtcgatgtcttggctgggcacagtgactcaacgcctgtaattcccagcactttgggaggccgaggtgggcagatcacctgaggttgggagttcaagaccagcctgaccaacatggagaaactccgtctctactaaaaatacaaaattagccagcgtggtggtgcatgcctgtaatcccagctactcgggaggctgaggcaggagaatcgcttgaacctgggagacggaggttacggtgagctgggcaacaagagcgaaactctgtctaaaaaaaaaaaaagaattgatgtcttgatgctacttaattttatctaattcacgtgtttttaaaaatcataacaaaatcagttttattcttcattctatcatacaattagtacaatctcaggtaagatgcaaacaatgtatactcataagtctctttttaacatgaaaactggtgctacctagggaagtacaaatgaaaccacaatgaggtaccacctccaacatgttaggatggccattataaaaaaagactgaaataataagaattggccaggatatgaagaaaagggaacgcttgtacactgttggtgggaatgtaaattgatatgaagcagttatggaaaacaatatggaaattcctcagaacattaaaaatagaactactgtatgacccagcaatccctatacccaaaggaaatgaaatcagcatcttgggaagatatctgcactcccatgttccttgtggcattattcccaatagacaagatatggaaacgattttttttttttttttgagacggagtctccttctgtcgccaggctggagtgcggtggcgcaaactcggctcactgcaacctccgcctcccgggttcaagcaatttttctgcctcaggcacccgagtagctgggactacaggtgcgtgccaccacgccctgctaatttttgtatttttcgtagagatagggtttcaccatgttggccaggatggtctcgatctcttgacctcgtgatccacctgcctcggcctccaaagtggtaggattacgggcgggaggcaccacgcctggcggaaacgatttaataagtgtctgttgccagacaaaaaaaataaattggggcatatacatccagtggaatagccattaaaaaggtgatcctgtcatttgtgacaacatagatgaacctggagagcatgctgctaagtgaaataaactagaaaaagaaaagaaaaatattgcaagatctcacttatatgtggaatctgaaataaagctgaatatgtaagaatagagtggctgagtggttatcgggggaaggggaagtgggagatgtaggtcaaagttgcagttacataggatgaataaaactagagatctaatatttagcatgatgactctggctaatattgtattggaaaatttgctgagagtagatttcaggtactcttaacacacacacgtagctatgtgaggagatggatgtattacttctgactgtagtagccatttcactgtgtatatgtataacaaaacatcgtgtcatgtaccttaaattatacaataaacaaagaagaggtgccggtttgaaggggcgaggacagagcgtggacttgcggaaagttaggtggccttggtgatttaatctctcaaaccttcggttttcttatctgtaacacgtattagagaaactgtgtcttgtcggaacctacccctcagtgggggtaatcccagctgtttgtcctcagctcatttctaactgaactgcaggcttctcaagagcagccaggatgtcaccttttcatcacctagcaccagctcaggacctggctcattaatttattgaacaaatgaatgtggcagaaaatttgctattggtgttggactgtgtttaaactttgtttcatgtttatcatggttaaacctccatcagaggtaaacaactatgttaattattacatcaaacttctgtacatcttgccccaaatgggatcatttatttgttcaggataaaatgtttttgaagtttttagcacacctgatagttgtatttcttctagattgggcttggatattgttattactcaggaatctggttgaatgtttgattgtataactctgcctttgacatatgtaattaaatgagtttgtatttaatgtgttccttgaggcagccaggtgtatttacctcagaactgttgaaggcttgccatgtctctaggactcattggtacctttaaggcatctctacaggtatgattttcttttactgtggattctttttttctttcaaaagtttttcagctgttagatatttagcagctcagtctgtttgaatgatttaatgtgttactattgaaaattactttgaaatacaatttgactgttttcaagagagtttggattctgaaggcccacagcgtataggctgaaacagtggttctcaaatctagcatgcattcactggatctgggacaggatccaacagtttgcatttctaacaagttccccattaatgctggtgctgttggtgtggggaccagactttgagaactattgggctaaagtgtggaagacaattaaaaataataatatggaggggaaatggggcccagtgtgtttgggaacaggatccctttgtgctctccacagacaatagagcagtaaagaaaaactggttttggcacctgaaaagaaggaaaatagacataaactttagaaaatactgtttgatagttgcagtggtccttaaaattaagataggagaagagatttggaaataatttaattttaaaaagtttattttaccttttttattataggagtaatgcatgttcataatggaaagtgtcataaatacagaaacatttctattctaaaagagaggaaaaatttccccaaagtatcttctgacatttttggcaatgtccattcagtatctcttttatgtgtaggacttttgtttttgttttgccatgaaataaagtttttattgtcaaaataatatatgctcattataatgaaagaaaaagaaagatcataaaggacactcactctttccagaaacaatactgataacatactgaagtttattatttggtatctcttcatgtgaatatatccatttatgtgaattaccttgaccatatggttttataacctaattttttcagtcactatcttttcatatcattagatgtaattctgaagcatcttttttaggcgcagagtatcttactctgaaaaactttgttgtagctgatgctcttcatccactggcccctcccatttctcatttctctactaggaatttgtaggtcaaagagcatgtaaaaatcttgatatgggccgggcacggtggctcaagcctgtaatcccagcactttgggaggctgagacagggggatcatgaggtcaggagaccgagaccgtcctagccaacacggtgaaaccctgtctctattaaaaaaaaatacaaaaaattagccaggtgcagtggcgggtgcttgtagtcccagctacttgggaggctgaggtgggagaatgacttgaacccgggacggggagcttacagtgagccgaggttgcgccactgcactccagcctgggcgacagagcgagactctgtctcaaaaaataaaaaataaagaataaatcttgatatgtattaccagatacccacaaagggcatagaagtttctgttctcactagtagctgtgtgcctgtacccagaccccaagtctatgctcattgccggtttaataattgccagcctgataggtgaaaatagtatcttttcattcacttcttttactgataagaagcttaacacttttcttcatgtgtcagttggtcgtttaaatttcttttgaatttctgctcttgtccttgtcacattttcttttggggttaatcttttttcttgatttatatgaactcttcatacttagggacattaattccttacatcatatgcttcagatatttgtttccaaaatttcatttgcttttaaaactaacttgtggaattttttttctttcatagaagtgttttaagtgtttcatagaagtgccatccactatgattttccttttttttgtttttttttttgtttgacatggagttttgctgttgttgcccaggctggagtgcagtggcacgatctcggctcactgcaacctctgcctcctgggttcaagcgattcctgctaatttttgtatttttagtagaaacggggtttcaccacgttggtcaggctggtttcaaactcctgaccttaggtgatccctccgcttcggcctcccagagtgctaggattacacgcatgagccattgcgcctgtcctgattttccatttttaaggatttctgctcatggtgtcaaatgagaacatcccctgtcacttcaagattttacgaatattaacctgcattttcttctacaacactttctcttttttaaaaaacgtttttaaaggtggagttttgctaagttgcccaggctggtcttcaactcctgggctcaagcaaacctcccacctcagcctttcaaagcgctgggattataggcatgagccaccgtgcccagcctctgccacacttccatgatttcatttgttcactagggtcttcaaactgtctgtagtttgttttgatgcaagcaaatacatttattttagtgtggccaaatgtaatttacatttttaaatattgaattattttggttgcactgtgcaaacattaggcaaatttaggtataaagttggaaaaagccactaagtgtcacactgttctgaggagcactgggaattctgagaaggcttaaagagtttgccatggttttctgtccttgtgatagtttgttcggaatgatggtttccagcttcatccatgcccctacaaaggatgtgaactcatccttttctatggctgcatagtatttcatggtgtatatgtgccacattttcgacagaaaaccaaacactgcatgttctcactcataggtgggaattgaacaatgagaacacttggacacagggtggggaacatcacacaccgggacctgtcgtgaggtgcggggaggggggagggatagcattaggagataaacctaatgtaaatgacaaattaatgggtgcagcacaccaacatggcacatgtatacatatgtaacaaaacctgcacgttgtgcacatgtaccctagaacttaaagtataattaaaaaaaaagagtttgccatggaagtggaggtcaggagaggggagaactgagcaagtatgtgggtatttccagctcctacttctcccaagaactgcaggcttagatgggcagctgtctagtaggcagatcttcttgggcatctaataataagctgttcaaaattaacatagccaaagcagaattcttttttttttttttttaagacagagtctcacttatcacctaggctggagtgcagtggcatgatctcggctcactgcaagcctcgcctccctggttcaagggattttcttgcctcaacctcccgagtacctgggattacagttgtgtgccaccatgtccagctaatttttatatttttagtagagacagggtttcgccctgttggccaggctggtcccaaacatctggcatcaagtgatccacccgcctaggcctcccaaagtgctgggattacagacttgagccaccgcacccagcccaaaacggaattcttgatgctgtccccaccctaatgcgcacaccccagtcctttctcgtcttagtaaatagcgctgtcaaacacccatttaggcaggccagaaacttcaaaggtgtctttgattccgctcttccaccactttatatctactccatcatgaagtcttgtagactttctgtccagaatatatcctgagtctgaccactcctaatcatttccactgttaaaacattaggccaccactgtctctcatgtgggtgttattgtggtcttctggacgttgtcttggttccactttgtctctccctgtaatctgtttcacatagtagcttctacagtgtaaataagatcatattattcccttgattaaaacctttcaaagacttcccattacatttaaaataaaatccaagccttactataaaagatccacttgtctggcctctgtgcttctccagtttcttccttctgcactccccttgtctgctttgcggtagcctaacatgtctctttctatctcttgaacaggttcttttctttcgttgggtctttatacaggctgaacctcctctagaactaactagaagctacctctgatgtcttctcagagagactttccttgactatccccaggcacatgaagaagccccacacaccccctctagtcaccatctatcttgttaaccttacttattttcttaaagtggggttctgtatgtaaaatgatcttctttatttgtttactggtttattagctgtcttcctattcgagaatgtaagctcccagaggacactctgttttgttcacttctgaatccctagcacttagccccgtgcttggcccatgacatttgtggtaagtactaggtgaccatttttggaactgttcccaccccacggcctgcattcacactttaatcacagcagctcagcttttatatcgtgagcttcagtgggaggttttgtttacagaaagttttcttggttgacaaaagcctgaagatgattttcttggaagatgaggatttattctaaggatatgtgaggaagcaaagtttttgttgttgttgttgttttggaggggtggtgggggatccgagtctcgctttgtcatccaggctggagtgtagtggcgcaatcatggctcactgcaacctctgcctcccgggtttaagcgattctcctgcctcagccacctgagtagctgggattacaggcatgcgccaccacgcccagctaatttttgtatttttagtagagacagggtttcacggaagcagagattttctgtcagtgttccatctacttcataatgtattgttgatatggttcttgattttttaacctgaaggcataagcatgaaaatagcataatgatttttcacagttcctgtccaagagtactttttctttacatgttgaattacctaccatagattgttttatcctataattagaaagattatgagattacatcatcttatatttacccttaaagagtgtttcccgaatcataagccaaagcctttgtataaccttattatgtaaatatttatgtttcaggtgtgttattccctttgtgtgtgtgtgtatctatatacatatatatgcatagtatttgtgttctcttattcctatgacattgtaaacgttctagttgatgatgtctgtgcttccattgcaactcttcactgcatgggtactctgatgtgtatggcttgctgctccccagatattcgttgactttgtgacatctgtcctaggacaatttcactattttagtttttggctactcagttaattagaaatgcatctcagttgtattttaagttattgctttctacattttaatcagtaaatacaaagagattgcctttagtttttgttatgtgtattttcaggttatgttactgggagtacaaagttttacaattgttgctttctttgtggattataggttttaggaaaataaaatttatcgtattgacagtttttgccttgaaaggcttattaaatttagcagtcctcccttttttgtgtgttttttgatccttatcctttttttttttttttttttttttgagacggagtctcgctctgtcacacaggctggagtgcagtggcagagctcactgcaagctccgcctcccaggttcatgccattctcctgcctcagcctcccaagtagctgggactacaggtgcccgcccccacatccagctaatttttttgtatttttagtagagacgaggtttcaccgtgttagccaggatggtcttgatctcctgacctcgtgatccgcctgtctggtcctcccaaagtgctgggattacaggcgtgagacaccgcgcccagcccatccttttgtttttaatctgtcattttattttaggtgcatttctagttcgcttggcctgctgtctttttcataacactttattcctatgtaatagatataatgttcttttgcattttattgtttctaaagcaaatatcttctaattaagaaaaataacttctagttaatttatttcaaggggaagcagtgggggttttattcctctggatgtttgttgtcttgtgtcctgtggaatattttctttctgtttttgttcttttctttctctaactcaggacagtgctgaggaatgttttcattggtgccgtattttctttttctttcttttcttttttcttttttttttttttgagacagggtctctgtctgttgcccaagctggaatgcaatggcgcaatctcggctcactgcaacttctgcctgctgggttcaagcgattctcatgcctcagcctctcgagtagctggcattacaggcatgcaccaccacacccggctaatttttgtgtttttatagagaaagggtttcgccatgttggccaggctggtcttgaactcctgacctcaagtgatccacccacctcagcctcccaaagtgctgggattgcaggcgtgagccgatgtgcgtggcctggtgccatactttctgcatttttctttaaggaaggttccaaatgtctgaagtccaccaaatgtctgaagtcctgcccagacttttggagagaaaacacagcaaagcaatcagtaggttaatgactgcatggtttctggaccaaattatcctcatctaccacttagaacattaagttgtaaaccagagtcagcacagccagggtggagattacttatttgtatcccttgctcgtaggttatttaatattctctgttgtgtcaaagtttagtcgggtatattaattagtcagcttttgctaaattatgttgtggtaacaatctccaaatctcagtagtttacgacaacaaaactttgtttctcagtttaaggctctttgtgggcttcatgccatggtagaacctcaaaagtggcatgtgccatttcaactcatacttcattggccaaaagcaagtcacgtggtcatgcagggcctcagtaagcaagaaatatttacccgcccggggatggacaggtaggaaagggtctgttaaggaagggcagcaaatatttggataacagtactatgtgtttgtatggagcgatatttaagaaggtttcctaggttttttgaggggtattgaagctgagaggttgggggcaggcaggaagctctgcagcctgtagcctatggtatcaagcttcatgagaacgagaattaactagttacatctttattaccatttttggcatctctgcagacagtggatctaatgcatgatagctgattaataaatgtttgttgaattaatgaacaaaatagcaagaaagtaacgtattctgaggcaggagaattgcttgaaccaggaggcagaggttgcagtgagctgacatcatgccattgcactccagcctgggcgacagagtgagactccgtctcaaaaaacaaaagaaagtaaacagattattttcatgctatttgatgcctccgcttagtttggaaccagtttttattttattttattttattttattttattttattttattttttgttttgtttttgttttcgtgttttttgagacggagtctcgctctgtcgcccaggctggagtgcagtggcgagatctgggttcattgcaagctccgcctcccgggttcacgtcattctcctgcctcagcctcctgagtagctgggactacaggcgcccaccactatgcccggctaatttttttgtatttttagtagaggggtttcaccgtgttaaccagggtggtcttgatctcctgacctcgtgatccacccgtctcggcctcccaaagtgctgggattacaggcatgaaccaccgcgcctggccttggaaccagttttatagagcagttcctacaatagctccttttatatttaaaatgaaaagtgctttcttgggggtcattttgccataccaaaagattatgtgcttaaaaaaaaaactacatactaattacagaaaaaattttaaatatgcattaaatacaagcaagtagaggttgtgttctatttggctactcaggacaactattggtgttttgttatatatcctcctatataattcctttctttcttttcttttttttttttttgagatggagtttcactcttgttgcccaggctggagtgcaatggcgcaatctcagctcaccgcaacctctgcctcccaggttcaagcgattctcgcttctcagcctccctagtagctgggattacaggcatgcgccaccacgcccggctaattttgtatttttggtagaggcggggtttctccatgttggtcaggctggtctcgaactcccgacctcaggtgatccacccgcctcggcctcccaaagtgcaggggttacaggcatgagccacatagtgcccagcctctttcttttcttttctttctttttttgagatggagcctctctctgttgcccaggctggaagaatacagtggcaccatcttggctcactgtaacctctgcttcccgggtacaagtgatgcttgtgtgtcagcctcccagtagctggcactacaggtgtgcaccaccacacccagctaatttttgtatttttagtagagacggggtttcatcacattggccaggctgatctcctgacctcaggtgatccactcacctcggctgcccaaagtgctgggattgcaggcttgagcccttttttttttccccatatggcttctgaacattgtttatatttattgtcacactaggatcacttagttttgtacttttagtagtatctattgctttatttgttatgttgccaatcggcagttgtaaaggtcgtagatgaaatagacaagtatttataagattaattttatcttacccttgttctctttttctcttcttgaatttcctccttcaaatatatgaactatttacttaaccaaacactctctttctcttccctctcaccatggcaagagtgaaagggaccagaatgatgaaaggtagacagttggcctgaggaaataaggtgccttggcgattctcagactggataatcagctcctggggaatcaggcgctgacttttttttttttcctcctgcttttactcagagatcatcttttcatattttgggatttgtgcagtcatttcaatgatctaaaagtgaagagcttgataataagttgattttagtcctactgtctttttgtgacggatgtgctagataagcttaatgtgagtcattcaagaaccaagcccctgtttgaacctgtccattgagggccctgtttatcagaggttgaagcattttttagctagcagctgatcttgggtaagcaagccattgtacaagttccccatgcctagttgttttgcatcattaatcatcttttcttcaagccatggaaacatggctgagtcttgagtcatctggctcttcccagtgctggaaatccaccctgctgaggtgaatgtgtgaaatattttttgttctcggtagagatctgagaactggtttgtctcctgcaatgaacagattgaattccttataaatatgttactaaaaggtaccttttgtgtccattttacagatatctgacatgattatttattaaactcctttaaataactcctgtgcttaatgcagtttccaaatatttgaaatactaaatgtagatttagggaactcagtgaccagttttcatttgcattttgatgaatttctctattttaatatttgtagttgctatccattttagaaatatccactctgccaagtaggttgggaatgtgtgcaagaatgacagcttaaataatgtgcttgtttgctattggagccgatgcccctaagtaaagctaccagataaagagaggaaagggggaaaaaaggaggagaatgaagccaccgtgtaacatctgttagagactcaatgtgagccctgtgagttagtcttcatttcccatgctatgttttatttttatttttcctgttccattaaagcatttcggttaattctgtataagtagaatgctgataactccttagagaaatgtgattcagtaataaccttgtttccatgtgactacttatctaatctgccatgcatctgctttaaggaaggtgtccattagggtcaactcacaggtcagacattaatcttaattgtcaaatgtctcaactcattgctagagactaaattgatcttgatggcactcatctgagtaccgattcacactaaaagacagtcaaggggttgttttcctttgtgtgttgtaattcttagcaggatcctaaaaatgaaagttttaaaatgtggaatagcatgattaatgaggacatttattaaggttaaggcagtttaaaagttcagtttaatctaaggttagcttgtaggaactgatataagagatagttaaaaatttgttaagctttacttaaaacctgtatttgggggtagaaacagttttcctagggtacttataatttcctttaattatctcagaaagagggtctcttattaggatgagggaaaaaaatgacccgtcattcttttaaatcaggtttaatttattcctgatatttatatgattcttatatgtcatgtaattcttatgacatataagagagaaaacattaatctagagtaggtaatttcctagttcagcttcttccacttgtgtgaactacagaagaactgaagagtaattgtaattgttttataactttaaagaatttaagagattaaattgctgtccttgtgaattctttgttaagtaactctcaaagaaatagtcaagttaaaggggatttactttctaaaactagctttcttttctttctgtctaaccttttattatgaaaaatttcaacatctacaaaagaaaggagagtagtatcattacccagctacagtcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagactttcttcaagtttcccttgtcttttaaatagggacgtatttgcaagttcttatctgtttggaaattcctgtagcaagttcaggtttagtcattctgtactgctttggtggtgccttatctaaatagtattgaaaggaagaaagaattatttcaccaagagttggccttgaaaggagttagatgtattgggtatatttaggaagtaccccttcaacgctgtaataatataccaacttttaaagctacctcataatagctcttaaaaacacatttaaaacacttagaggtgatcctttttcctagccatcagtgggacaaattaattcctttttgagtaaaaaaaaaaaaaaaaaaaaaattctctttttttagtactcaagatcagcaagtattggttgactcattctttgttgttaaacctcttggtttctcaggccagtgtgtctttttgtatactttgaccttgcactttaaactgaattccttttgtcctttgagggaggcataaagctgtcagttcctgttggtgagtgtgggaaattgagttttcactcttctctataatttctgcatttcaagtggttttaataataatcataactatttctcaattttacttcttaaaaaagtagattcatcagactgaattgaatatttgttttccttctaaagctgaagccaattttgccatacttgtttgtgcattcttaagagtttagtacttaagcatagaaaactgtggggttcacatttatattttgctttattacaacttagaaggtaattgatgacttggctctgtggtatgctcaaagtgctggactgagctagttcaagaatgtcattagcagtgaatgggaaatatgtgtctacttttcttcagtagctaaacagaagtaattatatatttacattctacctatttcatagggatgttgttagaattactgtgattagatttttttttttaatttccaaatgtatttaagcttctttacagataggtgccatatcaaagcaaggtgttaatgtcatttttctcaatttgtgtttttgtcactagaaatatatatatattgctttttctcttttcctggtatatttttctgataaatgttttgaaatttgttatcttaagtttttcatagctggaatgctagaaaagcatttatgtcctatttttagtgcaagtgatgagtctggctgggtgggtaagttaatggcaaggtaattgaactgtgctgagtgctcgccgatgtatccttctggcctctccattttcagggtagagttactgtttacagtgacatgtttcacagtctgtgtgaccagccagtgtgaatcagttcgtctattgcctggctttcttgagctcaatttttgtctcatttcccctttccattttatatatcacatttcaagatggatgatctacttgtctaaccactccagggaagattggtgccatctaataaagtcaaaatgaggtcctgcatgttacctggcataaattagagaattatagaatgaatgtgtgaacagatctgagactagagctaggtcacgaaactcctcagtttttttgggttctcattatgtgtttatggatggaattgttctctttatctggtttgggtggttttgtttgtcagtggccaatgtggtggatatttcaacacaatttggacatgcttcctatatattttgcagaatggtctttttcttttggttaactttataactaatagttaaagaattttcaagcctcagctgggtacggtggcccatgcctgtaatcccagcactttgggaggccaaggtgggcagattacctgaggtcaggagttttgagaccagcctggccaaaatggtgaaaccctgtctttactaaaaatacaaaaattagtcaggcctcactccagcctgggtgacagagcgagactctgtctcaaaagaaaaaaaaaaaaattatttgggcttggtgacgtgcacctgtaatctcagctactcgggaggctgtggcacgagaattgcttgaacctgtgaggcagaggttgcagtgagccaagatcgtgccattgcacttcagcctgggcaacaagagcagaactccatcttaaaaaaaaaaaaaaaaaaaaaaaaaaaaaagaattttcaagccacattaggatgcttatcggcatgagttttacataataagacaatctgaaatgtatttgagttttgatgtttctaatctgtagaacttgaaggcctaaggattttgtagttttttagggaacagcattcctctttctctcaggtgatctatgttatgttgacctactcaaacatgttaactttgaaaatgaaccaacgttcaggaacaaatgaaatgacattttcaggacagcattccaaatacatagttagggacagttgttcgtagcttctggagtgtttgaaaatggccctcatatcatacaacttgaattggcattcattgacaatcactttgcttttaaaagatgcttaacaaagagttgtaagtaacatactttgagactgagtaaataaaataaacatgcgaacctttgatgttaagctgagtttgtttgatttttcaggctgaatatacaaagactgtttctaggaaaacttgtgctttgtacagatagaggaacctcctaagaattttgattgtggcttccaaaatagcagatttctagaatatgattacctactttatctaagatttcaaaaagctgctttgtctattttatgatataaagttttcaaaaaatcatcactgttttgtttgccttttttttttttcttgaaaaggcatgtgtttaagcatcagccttattagctggactgttatttcatgtatttctgttagaacgctggataatggacttgaaacttacatggctaatataataccatgaagtttaggaaactaagggctcatttctgttgtattccttggaacgtatgtgggttcaagatcaaaatcattatttcttctttgttttggtatttgtctctttcgggaattaaaatttgttcccaaacattcgtaggactacactgtagcaggaatctgaatagaaaacactccttgtttagttctgagtttatgtggatgaggactaagtgaccattgaaggtggaagggtgatcacagagattactcagaacttaatttattaattctaaaatgcgttcattgaatacacatggtttgtgtgctttttatgggccaaaccatgtaacagaggctgggaatgcagttcttgctctcaggggaatgtagtcttgtctgagaaacagacaatgaacatcagtttccaatagatctagttgtaggcttagagcatgcagagggaacaacagaaaaaatccactgagaccattctggggtccaaataggacccatggcccaagtttagaatggcaagaaagaggaaagacagagggagcttgggcagtgttctgcaaaggataaattcagttctctaagaatagttcactagtccttttttttttctttttttttttgagatggagtttcgctcctgtcacccaggctggagtgcagtggtgcagtggtgcagtggcacgatctcggtgcactgcaccctctgcctcccaggttcaagcaattctcctgtcttagcctcctgagtcactggaattacaagcacgcccggctaattttggtatttttagtagagatggggtttcaccgtcttggctaggctggtcttgaacacctgacctcaggtgatccacccacctcggcctcccaaagtgctgggattacaggcatgagccattgtgcctggcctggtcacttgctcatagttattaatctgaagaagttctacagtaaatcaaatgttcaggattgcctaatgttgacttactgatttagaatatcattctcttggtatgcttctataaactaccagtgctcaatttttcttttcaattttgaacttgttgatggacagtgtctacagtctcttgacagttatgtaatttgtgtctatttaggtttaagctgtcaccttcccaaatgcggcatctgtgtagccccagagggagcattctaaaaggtaaatctgagcctggcgcagtggcccaggcctgtaatcccagcactttttgggagctgaggtgggaggatcacttgagtccaggagttttagaccagcctggtagcaagaccctgtctctacaaaaaataacaataaataaaattaacaggcacagtgatgtatacctctagtcctagctaccgtagaggctaacatgggaggattgcttgcactcaggagttcgaggctacagtgagctatgatcgcaccactgtactccagcctggtagcaagggcctatctctaaagaataaaaaatagactaggcatggtggctcatgcctgtaatgctagcactcggggaggctgaggccggtggatcacctgaggtcaggagttcaagaccaacctggccaacatagtgaaaccctgtctctactgaaaatacaaaagttagccgggcatggtggcgcacgcctgtaatcccagctactcaggaggctgaggcaggagaatcgcttgaaatcgggaggtggaggttgcagtgagctgagattgcaccactgcattccagcatgggcgacagaccaagactctgtctcaaaaaaaaaaaaaaataattaaaaaaaaaaataaggccgggtgcagtggctcacacttgtaatcctagcactttgggaggccaaggcaggcgaatcacttgaggtcaggagtttgagaccagcctggccaacatagtgaaacctcatctctaccaaaaatactagcctggcgtggtggtgcatgcctgtagtcccagctattcaggaggctgaggcaggagaattgcttgaacctgggaggtggaggttgtagtgagccaagatcacacttctgcattccagcctgggtgatagagcaagactctgtctcaaaaagaattaaaaataaatgaacaaaaataagccaggcgtggcccggtgcagtggctcaccctgtaatcccagcactttgggaggctgaggcaggaggatcacgaggtcaggagatcgagaccatcctggctaacatggtgaaaccccgtctctactaaaaaatagaaaaaagtagccggtcatggtggcgggtgcctgtagtcccagctactcgagaggctgaggcaggagaatggcgtgaacccgggaggcagagcttgcagtgagccaagatcgcaccactgcactccagcctgggcaacagagcgagactccgtttcaaaaaaaaaaaattagccaggcatggtggtggatgcctgtaatcttagctactggggaagttgaggcaggagaatgacttgcactggggaggtggaggttgcagtgagctgagattgcaccattgcactccagcctgggcaacagagcaaggctctgcctcagaaaaaaaaaagtgtatatatatatatacatatatatatatatatatatatatgtatatatatatatatatatatatgtaaaagttaaaaaaaaaaaaaaaaagacccatttctgccgaaaatctttcagtgactccatcaccccaatgggccatgggcaagtcctgtttccactctcacatccttgcctttgggattgttttcattcctgctgagtatttaccctcacctggaaagcagctgtgtgaacttctcttcatccttcgtaggctggtggcctttcttccatgctcagttaatcagtttctcttctctgcttcctttgttctttggcctgctctgcggtgttgtatgaaacacactgtgccagaattgtttgtttactttctgttcctgttctaaatatgagctctttgaggcaggacctgtgtctttctttggacctttacgtttgtcgcagtaactgtcatataataaacagtcaatacttgatttaagctgagcaatgtaacacttaaacattaattttgttacatttactggattataatggtgactgaaaaaaacatttttaagttttttactccacctgggacaattctaactaagtgttttacttatgttaaaactcatttaattatctttgttaaagaattactctgatgcttgttaaaatagttaggaagactttattcaagactattgcaatggcggggagagatccagctcaattctgaatccagcaaggacaaatagagaattacagtcaagtagcagaatatggtcagtgaatggtaaattgctaagtggagacatcaaggtcagtagatcttataaaactggcttagtctgcttgggctactgtaacaaactactatagactagatgccttaagcaatcgaaatttatttcttatagttctggaggctaagtctcagatcaagatgccgacagatttagttcctggtgagggccctctttgtggtgtgcagacagtcaccttcctgctggcagaaggagagatcatctctctgatgtctgttcttataagggtaccaatcccattcatgaaggctccactctcatgattttaattacctcccaaaggctcgctttccaaataccatgaccttggggataagtgcttcagtgtatgtattttgagaggacacatttggtccatggcactgacctaacaagattgttgccgaaggcaggcctagaatgtatacatcaaaggtgggggtgaggaatttgatcaaatatcaaaggtgatcagatatctcagatgggggtgattctcactaaactgacttagcaggattgtttgtaaaactgagttaggtaggctgaagacaggaggggactggaggaggttgcggcttcgttgaggagggctcagagaagcctgagtttggtcaaggagagggtctttgtcactgttaggagccttttaacttaggtgctaattatactagcattttatagacaaagaatctgaagcttagaaagaggctaagcaactcacgaggtccgtaccagtaagcaccctacctggattctagctggcgtgctttctgttccataactttaaagcattgatcatctggaccctgcctgtgatggctcaatttgcttttgctaacctgctgtgagaatcagtgggagtttgcctctgctttaaaattactcatggtcttgctgcccttagtgctgtcaatcctgtgatttccactggagcaacatactcaggttacaacactgggtaacatttacattttagcagctttcttgaaatttaaaatatatgtgtaagtatctcatttatatgcatttctagtttctttatacaacagaataacttcttttacatcaaatttctgaatttgactaaatttagaaataatggaatctcatccattaaatatagtcatagaaggaaggaaatatgaaaattaggatttcagatgtttgaacataaaagataattttaaacattgtcagtaatctatttctttttttttttcgagacggagttttgctctgtcacccaggctggagtgcagtggcacgatcttggcttactgcaccctctgcctcccagttcaagtgattctcctgcctcaacctcctgagtagctgggattacaggggcatgccaacatgccgggctaatttttgcatgccaccatgccaggctgatttttgtatttgtagtggaaatggggtttcgccatattggccaggctggtcttgaactcctgacctcatgtgatccgcccacctcgcctcccgaagtgctgggattataggcatgagccaccgcgcccagcccagtaaaatctatttctatgaaaagctcttcaaatgtaggtgaacgctgtaagctttatgaatcaactgttttctaaatggtaatacatgaaatctgacaattttttatgtgattttattcaattttctaagaaaagtaaaaaatcagatacatagccgctcttctcttgggactagtcttgataccttttgtatttttatatagtgctttgctcatacccttcttgctgttttttgttttgttttgttttgttttgttttttttggtgggggggtgggggatggagttttactcttattgtccaggctggagtgcaatggtgtgatctcggctcactgcaacctccgcctcccaggttcgagcaattctcctgcctcagccttgcaagtagctgggattataggcatgcgccatcacactttgctaattttggtatttttagtggggacagggtttcactatgttggtcaggctggtcttgaactcctgacctcaggtgatctaccctcctcgacctcccacagtgctgggactacaggcgtgagccactgtacccagccccttcttgctatgttttagcctgcaatgctgttcccacttgtgtctatatagcactcctaatttaaatcatacacactgctattctgcagtgatttcttactctttcagtcagggttggtagcttttttctctgggctttcacagtcctgtggaagggcacagggttatcttatctgatacaatgtgtacgaaaggagtaactgtatcatagtaaaagttttatatataagtgaaaatatttacaacactttatccagcttacaagtttttgatatattttgtttctgtgtcttaaacacaatggacaaatacctcatataaagttttatatttttaattgtcatatatttcattatatggatatatcttttttggagacagagtcttgctcttttgctcaggctggagtgcaatagcacgatcgtagctcactgcagcctccaattcctgggctcaagcgatccttccacctcagcctcccaagtagctggaactacaggcatgtgctcccatacctagctaatgttttggtcttatttttgttacttatttatttatttttaaacactttgttgcttaggctagtgtcaaactcctgggctcaaggaatcctcccaaactttggctacccaaagtgctgggattacagatgtgaaccaccatgcctggctggatgtttcataatttacctaactgttcctatgctattgaacagttaagattatttaagtttttaattgttaaaaataaagtcatggtgaatgcctttggacatatatctttgtattttggattattttcttatggcagatttgcaggagttttgttattgggtaaaatggaaagaacatttttcctttattttttaagagaaagggtctggccaggcgctgtggctcacacctgtaatcccagcactttgggaggccgaggcgggcagatcacctgaggtcaggagttcaaaaccagcctggccaacatggcgaaaccccgtctctactaaaaatacaaaaattagccaggcgtggtggtgggtgcctgtaatcccagcgacttgggaggctgacaggagaattacttgaacctgggaggcggagattgcagtgagccgatatcacaccactgcactccagcctgggagacagagcaagagtgtctcaaaaaaaacaaaaaacaaaaaacagacagggtctttcactcaggctgcaatgcagtggtgcaatcatggttctctgcagcctccaactcctaggctccatcaatcctgcctgagcagttcctaggactgcaggtgcgtgccatcatgcccagctgatttctgtatttgttttttttatttgtagagatgaggtcttaccatctttcccagctggtctcagacttctggcctcaagcagtcctcctgccttggcctcccaaaatgctgggattacaggcgtgagccaccgtgcccggccacttttttctactcttgatatacttacctatgatacgctttccaaaggagttgtaacagtttgccctcccaccagtggtgtgagagagggtctctttgctctaacagtattaatatcagatatctgtattaaacttatttattttgaggccttacctctttccttgtggtaaactttctgaactaggttgacctaaagtaaactggtttagattcccaaataaaattgacaaaaactttataagatccattttaaaagttggagtgtcaaggaaataggaaaagctttgttagagagggaaatgttattcagtgaagtacatattgaatgtgtgaacttttcttcagtaacagttgttatcttttaaaaatcttctccatggtatttggaattttaaagcttaatacctctgctggattttgcaagcgtgaaactaaaacacagtgaaatttgaatgtgcaaacatacataaactggaattgtgaataaattagattataaaccaaacacattttgagtataagtgggcctttagaaagttttttatattatgggtagaaggtgaacctttctaaagaaaataagaaattgaggaaatctaggattttcttctttttattttggatctcagtgtgtttgtgatttttaacagaaacgttcttttctgtactttaatggtgcagccagatccatgtaaagaaaaggagtgaaatccccaggaaagatgaccagcagcaggattcttttcagcttttctccctttcctcaggcttgaatatatttcagtgcacctcaatcaagtgaagtgagattaaatatttgagtcatctgtctgttgccttctaaaatggtctggctttctgttggctgcagtctatttagtgttttagtgatgctaatgttattgaatggtttttagttctaaaacttctagtagtgataaatcttgtgcatagaagtcccctaggtcacttagcagagcgcagttggtttttgttaatgactgcattgtcctttgctctcattcgtgatacccagtgacttttcattgatgttgcagtaaggctttttttttgttgttggacttctcccattctttacacattggtaaataatcttcagctgtagcaggaggtagccagcatctatgtgtggatcagatttatcaatatgtacctgtgcagattgcctttatctcctgattgggcaaatacttaacagtccttagcagtctctccattgagttttccaccaactctaactggcaaaaggactcagttgtattggacaggaaaatcttattgtctttgctgtccattgtggcactaaagctgtgaagatgtcatacatgtgaagtattcactggattctcagttacttactcgttatcaaggcttacatgtagccaatttaattttgatgaatatgtttaaatgtagggcattttataattactggctcatggttttttatacagtatgtgcatatttcatttcttttactaccgtctttcagcccatatttaattcatccatttgcagctgttgcactgttttgttgaaactggcttaaaaatctggcaggaggcttccctactttcttgcccttttcggtgttatggtgttattttacacagttagtactttctatgtagtttcttctttcctaaagctgaagggccatatctctcaaacttttctctgcttacctttaaccactgttcgtgccgatgagctgataataccaggcttggttgctggctgtatttagaggtatacaatttaaatacccagagataaaggtgacagtagtaaattagtgcactgtattgtcttaagactaagtgtgatttcagttcttatgctacaacatggaagtttattttaatgttttcctttatgtatgggctttgcaatggttgaaacttgagtttttatttggaagttttggaagacaacttttagattgtctcttttttttttttttgagacggattctcactctgtcgcccaagttggagtgcagaggcgtgatctcggctcactgcaacctctagctcccgagttgaagcgattctcctgcctcagcctcccgaggcatacacgaccacacctggctaatttttttttttttttttttgtatttttagtagagatgggctttcaccatattggcccggctggtctcaaactcctaacctcaggtgatctgcctgcctcggtttcccaaagcactgagattacaggtgtgagccactgtgcctagcctagattatctcttctttagtgactgtatatatctacattacacagatgacaacattttgttttcctgtaacctaggccattacatttttttttcatgtgacaaagtgtttgcaattatttgtgaaattttaattttttcatcacttattaatttatatttgagaggactggaaagtatgtgagttgaaaatagtttaaacttatacaatctcattattaatttggctgttaatttgaatctattccataacttatatttaaaataaaattttgatttgaaaggctcttatctcaatcagtggttcttaaaattattgtttgctgtttagagttatattttttttccaggaagtacttttttagctttcaggaacttgatataatgttttattcttgatgacccactggaaaatagaaccttctagaagaaataaagtcactttattgaagctttatgaatggctctcctatctgcatctgtagggctctacaatctgatttttccaaacaaatagacaaactatggataataacttttcagatgttactttgcagttagttggtggtctggaagaagaaaaaagagcttcaaagaggggactgttaattccatttatctcttgaacaggaattgctttcctgtctttcattgctgtcccttatttttcacctttatgttgtagctaggttttggttttattagctccctgatgaattctctcttcctgccaatattaaagtaaggatgatttagaagaactgaggttaaaatctgcctattgaagctctccaggctagataccctgacatttctctttgtggaaagtaagcaggagtaaagggacaaatcgtccgaaatgccattgagtgttgccaagtgatgtgctgacagctgtacctgacagtgattgctggaccctggtcattcctgagtgtctccttttcacctcccatcccctgctgccactcccccctaacaacaacagaaattctgggaggaatgcctgttccctatttagaggacaacttgagtgatcatgatagtttgtcagatataatgtggacaatgacctttttcagttttagtaataagattcttctttttatcaggttctttatcctttatgcagttttaaaatattacttatgaacaagctgcatatcccttttaggtcatcttgttcttctacttcaaatagcacatgtagaagccacatttgaggctcagggcttcagacatgacaatagggcattgatcaggttggctatatgtttgggatttgtcagttcctttgtccattttttgtctcgctttcagtaccttttctctgtgttttaaaagggctttgtgtacctcttgcctttatgtgtaatcttacagggcagctttcttctttttcattcatttcctgctctaagagtcatctcaagataggaatctggtataagactcacttatagaacagggacataggctcttccagttgttttcattcattgcagattattttaaataagagaaaggtttccttgtatttttctttaatgttttccaattttgaattgttatagatgcaaagcctttaaaaggataatatgtggaggcagtatttgtttggggtatcttttaattgtttttctagatcaaggacagatatagatagattaatacctgaaacgaaaccctaacaactctcaaatatcagataatttttttttatgtttctgaggatgtttttatatcctttgagatatttaaaatatacacatttttatgtttctcccacatttggacatttctttcccctcaatgtttcattgatgccacatttctaccaattttaatcttgtattctatatcttactatcctatagtttcttcaagctgaaattagaccttttgagcaactttaaaacaaatttttaaaaatatttatttataaaagatcaattacacttattaccttagtaccataataaaaatctgtttcaaataaatgagtctgaagatgggaagggacaccattcagtgggtttagaaatagacctgttaaaatacaagtccagctggctgggcacggtgcctcatgcactttgggaggctgaggcgggcagattgcttgtgctcaggagttcaggaccaggctgggcaacatggtgaaaccctgtctctacaaaaatacaaaaattagccaggtgtggtggtacacacctatagtcccagctacttgggagactgaggtaggaggatggcttaagccctggatgtggaggttgtggtgaactgagattgtgccactgctttccagcctgggtgacagagccaggtcctatctcaaaaaattatagaataaataaataagcaagcccaaaggcaatttcattttattttatttagagacagtgtctgactgccgcccaggctgcagtgccagtggtgccatcatagctcactacaacctcgaactcctgggacaaaagcattttttcctgcctcagcctccccaagtagctgggattgtaggcatgtaccacacacccaatttttaagtttgttttttgtagagacagcatcttgctatgttgcccaggctggtcttgaattcctggcctcaagagatcctcctgcctcagcttcccaaagtgctaggagtatcggtgtgagccacctgccctgcttgaattgttttttttttgttgttgttttgtttttttttggagacggagtcttgttctctgttgcccaggctggagtgcagtggcacgatctcagctcactgcaacctaaacctccttgggttcaagcaattctcctgcctcagcctcccgagtagctgggattgcaggtgcccaccaccatgcctggcttatttttgtatttttagtagagatggcattttgccatgttggccaggctggtctcgaactcctaacctcaggtgatccacctgcctcggcttcccaaagtgctgggattacaggtgtgagccaccgcacttggccctgaattgtttaaatatgaagatgaagaggtctctgctgtccttactcctctggcctctaataccttctagccatcttgccttactttggaagggagggagacagatgtagttgttcacagttgagagctgctgaaacactgtgactttatggacagtagtagggagaaagcaagcctaatccgtttataaatgttccattatatacaaaataccctttctaccaacagtaggttcttaattactgacaccaggcatgctttggttgtgactccagcagcgcgggttggtggcatcttacactgaacagcctgggcctccactctccccttctgtaaattttgcctgtcactaattgtttgggcccagtttcttcatttatataagaggattataagatttttgtgaggggatggtcaataattaagtgaaaaacagatgatgtatgttcataatcaccttttagtctctaggtcattaagcctagattagcctattttggtgtattagaaatttgctgattatctggactatgtattagtagtacatgtagaagatttcttttttctgtgtgtgtgtgtgtgtgtgtgtgtgtgtgtgtgtgtgttttcttatagatgtggtctcactctgtttcccaggctgaagtgcagtggtgcaatctcagctcatgcaatgccaccaatccatgttgctggagtcacaaccaaagcatgcctggtctcagtagttaagaacctactgttggtagaaagggtattttgtatataatggaacatttataaatggattaggcttgcttaggcctgggttcaagcaatccttccgccctagactcctaagtaattggaactataggcacatgccaccacgcccagctagtttttgtgtattttttgtagagacggggttttgccacgtcacccagaacagccttgaactcctgtgactgttgtgggaaattgatctagactcaagtgatctccctgcttcggcctccaaaagtgctgggattacaggtgtgagccactgtgcctggcctgtaaatatgtttgaattacctcatttcatcttgcatgcttgttatttttaacatgccttttctccctttaatttttaaaaaatttggctgggcatggtgacgcacgcctgtaatcccagcactttgagaggcataggtgggtggatcacttgaagccaggagtttgagaccaacctggccaacatggtgaaaccctgtgtctgttaaaaaaaaaaaaaaattagccaagtgtggtggcacgcacctgtaatcccagctatttgggaggctgaggcaggagaatcacttgaacccaggaggcggaggctgcagtgagcagagattgtgccactgcactccagcctgagtaacagagcgagactccatctcaaaaaaaaaaaggccggaatcctagcactttgggaggctgaggtgggcggattgcctgagctcaggagttccagaccagcctggtcaacatgatgaaaccccgtctctactaaaaatagaaaaattagctgggcgtggtggtgggtgcctataatcccagctactggagaggctgaggcaggagaagtgcttgaacctggagggcggatgttgcaatgagccaagattgcaccacttcactccagcctgggcgaaagagcgaaactctctctcaaaaaacaaaaaaacaaacaaaaaaatttttttttttttttttttttttttttttttttttttttttagacggagtcttgctccgttgctcaggctggagtgcagtggcactatctcaggtcactgcagcctccgcctcccaggttcaagcgattcccctgcactcagcctcctaagtagctgggattacaggtgctcaccaccacacccagctaatttttatatttttagtagagatggggttttgccatgttggccaggctggtctcgaacacctgacctcaggcgatctgcccacctcggactcccaaagtgctgggtttacaggcgtgagccaccgcacctggccaaaaaaatttgaaaattttcaaacattcaggaaagttgaaagaacagcacaatgacatacttgttttaaaagaccaattacagtttaattatttgatataaagttaagttttaaattatgccagtaattaatactttagacattttattccacatggttaaattttacctttttaactattcaacttagtatttatgtgctagaacctaaaatccctaattgtttatgttttgttttgatttttattttttggaattgttgcatattttctgaataatcttcccatgtttatgatagcaaaacattggaactgaaataacaaatctgtttcaatatacttttttatcatgcaaaatgacattttaataaatattgttttagccaggcacggtggctcacgcctgtaatcctagcactttgggaggctgaggcgggcagatcacctgaggtcaggagttcaggaccagcctggccaacatggtgaaaccctgtctctaccaaagtacaaaaattagccgggcatgatggccggtgcctgtaattccagctactcgggaggctgagatggaaaaatcgcttgaacttgggagatggtggttgcagtgattgcagtgagccgagatcgcaccactgcactccagcctgggtggctgagcgagactctgtctgtgtgtgtgtgtgtgtgtgtgtgtgtgtgtatacacatatatacgtatatataaattgtatatatataaagaaagaatatatatataaagaatatatatgcgtatatatataaagaaataaagttgttttaaggatggtcattctagtttataaatacatgtttattagaggccttctacttatctatatcaacattagggattttaatgtaagtgccaaaattaaggatcatcagtattttttcttttgactttctgtaattggctcttttttcctgaagctgaaatgaagaaagattaaagacttcttaaacatattctagctttggtttaaaaatctgaacattatccaaacttgaagaaactatttacctgtttcttcattgcttaatacttagtctctatgtttttctattttttgtacctaaataaggagtgtttgtctcaataaaatatctaggtccagcaatatgtttagaaaggttttaataacttgctgaaagcatgcattttgtgtaaagtgtggcaaagaaggaaacaattgtactttcactgggaaaagactaaaaggaaatataaataccaagctgttgatagaggttgccttcggagagtggaattgtggatttttttttcacctatcttttcagttttctaaatttcccacaattgtcacctataacctttaaagggggaaagtgtaagcaatcatgatgtaggccctgttgtaaaacagaagtaaatgggactgtgcctatttgcctacttggtgctgcccttttccgtgtgttgtctcctcgccgaagagctccgggcccttagccctgaggtgctgcctctgcttggggctgagcttcctgcactcctgggtaactctcctgctttctaggccacagggccagggacctcagagagaagaatgcctttccttttctctaggtatgtttctgtttgttttcagcgtaggtgacctaccttatgctgctgaagtcccctcatagagatagaactgatttcgttcacttttttcttttcttaactgctctaggctttctgttagattttcaaaaaatgtgtgacttcctgcttacatatggtaaatgtttacacgtcaggaagcttttcctttttgtgtgtaagaagtagaagctcactggacttatatgtcagcattctattaatcttaattcccccattttgtttctgtgatctgctatgacattacaaaaaaaattggtttatctttcttctttcgttttccagtgcctttattgcatggaacagtatcccctgcacccacgcttcaccctggttagtttaccaggctaactactttgtgcctctttggtgaagttcgtattcctaaaagtatgaggttatcatcatgggctctgaatccagactctctcttccattgtttaataactgtataaactgtgttttagtctctggaagagggaatactaataatatttagtccatagctttgttaataggattaaattggctaatataggtcaggtgtacttgcaagcacttaaactttccattcgttattataagctattactattaaggatcatgccagtaaatcctcaccaaaattgacttcattattttggcataatgttattgtagactattatctttgattccgggagtaaggctaagttgtcatttgaatgagataaggacctcgaaatcagttgtaaagacaatcttggccgggcgcggtggctcacacctgtaatcccagcactttgggaggccagggtgggcagatcacgaggtcaggagattgagaccatcctggctaacatggagaaacccatctctactaaaaaaaaaaaaaaaaaaaaaaaatacaaacaaaaacattagccaggcgtggtggcaggtgcctgtagtcccagctacttgggaggctgaggccggagaatggcgtgaacctgggaggcagaggttgcagtgagccgagatcgggccactgcactccagcctgggcaacagagcaagactccgtctcaaaaaaaaaaaaaaaaaaagacaaaatgttttaatgaggagataaaaatcactgaaccagcctgttgtttttatattggatcagtatagctttgtaccgtacctggaaataaaaataaaaatttttcctgagtaaattaataagatgtaggaaagatattaaggtttatttttaagtaagctctaaatagaaatgataatctgattataaaaagaagaatatgaaaaatatttaatatgctagtgctctgactcaaaaattaaaacctacattttttctttattatttgttttttgagacagagtctcgctctatcacccaggctggagtgcagtggcacgatctcagctcactgcaagctctgcctcctgggttcacaccattctcctgcctcagcttcccgagtagctgcgactacaggtgcctgccaccacacccggctaatttttttttttgtatttttagtagagacagggtttcactgtgttagccaggatagtcttgatctcctgacctcatgatccgcccgcctcagcctcccaaagtgctgggattacaggcgtgagccactgcacctggctaaaacctacatttttttcaattctctttttaacatttgaaaattttgcttaatctaaaatatactccagaagtttaaatggaaagaccttaataaaatattcagtcaaatgctcttcctttagaaatggaggtactgaagttcatttctcctatcattctaaattgatgtttcattttgactatatatttagtgagttatggcagtaaaagcagctttaattttttttctgaaagcctactcatattggagccctttataacttgcctcttgaagtatatatatttattcatacaaatcaaacactgatgtctgtgaagtttcatatcatcttttatatttgaattttgttcatatacttattgtcacccaggctggaagtacagtggtgtaatctcagctcactgcaacctctgcctcctgggttcaagtgattctcctgcctcagcctcccgagtagctgggattacaggcatgtgccaccatgctggctaatttttctatttttagtagagatggggtttcgccatgttggccaggctggtctggaactcctgacctcaagtgatctgcccacctcagcctcccaaagtgctgggattacaggcatgagccaccaagtttttaattgatggcattttaaagaatacctcatattttatactttccagacattttccccacttatatgaaatttaaaatgagagtatagctgttatttgttacttggtcataaaggtatttggaaaagcactgatcttagaattttaataaaaggcatttattaccaaaaaaaaaaaaacactggatatattgaccttaaaatgagtaattagtattttccagtaaagcattttggattcaacatagactatgcttcaccctacctcacttctattagaaaaccttttttaaaaagaaattttctttttgtcagctttagtaaataatgtcattcaggattcctattcacaatctgagatctgccacttaacttgctcagaagccttacagtccacaccatttgttctatcctttcaattcaggttttatttgtttatttatttatttattttttttggcgtgctgttgcacaatcttggctcactgcaacctctgccttctgggttcaagtgattctcctgcctcagcctcccgagtagctaaggttacaggcgtgcgctatcacgcccagctaatttttgtatttttagtagagatggggtttcaccatgttagccaggctggtgttgaactcctgacctcaagtgatccacccgcctcggcctcccaaagtgctgggattacaggtgtgagccactgcacctggcctcaattcagtttttaacttgagcttaaacgagatattttttaaaagttaaaatctgtgttgaggcatatcaagaattgctatgtctcttgggggagagatgtgaattccatcaacatagatatgctagtttatagtgaactgttaggaatgctgtacccttgactcatacttagtcttttctttgtggcttgtggctctcttttcaacttcattaacatgtaattgaagtgtactaaatgcatatacttattttttatgttttttcaattttttattttttgtgtgtgttggggggtctcactatgttgcccaggctagtcttgaactcctggcctaaagtgatgctcccaccttggcatcccaaagcactttacagatgtgaggcactgcactttaaatgtgtatatttaaaaatgtacagtttggttagttttgacatgagcatatgcctgtgaaatcatcattcccaagagagcaaacacttctgttcccccaaaaggttcttgtgcctctctgttttgtgtcctttcttctcctcccatcttcaggaaaccactgatggggtttttgtcactataattagtttacattttctagaatttttctggaagtggaatcatagatatatacttcttttttaatctgacttctttcacttagcataataattttgagattcacgcatgttgttgcctgtgtaacagttggttactttttattgccaagtagcatttcattggatggatagatcatcatttgtttattcattgatcagttgattgacatttgggtttcagtttttggctcttaaaaataaagcttgatagtacatttgtatagaaatctttgtgtgggcataaattttcatttctcttaaccaaatacctagaagtagagtggctaggtggagtggtagctgtgtaatgttttaagaaaactatatttttaaaagtttgtacaattttacattcctctcagcagtgtgtagagctgttccacatcctcaccaacactagatgtggtcattctttctcatattagccattctagtggaaatatagtggcatatcagtgtgattttagtttgcatttccctgatgattaataatgttgaacatcttttcatgggtttattgcccatttctagaagttattttacatctcagccatttcctcactgagctgtcttattcttaaattgtaagagttctttagatattgtggatacaagtactttttctaatgtatgtgttgcaagtaagtgttttctttgtggtttgcttttttgttttcataagggttatcttttgaagaactgtttttttgttttttttattactttgaagcccagtttactaattttttcttttttgtttttttttgagatggagttttgctcttgttgcccaggctggagtgcaatggcgcgatctcggctcacagcaacttcgcctcccaggttcaggccattctcctgcctcagcctccagagtagctaggattacaggcatgcgccaccacgcccggctaattttgtatttttagtagagacgggtttctccatgttggtcaggctggtctggaactccggacctcaggtgatccacccgccttggcctcccaaagtgctgggattataggcgtgagccaccgcacccggcctaattttttcttttataaatcatgcttccttgtgttttgagaaattgcctagcctaagttcaggaagatattctcccatcttttaagatttttatatgaagcatatatggttttgcatttaggcctaggacccgttttgaattaatttttgtgtattatgtaaagtgtcagtgttggcttttctccccacctggatatccagttgatccactttgtttgttgaaagacttttttcctccagtgatttgtctttacaactttgccaaaaatcagttaaccaaacgggtaggtctttctgaactcttcttttctgttttattgatctgtctctttacaccaatcccaaaaggccttgactactgttgttttatagtaaatcttgaaatcagggtaaatctttcaactttgttcttttaaaaagttgctctgcttattctaggtctttactatcagcttgccgatttctgccacaaagcctgctgcaattttgattgggattgcattgaatatacaaaccctttggaaagaatggcattttcacagtatttaatctttcaacccatgaacttagtatcttagtaccatttatttaggtcttctttaagttttcttcgcaatattttgtagttctaagtgtagaggccttgtatatgtttttttgtgtgtttgtttgagacggagtttcactcttgttgcccaggctgggcctcccgggttcaagcgattttcatgcctcagcctcccaagtagctggaattacgggcatgtgccaccatgcctggctgattttgtatttttagtggtcaggctggtctcgaactcctgtcctcaggtgactcacccgccttggcttcccaaagtgctgaggttacaggcgtgaggcaccgcgcccagcctgtcttttgttaaatttacatttagaaattttacatattttgatgctactgtaaaacagttgtttttcttaattccactttccaattttttgcttgctagtatttaagaattcagttcattttaatacattaaccttttatcctgcagttttgttaaattcacttattgaatatagttattgttttctagattctctgggattttctatataaatagtgatatctgtaaataaggagagctttatttttactttccaatcttcatgcctattttttgcttgttgtttttcttgtcttattactttattgagtaatctccatatcagtgttgcacagaagtggtaaaagcagatatccttgtcttcttcctgatctcaggctgagaaattcagtctttaaccgttaactgtgatgttagatgtaggttgttcatggatcccctatatctgtttgtagaagtttcctactaattctaatttgctgagaggcatttttttttgtttttttttttttttgagacagagtctcgctttgtcacccgggctggagtgcagtggcatgatctcggctcactgcaagctctgcctcccgggttcacgccattctcctgcctcagcttcccgagtagctgggactgcaggcaccggccaccacgcctggctaattttttgtatttttaggagagacggggtttcaccgtgttagccaggatggtctcgacctcctgacctcgtgaaccgcccgtcccaaagtgctgggattacaggcgtgagccaccacacccggcctggttttttttaatcatgattggatgttgcgtttttgtcagaagcttttaaaaaaatatctgttcacatgatcatatgggctttctgctttattctgctaatatagtatattacattttctgaatggtttaatcttgccatttctaggataaactatttggttatattttagtatcctttttatataatattgatgttcaatttttaatttttgtgaatgatttttgtatctgtattctttagggatcttgttctattattttttgtaacgtctgtgaggttttggtattatagttgtatgacctaaaaaagtgaagtgggtagtgatctcctttttttttgtttgtaaaacttttcataatttttgtattatttcttctttgaaagaattcaccagtgaaacagactatggctttcttttgggggaagttttttgttttttttttttttcttttgagacggagtcttgctccgtcgccaggctggagtgcagtgctgcgatctcggctcactgcaacctccgcctcttgggttcaagtgattctcctgcctcagcctcctgagcagctgggactacaggcgcgtgctaccacacccagctaattattgtatttttagtagagacgttggccaggatggtctcgatctcctgacctcgtgatcccaaagtgctgggattacaggcatgagccaccgcgcctggccggggaaggtttttaatgataaaatcagcttctttaataaatataagagtattcacattctcgtatcaattttagtaagctttattttccaagaaatttgtttcttttatctacactgtcaaatttattggcataaggctttttactatttcttattttttaaatgtttgtaggattgatggggatgccccttatttctacgatttttttttctctctgtatctagctcgaggtttgtaaattttttttttcaaagaaccaaagtttgattttgtaattttctctattgtctgcatttttattcatcctgccatatcactgtaatttcctttcttctacttactgttggtttacatttctttttccaagtttttttctgttattgtttagattactaacatttaatgtaattatcggttgttggaattagacctgccatcttcctattactggttttgtttgtcctttctgtttttttttctttctttcttctgtttcttttttcttgacatctttggatttttaacattccattttcatttgcctcttgactttttggctatgtctttttctgtgtgttgtgtgtgtgtgtgtgtgtgtgtgtgtgtgtgtgtgtgttgtgtaattgctccaggtagtaaatatatttacttaaccttttattatcagcttagagttaatattttatcacttcacatagaatgtagaaggcttgcagccataaaagtccctttaccctccccccagagacatttatgttacagttgtcatatgtgttatatttatgttgaaaccctactacacagtgttacagtatttgctttcaacagtctacatattttaaagaccctaataggaaaaataaatttatatttactcagatgtttgccatttcttttgctctgctttcattcttaaagatctcagcttctctctaaaattttcatttgattctttttaaactagtttttctttctctgctgataacttgtatctttccatgcatttgtgtttgtgtttgcctcatggaaagtaggtgtaatggctgttctacagtctttgtgtgataatctcaacattttcattgtcttggagttggcatctgttgattgcaattttttttttttaagaatttgtcagattttcctacttctttgtatgtccagtagttttggattatatcctggacattgtgagtttcatgttgtatagatgttgtgtgctgttgtaatcctctgcagaatgctgtttgtttcagtaggtatctaacttggttagatctgccttggttatataccagactataaattctctatgctgtctgtggacaggggttcctttctcagttcagttttcaagaccagtgagtgctgtgcttctttgagcctgccgtgcatatccatatctcaggtgtgagcctaagacaagcgggagttaattcacacaatggcaggtcccatttctaccttctttcctctctggttttccccacactttacagcccacaggtgcctttttcattagttcctttaaccacaaagaccgtgtttctgttggagttttagtctctgcacctgtgcttcactgcatagctccctgactggggcccacctgtggggcagagttgtagagaaaagacaaaaaagaaagtttttactccatggaaaggaaactttttagaaactttttactcacctcccaaatctgcctgcttttgtctacttcttattgtcctcaagtattatagttacattttgtgttctgtctgctatagcagaagcagaactctggtttgtgacattttattttatttttatttttgagactgagtcttgctcttgctgcccaggctggagtgctgtggcaggatctcggttcactgtaacctctgcctcctgggttcaagcgattcttgagcctcaccctcctgagtagctgggattacgagtgcccaccaccacgcccatctaatttttgtatttttattagagacagggttttatcatgttggccaggctggtcacgaactcctgacctcaagtgatccgcctgccttggcctcgcaaagtgctgggattccaggtgggagccaccgtgcctgaccaggttttgtgacattatttaatgtgttggatatgtgattattctttttcaacatggtagcctttttttgtttttgtttttgagacggagtcttgctccgtctcccaggctggagtgcggtggcacgatctaggctcactgcaagctctgcctcccaggttcacgccattctcctgcctcagcctcccgagtagctgggactacaggcgcccgccaccacgcctggctaattttttttggtatttttagtagagacggggtttcaccatgttagccaggatggtctcaatctgctgacctcatgatctgcttgcctcggcctcccagagtgctgggattacaggcgtgagcaccactcccggtctcaacatggtagccttttacaaattactatatttttttcaaattgtagtaattcatacagcaagcatatataatggtaggacaaaacaccttaagccaagatgtcatctccatggtctgtccaggtagcatagaacacaaaaggagatgtgattgaaagatgttgcttcatctacatgtttctactattgtctggggttccttaggagccaaggagaacctcgctgtgattggcattggaaagacctgtggttggaagaaaattacctgggaacattccagcctcatcttttttttttttttttttttttttgagacggagtcttgctctgtcacccaagctggagtgcagtggcgctatctcggctcactgcaacctccggctctcgggttcaagcaattctcctgcctcagcctcctgagtagctgggactacaggcatgtgccaccacaccgggctaattttttgtttggtggagacggggttttaccgtgttagccaggatggtctccatctcttgacctcgtgatccacccgccttggcctcccaaagtgctggaattacaggcgtgagccaccgcccctggcccagcctcatctttaagccataatttggctattgtgttagtgaataaacctgaaaggtacatcttcattcatacataaacataatttagttttcattaggtagattccttgttcacatccagctgagaacatgacactaaagaaatcgggctttaattggggagggaaagagagagaacgtggagtccctttggttgtcacttaagagatacagatgaaggagaagtagagttggaggtcagaagggccagaaggtaaatgtagtctaatattagtcatagtgaggtgaaggcttttggagggtagagattcacctagggtgagaattatttcctaagttctagagtagcatggtaaataacaaatagtcttaggtgctttgtcaggaactgataatgactacaagtatatttgaaatcataagagttatatttatgtttgctgtgatcctctcatagtagctgtgaaatatttaaagtaaggcataaaattattatatctatatctatatctataagtaaaaatggtctattttaatgccttcagtatcatagttgagtattaagctaatgctaacttcataaaatcattttttcctaagataatttttgagatttataggaaggtagaaatgcatgcatttcctctggatttgccatttgttgcatagtattatgtataacattttcttaaacaaaaagcttaaagaaaatattagcaaatcaaacctagctgtgtagtgaaagaataacatgcatatatgaattggtctattgtacaaattctaggataattcagtatttgcaaatatgtcactataattcagaatgtaagtaaaggagaaattcattatctcactagatgcttaaagaaagcttctgaaaaaaatttagccatttcttaataaaattataaaaaataggaatagaaggaaactacataaatatggtaaataatctttactaaaatacaacaacaaaccaacctattaaaatatgaaataccaaaactgtcactgtgaaagtcacaggcaatacaaaaattattgctatcacaactattttgtatagcttagtattattgctttgggctagtaatgtaaggctaaattctttatttccagaaaatataggtctaggaaatctaaagagattcatatgtgagactattagcactaataagaaagtatggtaaagtagctggatacaaagaagagaaatcaataacctctttattttgcaacacagtaaaaaaatggaagtaaaactgaatgaacagaatgtattctcatatatattaaatatctgttttactatgcatttaaaatccagagcttaccatttttgggaaactctacaaaaagatatatgacatgttgattccaaaaggattttatgaggactaagtgagataaaacacactaaaatgttcaagagaattatcaaggttgcctatacaatatattgaatgagaaattgtcgaggaaaagaaaggcagctgcaatttctaaagggaatctacagtgagaagtagtctgattcacaaacctctggttaaatatggtgtcttgactacacttgttttctccttccctaaagtctgcaataatctcaaaggaagcttaaaaatgttaattcatagctgggcagatggggtgttgtcacctgtaatcccagctacttcggaggcagaggcaggagaattgcttgaacccaggaggtggaggttgcagtgagccaagattgcaccactgcactccagcctggggacggagtgagactctgtctcaataaataaataaaataataaaatacataaataagtgaaatcttaattcataaggagaaacataacagtaaaggagacagtgaccaaagattttaacaatttttcaaaacagaaagtgaatggagggagtagtaactgagttcacagagaaagataccacctaagtacctgcagaggtcagttatggagataacagcatgccccagggatatcttgagagagttccttgtgcttgggggctccacgtattccaaaaggctgaagtcagttttacagctcacagtggaaattccttaaaagtccatatccagatctcttagaccttcctctcctacactccagcagatgggtaactacttcagtcccgtctgctggggaaatgggaggagcgctagaaccggaagtgctccagactagagaggtgaagcacgggattgaaagtcaagtgagcctgtacaggtctgcacactgaagtgtagggccctacctccttccttcttcactcctcctcaaggcagcacttagatgagttgatcccttcacaccccacccagcagttcgttctacctggcaaaacttaacagcttcggtgaagaaacctccacattactgaacatttggaggtgtcccaatgaaaaggtaactcaatatacctgatcattttacagagaagcccatcagtcaacaagcttgccacccacgctgagcttgggcagttttttagtgcctcattattaaatatggaggcgcatccagggaccactagatatacaaggaaaaccttaaaagtgaaagagacgaccgagacaggcggatcacaaggtcaggagttcgagaccagcctggccaacatggtgaaactccatctctactaaaaatacaaaaattagccgggcatggtggggcgagcctgtaatcccagctactcaggaggctgaggcaagagaattgcttgaacctgggaggcagaggttgcagtgagctgagatcgcctgggcaacaaagcaagactccgtctcaaaaaaaaaaaaaagtgaaagagacccagtcaatgagccaatgaacaaaaaaggaacccagaggaatccaatgatccaagaaacagaagaacagagaacaagaaagtgcttttggaaatttaaaaatgtgatagttggaaaaaacttctgtggacaaattggaagatgaaattgagatgtattagggcaagagactcattttttttaatttaaatttaagattttaaatctgtgagtatttagtactcattctttttttttttttaatttttgtttttgagacagggtctctctccagttgctcaggctggagtacagtgacaccgtcttagctcactgtagccttgacctcccgagctcaggttattctgccacctcagcctcctgagtagctgggactacaggctcatgcaaccacgcctggctaatttttgtatttttactagaaacagggttttgccatgttgcccaggctgatcttgaactcttggactcaagtgatctgcccgactcagcctctcaaagtgctgggattacaggtgtgagccactgtgcccagtcaatactcatttttaactgtgcatttaccctgttaaattaaacgtaaggaaaaatattcactaaatctggatttttttgagacggagtctggctaagtcacccaggctggagtgcaggggtgcaatctcggctcactgcaagctccatctcctgggttcacgccattctcctgcctcagcctcccgagtagctgggactacaggcgcccgccaccacgcccagctaattttttttgtgtgtgtgtgtgtttccagtagagatggggttttaccgtgttagctaggatggtctcgatctcctgaccttgtgatccgcccgccttggcctcccaaagttctgggattacaggcgtgagccactgcgcccggccctaaatctggatttttgtttttagttagagaagaggactggctttttttcacatcggctgttgatgaataaataatgcctgatggagatttttggagcattagatttgtgtttggtagtctgggacagatgttagtgtaatatgcattgtttacaggatatggagttagcaggacagctaactccacagcgtttggtcaccaaacgaatgatatcgtgctaatcacgtaccctttctgattttcatttacctgatccataatatggggatggtaataatggtaacctatctcacagggctgtgatgatgagtagaagagataagacctataataaattacctagtataatgtgtagcatgtactaaatgctcaatgaaaagaagctttgattataaccatcaagtagatggactggtaattatagatggttaagaaaaaggtacagtcagccctccgtatccatgggtttcacagagtccataggttcagcctaccatagattgaaaacatttgggggaagaaattatgtctatactaaacatgtacagacttttaagcttacagaataacagttgtttacatagcatttaccttgtattaaatattgtaagtaatctagagattatttgaagtatgcaagaggacgtgcttaggttatatgcaaatactgtgccattttatatcagggacttgaggatccacggatttttttttaatccatgggaggtcttggaaccagtgttcctgggataatgagggacaactgtatacttaaaaagtaacacgtgaatgaatgaattccttaattgtagagctatgctctggctctagtattagtcctctgaccattaaagatagcatgttggtgtgtttatgattatacaggaattaagttttcataaacttaaatgttgcattttcacttacaggcgtcgattagcaaggtaaaagtaacagaaccatggctcagtttccaacaccttttggtggtaagttttcagaaatttctctttttaatgtactttgggaccagattttaaaaacttgatattatggcaaatttaaaattaaaaagtagagaaaataatataatcagcattcatgtattccatcatatagtttcattaattatcaactcatgcccaatattgtttcatctggattcttttggagcaactcccaggcatcatttcatctataaatattttagtatgtgtacctaaaagataagaaaacgtttaaagacataacttcagtaccattatcacatctataaaaatttacaataccgggccgggcatggtggctcacgcctgtaatcccagcactttgggaggccgaggctggtggatcacctgaggtctggagttcaagaccagcctggccaacatagtgaaaccctgtctctatgaaaaatacaaaaattagccgggcgtggtggcaggcacctgtagtcccagctacttgggaggctgaggcaggagaatgacatgaacccgggaggcggaggttgcagtgagccgaggtcgcaccactgcactccagcctgggcgacagagcaagactccatctctaaataaacaaacaaacaaacaataccatattattgtacctgtaaaatgttcgctacatctagtctgtaccttatagtctttggacatttccctgatagtctttagacatttcttgttatggtttgtttgtttaaattgggatccaaataagatacaaacattgcaattaggtcatgtgtttcccaagtctcttagtgaattttcccccactcctctgtttttttatcagcaagttatttgttgaagtgatggggtcatttacactttttcaaagcctggatttgaagcatgacatttttgtttgttttacttcagttaaactaaacataagtttgaaacatatcagtctgcataaaatgtgttttttgggtaatttttcctaatgttattaggaaattgttaagtgttcttgcttacacccaagttactttttaacaaaaatacttattaaaaagtacttattaaaaaatacttattaaaagttcatattaacggattactcttggaagctgtctaatcttgtcatgaagagagtaaaagtctccgtgggattctggtacagagatctgtaaacttttaaaaatcactagttattctattttatttttgtcccccttcttaattactgtacaatttctggtttttgtttatagttacagggatgaattctgacagggcagtgaaaatttcttctagaagttgcagaactgtaaggcctgtgaggaaggggtcatttctgtcttggacacccgttcatccccacagtaaatatttttccagtgactgaatggatttttactttatctgtcagtgtcatcccagacccggtagagaggagagatgcaatgtttagatgtttttgctggtgtgctgggcacattcacattttgtgtgaaacatacgtattgtgtattcccagttttgtggaaggtgtccgagcttttgaaagctttcatgtatgtaatctagaattattttagtcaatttgaggagacctaggactaaagtctgcaagatctcagtcgtgagtggacatctagtcagcctaagagctgaaactgaaggaaaacctaaaacccattctctttggctattatttcatatcaggacatcccctgcccttctttttttttaagtctgtttcctgcatactgagatacctgtttttaaaaacagctttagtgaaatataatttatattccataaaatttactagctttagttgtataataatttttagcaaattatatagagttgtgcagccatcaccacaatctaatatattaatattttaatcaccccccaaaagattttcatggatatttatcacactcaccttcttctttcataacttttgcctgtggcatttaaggcacttgagagtacagttttaggtttaagttaatttagtctgttgcttgggtttatgtaagtaaattattaatttactataatcttgctaactatgggattataaaacaagtttctaaaaaaggaatgtgtgcctcttcttttctttccctcccattctctctctttctgtttcttacattttgtgtcctgttttacacttttctaactttatatgcataacttccaaggacaagaagatgtgaatttatcaagtctttataatacattgacagaatcttgaagtgctgtggaaatagtgtgtgagagcattttgttttccttttctcactgaataatttgtttgtcttttctttggattttaggcagcctggatatctgggccataactgtagaggaaagagcgaagcatgatcagcagttccatagtttaaagccaatatctggattcattactggtaatcacagtcagcattttttcatttttacttatcagtagtgcagatgtctgtggaaactctatcatgcaaagacgagatgggcaaatatgaccaaggagagacatttacctgttttgccctaaccttgtgcctgtccttttacaatttttttacacataatggaatcataccttgtttgcaatttttagtgcatgtcaaaccacttgttttgtgcatgtaatttatgggaattggttaagatcaaaggaccaatggctcacacctgtaatcccagcactctgggaggccgaggtgggcagatcccttgaggtcaggagttccaaaccagcctggccaacatggtgaaaccccgtctctactaaaaataaaaaattagctgggtgtcgtggtgggcgcctgtaatcccagctacttggaggctgaggcaggagaattgtttgaaccctagaggcagaggttgcagtgagccgagatcacgccactgcactccagcctgggtgacagagcgagactccatctcaaaaataaacaaactaattttcctgtttgattatttttcagaattcactttataaaaagtggaatctttatttccaggggaattgttctgctaccatgcccagctaattttttcttcttctttttttttttgagacagaatttcgctcttgttacccaggctggagtacaatggcgtgatctcggctcactgcaacctccccttccagtttcaaacgattctcctgcctcagcctccgaagtagctgggattacaggcacccactaccatgcccagcttattttttatatttttagtagagatggggcttcaccatgttggccaggctggtcttgaacttctgacctcaggtgtcgttcttaatcattgttatttattctctgtaaatacttcagaagtacccagaatttggagtataggtattgggaatggcaaataactttttttataaagtgaaagtatgggtcatcagtttcctaaggatttctataaatgtgcttttgcacaatgggtagctgttcatatcttagttaatagcagattaattaaagtggaaaatctatgccaggaaatggtaggccctttttgagatgattttttgaattctaaagtcagtgctgatggattcttttactgttgcctatgggcttatccttggacttttataatgcactcaactggtatttatagtattaccagcctctttgtaaattttgtaattttgctattacaggatttctgtcagctgttgtttttttttttttttcctgaaactttttctgtttaatttacaggtgatcaagctagaaactttttttttcaatctgggttacctcaacctgttttagcacagatatggtaagttggaattttacatgaaattttacataagcataaggcaaaataaaatatcgttttgttctatttggtaatatgatttcttatgttataaaaggagaacatgtatctctagcctgaaatatcttgttacttcttaccagagagttatgtctgaaaagtgtctttctcatatggaactaaaacaaaacaacaaaaaaagtggtgacatttgaatgacaacactgtcaaaaagttgaatttccatggagacatctaaattttggtgttccttcaccaattagttttggcttcacccatatcacccacatttatttgaatgtcccacatttcttgctttataatggaatgattttttatctttcattgactgaagaataaaaggtaaagaaaatatttgagagttagtgcatggtaaatccataacattaatagataatagtgaattatttgactatcacaaataggcattcaatcttttaagccacaggaaatacagagagtataataaaaagggtggcaaatacagttttggattcttggctcatggctttggagagccatgctgaattctgttgtcctctaagatgtctcatttttttcaccaagggtgcttaatacttcacttccctgagttaattagtgatacgaaggcagctcgctatgaagaaagagcatgtaggctgggcgcggtggctcatgcctgtaatcccagcactttgggaggccgaggcgggcggatcacgaggtcaggagatggagaccatcctggataacacggtgaaaccccatctctcctaaaaatacaaaaaattagccaggtgtggtggcgggcgcctgtagtcccagctactcgggaggctgaggcaggagaatgatgtgaacccaggaggcagagcttgcagtgagccgagatcatgccactgcactccagcctgggcgacagagcgagactccgtctccaaaaaaaaaagagcatgtgatttgtagtcgtacacctgagtttgattcccaggtgtaccattttcagtgtctctgatttggagatacagttaccctctttgacctcaagttttctaatctagaaaataggaatggttatagttttgtgagagttgttgagaggattccagaaaaaccaaggacttattgtggctcctgtcacataataggccctcaaagtaaaacccaaaaaggtatcatctccaggggctgggtattctacataactgaattttccagctaactactttgtcctcttaaattaccaaacttttaaatttataatcttgtggaaattaataaaggttgatacagctttttgtttcttttaagcacagtctacagaacacaatctaagcttttcttgatgaaatgtcatcattatgaaaattagtaactgtcctgaaatagcaaaactttcacaggagattgtgtgtgtgtgtttgtgtgtgtgtgtgtgtgtatttggatatatttgaattgaaacgaaatgataccagatctctgtgctttttttgggtatctgctttattttctttttcctggttgtcagcatattggccgccagactgtctctaaactagtgtgcttgctcctctgaagccattctaattctaacttctgatctattagagctaaaaaatcagataaccaagcggttttggaattacagtttaagtaaagtaagatgctcagatgaagaaacagcctgcaagaaagaagtcatgtgcaagtgagcacagaagccctgttctgtcagttaaatgtgaaagtttaaacgcaagagacctgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaatataatgagccctcatctttaaaaaaaaaaaaaaaattttttttttttgtttttttttttttttttttgagatggagttttgcccttgttgtccaggctggattgcaatggcacgatcttagctcactgcaacctctgcctcccggcttcaagcgattctcctgcctcagcctcctgagtagctgggattacaggcgtacaccaccacgcctggctgattttggtatttttagtagagatgggatttcaccatgttggtcatgctggtctcaaactcctgaccttgtgatccacctgcctcgacctcccaaagtgctgggattacaggcgtgagtcactgtgcccggccaaaaaaattttttttaattagctgggcattgtggtgcatgcctgtagtcttagctgctagggaggctgaagtgggaggattgcttgagccctggagtttgaggctgcagtcagctatgattgtgccttctagcgtgggtgacagagcaagaccctgtctctaaaaaataaaaacagttgtcctaactttctaaactatttttacctgagtggcccaaagtcaggtttttataatgactatgtatattaattaaagatggtaatgtggcaatcttagattgaatgaatctttaatttttttcttacgttttgctaaataaatttgtgatggcgtattttactatcaaaaatgtctgtaactctcttttcccaaaagaaatgtctttgaaaagtcattggaaatttcatgaaccactgatatcctgcccagatgatggaataatgcagtgcaaattatgagtttagcaagatctgcctttcaactgagctgatttgatacttattcacatagtaaccctgagtagtacttgatctcttaaagcctaggtttttttgtttgtttgtttgtgtttatgttttgagacggagtcttgctctgttgctcaggctggagtgcaatggcacgatcttagctcactgcaacctctgcctcccaggttcaagtgattctcctgcctcagcctcccaagtagctgagattacaggtgcccacgaccatgcccgcctaacctttgtatttttagtagagacaggttttcaccatgttggctagcctggtctcgaactcctgacctgaagtgatctgcctgcctcggcctcccaaagtgctagaattacaggcatgacccactgcagccggccaagcctaggtttttaaaattgcaactaataatagctgatctaaagaagcagctccctccaacccccatactatttttatgttcttctgtgatttttctggtagggtcccagggtaagtccttactccttttggtagacggaagaatgggtttgactctgaagttttaggcagtccttgtgtcagtcatctggggaagaagataattttttgcttttttgtttgtttttgagacagggtcttactctgtcaccaagactggagtgcagtggcatgatcatagctcactgcagcctcaatattctgggctcaaacaatcctccggactcaaacaatcctcccacctcagcctcctgagtagctgagtctacaggcatacaccaccatgcctggctaatttttgtattttatgtagagatggggttttgtcatgttgcccaggctggtcttgaactcctagattcaagccgtctgcccgcctcagcctcccaaagtgctgggattataggcattagccatcacatccagcaaagaagagaagtttggattaagaattggaaactgtgtctagtttctctctctgagctttacttactttgttctggactttgtttcaaatatttgagtgatacgaactgatggacagtatatgttagaaacctttattatgttttatttccatgtagaaactatattccagttaactaatttgttaactttcaactgtaatctgttaatgctttggggactccttgtctctcctggctgatttccaattaagaatacaagaaaaccttaattctcggaggatggagtcaagtcagtgtgtgtcatgccaaattataaccgtggccaaagatggtacatcttcctagaaattgtcttattaataaggagctggaaggaggttggcagatatccttttggcaattgaagtgcttagaattttttcaactttgctatgatgtggaggggaggagaataaagcagtgggaatagacaagagccagaaggtacaggaaggaagaagagacggggtgaagaggctggatgagggctctggaatctgagacggagggccagcagaaatggagagaaaagagggagtgagggagcactacctggaaatgggccctgagaggaaagaagggagccagacacatgaaggcaaggattagatcaactttgtgatctggttcagaatgggtgtcagggcaaacagccatatagtcatagtttgtactttcttaagacactcctgagtatgtgtcagaagggccttcagccccaacaagatcaatttgctaaactcatacaaaaaaaaaaaaaaaaaagaataagcaccctggactcttgatcccctctcctccatccctcattcctgagtctttaccatccagtagctcatggcgttgaactaagatgacatcttagttacctggctgcccaaaccaacacctgggcaccgtgcttgatttccctcttttcttcaccctgcatacccagtccatcaacgtaattgcatttacggactttatccccaatctggccacttctttcctactgctaccatcctaacctgtcatctcacctgggcccactgttcgagcatctggactgggttctctctttcacacttgcccctttagagtctagtctccaaacagcagctggaattttttttttttttttttgagacaaagtctcactctgtcgcccaagctgggcagtggcgcaatctgggctcactgcaacctctgtctcccgggtctaagtgattcttctgcatcagcaccttgactaactgggattacaggtgcacactaccatgcctggctaatttttgtatttttagtagagacggggtttcaccatgtcagccaggctgggctcgaactcctgacctcagatgatccacctgcctcggcctctcaaagtgctgggattataggcatgagccaccgcacccggccaggaataatcttttgaggagtgcagtggtgcgatctcagctcactgcaacctctgcctcacagcttcaagtgattctcctgcctcagcctcccgagtagctgggactacaggcgcgcgccactatgcccagctaatttttgtatttttagtagcagggtttcaccatgttgggcaggatggtctggatctcctgacattgtgatccgcctgcctcggcctcccaaagtgctgggattacaggcttgagccaccctgcccagccttcttcctgttctttaaatgggccaggtttctccttgcctcagggtcattgtacttagtgtttcctcttcctataattcagttgctctagttcctcacatcgcaggttcattgcctttcaggtttcagttcatatgtcacctccccaaagtggcattccctgaccagctagtgtaaagtggtcccctctgcccacctctttccctttaccttggtagcacttatcaccatgtaaaataatctggtttgttctcttgttagttctgcttgcactaaaatataagctctgtggtgctaggaactgtgtctttttcatagatataaccccaatttccagatagatgcccagccccccactcccccctgccccataattggtttttgaatgaatgagaatgaatgactggattagtctgcactgctgctgggtctcacctccagcccaaggggcagcaggtgagagatgagcagcctgaggccaggctttgtggatgaactgggctcctaaaggaatctgtaggtgccaacactgcagggaatgaggtgggacaagaggagcctggcctcatcccttcatcctgtaacacacacaaagtagtttcagaattgttacattcacctccactacaaacaacaaatttaggcccagtgcagtggctcatgcctgtaatctcagcactttgggaggtcgaggcaggaggatcacttgagcccaggagtttgagacctgcctgggcaacatagtgagaccccgtctctactttaaaaaaaaaattatccaggtatggtggcacatgcctgtagtctcagctactcagaggatggggtgggaggatcacttgagctgaggattcaagcctgcattgcgctatgattgtgccactgtactccagcctgggcaacagagtgagaccctgtctcaaacaaacaaacaaataaaaaaaaaaaaaagaacctagtaagtagtgtaaaccaaaaagtatctgagacaagaggtctcaatcattttaggagtttattttgctaaagttaaggacatgccgggaggaaataagcacagaatcacagaaactgtgcttttctccaacgatgattttgatggcttcagtatttaaagggaacaggtaggctggagggcaaagagggaggatatggtaatccatatattgccagagaaaaggagcaggcaggggaatagtcagttaggtaatagtaaatcagtaaagtgctcagtaagtcggcactttacataagataaaatggaacataaagtagcctgtagaggtgtttgaccttttatttgtagctccctgcttaggaacaaagggactcagctttcagggactcagctttcagcttacttttctaccttttgcatagtgaattgaagtcctgcgtttttattttcctttcacagtagatttcaagattactttgtagttccttttgtttttaaacagaggacatataaagtactatgtgaagttacttggactaggcttttttttctacctcttacgtggatatgttagttatttataatatgattaggtttattttcatttttatttaatttagatatgcctcctcatctttgtggacttaattttattatttaaatacataacagattaaaaaggttctaaaaaccgaaactaacaaaaaggtgtgctcagacaaggtcactccctcttctatccctttaccctgtttccacccattgtattagtttcctgttatccttcatttatttttgttggaaaaaagcaggtacataatgtatataacgtgtatgtattcatatttaaattacttcctttcctccttacattaaggtaacctgctataaatgctctctgttcttttttttttttttttttttttttttttctggagacagagtcttgctctgtcacccaggctggagtgcagtgacgtgatctcggctcactgcaacctccatctcctaggtttaagcaactctctgcctcagcctcctgagtagctgggattacaggcacgtgccaccatgcccagctaattttttgtatttttagtagagatggggtttcaccatcttggccaggctggtcttgaactcctgacctcatgatccacccttctcggcctcccaaagtgctgggattacaggcgtgagccaccgtgcccagcctgtttttttgtttttgtttttgtttgagatggagtcttgctccgtcacccaggctggaggtgctatcttaggtcactgcaacctccgtctcccaggttcaagcaattctcatgcctcagtctcccaaatagctgggactacaggcgcccgcgtgcccagccaatttttgtgtttttagtagagacagggtttcaccttgttggtcagactggtctcgaactcctgacctcaggtgatccacctgcctcggcctcccaaagtgctgggattagaggcatgagccaccgcgcccagccgtaactaccatatttccataaatttcttagaattttcattaccagggattccccacagttatgtttattgagaaaagcgttttttgagtatcacgacattttcaactaaatgttgggattgtcgtatgtggtttaaagtcaagtccctagaacctcatggttaagtttcttctcctcacccatgaaaacacttctgtaggacacctttagagtctaattaagccattacctaaagtcttctcccctaacctactcattatcccacactggatattcctgtttctcaccagagaccatactgggcagtggtgtggggaacagggagtgggcacctgcctgactgattgattggttttagtgtgcatgttgatgttgatttttattaatgggaactcttccccaccaaaccgttttaaatagttgcgtatcttttaaaaaactacttagcaaaagaaggaagttcaccatttcattttatttacttagtttcctttataaaacctgaaaggtagtacaaaaataaagcaaccagaagccagtttcatttatgagcatagatccaaaaaagtcaaaatcttagcaaatagaatttcacaatgtatgaaaagaatacacaatgaccaactttatgccagaggtgcaagattggttcagagtcgaaaaattctatcaacattagtcattatttcagcagataaaaggaagaagaaaacttgtgatcggattggtaattacagattaggcacccgatgaaaaatacagtaaccatttctaataagtagaaaggaaactacttaaatatgtgagactactatccatgaaaagagtcaaactctgtaaaatatttgaaaaggtttattccaagccgaatatgagtcaccaatggcctgtgacacagccctcaggagatcctgagaccatttgcccaaggtggttggtatataacatggttttatacattttagggagacataagacatcaatcaatatatgtaaaatgtacactatttcggtctggaacaatgggacaactggaagcagaggcttccaggtcatacgtggattcaagagtttttaattggcatttcattgaaagagttattatccaaagagctggaatcaatagaagggaatgtgtgggttatcataagtggttttggagaacaaagttttgtcatgcgggtgaagcctcccggtagtagacttcagagaaaatagatggtaaatatttcttatcagactttaagagcctcctttatcagtcttaaggcctgtgttgatgctaatgctggtcagctgggcctgaattccaaaagggaggagggtataatgaggcatgtctgacttcctcttcccatcttggcttgaactagtttttcaggttaattttgaaatgcccttggctgagatgaggggtccattcagatggtggggggctcaaaattttgttttcagtttacattactttccagaaatcactaccaactgtcattctaaacaatgaactctattaaactattagctctagtaaatctactgtttcatttaaactcagaactgagcaagaacgcattcagtaatgtcttagaaggcagtaagaccaataaaaaagattggcctaaatattggaaaagaaagataatgctcatttttttctagttatgtgattgtatacttagtacacccaagagattttagttttaaaacattaataagaacttgtaggagtctggtaggatagctaaatacagcctaaataattttttaaaataaaaaatgttctctgtgcttgaaataagcacctaaaaatggaaatggggggaatgtttcatctaaaatctggcaaaaatgataaaattcttcagaatacatttagcaagaaaagcatattatatgaaaaaagtgatacaattttattaaaggaaatagtatatttgaacaaccggaaagattgtcttttctttggttgggtaaactattggtgcaaaagcaattgtggtttaatcaattctccaaaaatccccttctaaggcagtttttggatcccagtagggttgtttgtataacagataaaataatctaaatgttcataggaaaatagacacccatgaataaccaagggggaaaaaaaaccttcccagaccttcccggatcacaatataccagagagccagtgtgatcaaatcattgtaatattgacctggaaattgttcagtcagaacagatagtccagaaatagttctcacttcatatgaacatttgatacatgataaaaatgtatattagttcagtgagaagaagagggattgattaataaatattactgggaaagctaggaatccatgtagaagaaatgtgattggaccctggaataactcccccacccctacccataattattggtttaaggattgaaatgaaataaaataatacaatgttagaaaatcaaggactaacaaccttctaatcatatgataaaagaaatattttatatacaaaaatttagaatttttatgccgtacatatacataaatcaacaaataatgaatttttaaaagtctttcagcagtcagcagataaacagttaatttgtgatacactatgagctcttataaactaacaacaaaagacatgcaatatatagaaaatttggcaaaggatttgaataagcagttcatagaagtgcaaatccaaatggccacgaaatacagaaaaatgatgctcaggttcacaagtagtgagaagaattcagattctgaattctttgctgaagggcccatgactacaggagaatggggaactcctatctgaggcaaaaaggtttctgcaaccacagagctttgtttcctgcgttatgatccttattttctaaaatgtgccaacttttacaatcttgatcacttttagagatttttttatctttgtcttatgccatactttttattgtgttacatgttttctttctttgagttaattccagctatgcagaattgttttctgtgtaacttaattttcttttgtgaacactgtccggatatggctcagtctaaaagatcatggtattttaattgaactgtcttatttagatctttcaaatacatttttcataatattggtttaaaaaaatcctcatgcttttaatatctggattaaaagaaataaaatctgaataaaacttttttatgcagaagaggttaagtcatgaatatgcacagttttgatgatataatgtagtttccagttacaaggacaaacttttgcttacttgatcttagccaaaaggccgagaagcgattccttttgcttactcttctttgagaaaatactttacattaaagctcattacagtttgcacttggaccgtgtatatttgagtaccattttcaaatagcagacacattttgtaagctaacttacaaaattgttgagtgatatggggcatgattctaaagaaaagttagtttcaagagctttagaggtttagtagcattatagttgagtaaccctagcatagcataagtaggtagcatagcatactgtgtcatgttcccacattgaggtttgtagagctctacaaagaatgcaatctaagtatctctagcaatattaacattccgcttctaaatctttttcttttctaatagctttattgtgaaagaattcacataataaaatttactcgtttaaagtatctaattcattggttttagtttattcacagagttgtgcgacagtcactattagctaattttagaatgttttcatcacttcagaaagaaaccccttttgatgtctaaagtacaaatcctcacactgaggctgaaaattacctgctaaagtggcagagtgaaagatattttatgtttatataaaacttggccagtatttacaggctattccccatagtttggtaaacagttatgttttctgttgttgtctctaggggtaagagtgctaattattttgttttcgtgttggtgggagtggtggttttggaaaggttcttttatggtcacagttgttctcaggccatgctgttggtttgcagggcactagctgacatgaataatgatggaagaatggatcaagtggagttttccatagctatgaaacttatcaaactgaagctacaaggatatcagctaccctctgcacttccccctgtcatgaaacagcaaccagttgctatttctagcgcaccagcatttggtaagtctgaaaatgaattggtttctgtattttcttgtatattttaaaaataaatgttttcctttttttccctctcggtttataacattatgaaattctaggaggtaattctgtctgaaaaatgatggccccctgcaggaagatagtgctggggagaagaaggagcatgttcacatttgaaccctgggatgtaaagtaatcaaaatgaaagcagagatgcaggccgccagtcaggggaaaaggaagaaacttacagtccgctgctgcagcttctgggtttttttttttttttctcttccattatccttcaggttgttgcatacttccttttgattttcggtttccataatgtctgtttctccttgtgcataaacaattcctttggattatggcatctagaaatatatatattttgaatcacagtactgagtcacttggccacattaaattctttcttagaacaaaatggaatagagaaaaaataaacattgttatcctgattaaaaacctaattccagccgggcatggtggcttacacctctaatcccagcactttgggaggctgaggcaggtggatcacctgaggtcaggagttcgagaccagcctggtcaacatggcgaaatcccatctctactgaaaatataaaaaattagccaggtgtggtggtgcgcacctgtaatcccagctactcggagaggctgaggcaggagaacctgggaggcagtggctgcagtgagccaaaattgtgccactgtactccagcctgtgcgacagagcaagacttcgtctcaaaacaaacgtgattccataaaaaattatctttcaaccaggtatttttcttataagctaattgattaattagttgactgagatcagtagttctgatttctgttctcattctagactttaggttaatttgaagatcacagtaataaaatctaacatctgattcatggggaggttctttaacagtttaaaacaaaacatgaaaattgtggctagagtttcttttcatctcttcatcctcagatagctgatgataggtgataaagtgaaatagatttcggagggggcagtcaacagtaattcagggtgtctctgatataattaatgataagctaagatacagaaatactctggttttacttactaggtttcctattaaaaacaatgtattgcctttcttttagtaagttttagccacaaggctggtttttgtaaggggaaaggttttggaagatttttaggcaaataggatagtggtccaagaaaagaaagaaaaatccatatatgagcaaaggcgaggaagagcagaagtgaacactgcagcagcctccacatgactggggccgttgtttgtcttgtccagtgtgtgctcacaatgtttagcctttagttaaccagctaatttaagtggaacttgctctgaatccctgaagatctctgtagccaatctttggtcaggacccaggcgttaaaataattcaagggtgtttggggtcgaacacagtggctcatgcctgtaatcctaatgctttgggaggccaaagcaggaggattgcttggtcccaggtgttggagaccagcctggcaacataacaaggcctcgttgctactgaaaatttaaaaattaaccaggcatagtggtgggtgcctatagtcccagccacttgggaagctgagacaagaggatcacttgagcacaagaggtcaagcctgcagtgagccaagatcacactactgcaccccagcctgggtgacaaagtgataccctgtcttaaaaaacaaaaacaaaaaacaacggtatttggttttcttttggctttcttccaatgctacaagaagaaatctcatagtggagaaaaggtcaaatgactagaggcaccccatttctcctttttctctcaaacctggggtcaataatttttcctgtaccatttaattcattttctcttattccattctgccatcagaatttcagttgtggagctattgctgatttagtttcaggaggttgtgaccttactgctgagaaagttttacagtcgttaagtaacctgctactgttaaacctgccaggatttctgacctaatactctgccaggcagcccatcactcttccccccagacttctccctgtctttcctcaccacattgatgttctcagtaaatgattttgatgaggctaaaccatgaaggatatcagaacataggagaagttaccagtatatgatcttgatcaagtttacttaagtattttctagttctacctctcagctcaatctagggtaaaatacatatatatattttatagtttgttgagccacttgagaataaaataatttattactattgtcattgttttatttatttatttatttattttgagacagactctcacttagtcgcccaggctggagtgcagtagcatgatcttggctcactgcaacctctgcctcccgggttcaagcagttctcctgtctcagcctcccgagtagctgggactacagggacatgccgcaacacccagctaatttttgtatttttaatagagacagggttccaccatgttggtcacgctggtcttgaattcctgacctcaggtgatccacccacctcagcctcccaaagtgttggcattacaggatgagccactgcacctggcctgctttctaattaatattgaaaattattggttaggtgtggtggctcatacctgtaatctcagcactttgggaggccgaggtgggcagatcgcttgcgctcaggagtttgagaccaacctgggaaacatggcaaaaccccatctctacaaaaaatacaaaaattagctgggtatggtggtgtgtgcctgtagtcctaactgcttgggaggctgaggcaaggggatggcttgagcccaggaggtggaggttgcagtgagccaagggagatcgtgccactgcactccagcctgggtgacagagccagaccctatctcaaaaaacaaaacaaaacaaaaatctgactctgcatttccttgcccttatatatagtatgtgccttcacatataatatttgatcacaatgataaccctaaaaagtatgcagactgtattagccctgttatataaatgagggaactgagattctcagaaattgaacattttgcttaaggccatatttctaacaaaggagatagaacctgtccaaagctaccatttatctaaaggcgagatggagtctcactctgtcgcccaggctggagtgcagtggcatgatctcggctcactgcaacctccgcctctcgagttcaagcaattctccttcgtcagcctcccgagtagctgggattacaggcacccaccaccacacccggctaatttttctatttttagtagcgacggggtttcaccatcttggccaggctggtcttgaactcctgaccttgtgatccacccgcctcggcctcccaaactcctggcattacaggcatgagccaccgcacccggatggctttaggttttttaaaattaccttctccgtgccttcattatcaccaaactaactgggtgacatgacgtgtcactcttccatggttccttgtctgcatgggttttttgttttgagacagggtctcactctgttgcccagactagagtgcaatggcacgatcatagctcactgtagcctccaactcctaggctcaagcgttcctcctgcttcagcctcctgtgtagctgggactacaggcatgtaccaccacactgaagtaattaaaaaattttttttatagatagagtcttgctcttttgcccaggctggtctcaaactcctaatctcaagtaatcctcccattttggcttcccaaagtgctgagattacagcataagccatggcaccaagcctcagatattttttaatgtagttgttaacacactatagaattaaggctcagactggagtctgaacaatgattttgttcaactcccctacagagaagagagaaaaatggggtgcagtgatactgtgacttgccttagagcaccctgaaaatagaattttctattgtaggaaattctatgggtagacttggtaccttctttcaccagtgtgcactcagcataattcttttgttctggacccagcttatacaggaggagtctgtttttcttttgcttggtttttgttttgccagagtacatggttttattggattaaaccagtgttttgtaagcccctactgtgtgtcctagttgctgggaacatgctggccagcaagacctcatggcttctaccactgtggatcttattttcaaattgtggggagcaaggaaataaatacttttaggtgagaataagtgcaataagttcattaaaacagagtaatagtagagagacagagagagagaaaccagtagaacaagatggccagggaagaattctttgagcagatgacttttggaactgatgtagatgatgagagccatgtgaagacctaggggagaggccttccaggctaaaggaactgcactggcaaaagtcctaaggcaaaaactagcttggggtttggaaggtgtgcgaggggcgtcgtagctgaagcatggggagaccataaggaaaagcaagcaaacaacagattaagcagaagagtgacgtggttgatagacttatctgtgttatctgaagactggaatgtaggggacaagaatggaatcctggagatcagttaggaggcttttgccacgggcaagaggcaatggtgatttatatctggtggtgataatcaatgtggaggacagattagattcattctagcctgtattttgggaaaaaagtaaaaaggacttgtcagtagattggaaataagaaatgaaaaaggagtattaaggcttttcacatgaataactagatggatggtataagtgtatactgagatggggataacaggaagaggaatggttttaaaggagaaattaagagttttggtgattttgagagtcctagtagatttccgagttgggatgttaaggagacagggatgactacgtttgactgaagctcagaggaaggatcgatcagctctggggcagtttggatatggagagcatgtcttaggggcaagcttagctataaggagtacagtgtagacccaagccttgatgtgatgtgacatttaaaggtcaggcaaaagaggagaagccagaaactgaggctgacaaaagtgaaatggcagaagattggtgtcctgctaccaagaaaaagtgtttcaagaaggagggaatgctccattgtttgagctgcttttgagagatggagtaagaatatggcagaacagtgctgattagatttgatgtgatgagcttttgagtgaccttgacaagcagtttcagtatagtgatagggacaaaatcctgattggaggcttggaagaggggagagaatttcaagaattaagacttacacaggaagaggtgatggcagccagaatacggcttctggtagatgtatttatttagaaagtcattcattcagaaaaggtagtcagttgtcaaaaggatgatagtctttttgcagtggctatttaaagcacagtaggccaggcacggtggctcatgcctgtaatcgcagcactttgggaggccaaggctggaggattgcttgaggctcctagttcaggaccagcctgggcaacatagtgagatcctatttatatttttttaatgtaagtagatagatagatagatagctaataaatttttccttttctgtaaaatggaaaaattattatgtaagagaagatttctaacaaatttggaagcttaaaagatgcttttaccagtctgatgattaaacagtatttttaaacttggccttttcctcagtgtctttttgaggttagcctccttttaggttaggggtctgcagcacagatggggtacgtgtcttgaaggttaactggttgcgcagtatgctgtgtcaagccttttgaaagtctgaatgatggctcatgaaaacttttggtttgtttccatctatttttatttgttgcttgagtagattgacattcttacttaagcaaaaaccaggatttggagtataattcagtatagttatcaaaagaaccaaatttttaaaaagaaaaacacattaaaaatatagttatcaaataatcttagaaaattttggaattctaaaactgacaaggtaaacctgatacatgttgctatgtgtggatatgtaaagttaatctgattccaaatgagatgtgtggtaatgtgcttgatagtgtgcacgtgaactgtaaaccagtcatctagatgactataattataaacttactcagtaaagcccaagttagaatttttttcttctctttgttggattttcagtgtctataaacattgtttttaaaaatgaaaataggccgggcgcagtgactcacgcctgtaatcccagcactttggggggcccaggtgggcggatcatgaggtcaggagatcgagaccatcctggctaacatgatgaaactccgtctctactaaaaatacaaaaaaaaattaaccaagcatggtggcgggtgtctgtagtcccagctgctcgggaggctgaggcaggagaatggcgtgaaccctggaggcagagcttgcagtgagctgagatcgcgtcactgcactccatcctgggcgacagagcgagattccgtctcaaaaaaaaaaaaaaaaaaaaaggaaatagtctgattttcttactgtataagtaatagatgctgcttgcgagtcaacaatgcaaaaagacttaaaaagtaaaaattactattaattctgttacccagtgatgaccactgtgttcaacaacactatttttaaaatcttttttttttttttttgaggtggagtcttgctctgtcccccaggctggagtgcagtggcaccttctcggctcactgcaacctccgcttcctgggttcaagcgattgtcctgcctcagcctccccggtagctgggattacaggcatgtgccaccacgcctggctaatttttgtatttttagtagagacggggtttcaccatgttggccaggctggtctcgaacttctgatctcaagatccacccaccttggcctcccaaagtgctgggattacaggcgtgagccaccgcgcctggccctatttttaaaattttacacaagtaatacatgctcttagtaaaaagaaatacaaacaaaacagaattgtgtacatttgtaacagtgcaggaggaagagggaagaattagggtacctggtgcacttgaaacaggagaaccccaaaatagctaacaggtatttgcaagaaagttcaaccaggctgagagcagcaatagaaataggaaagggttatgctctctgcagtactgagtgagtacaaaggatctgagagatttggagcagtccagcccctatgaactcaaaagactggcccaacaagccttccttttgggacagggcttcatactcaggaaaaatgactgggagtggaatcaaaattgagcagtatagggacatggatacaaaggaaagagatggtccagacaaaagtaggggaggagaatggagactggaattcctaagaagcaaggctcacataaaaatgagcaacagaaagtatcaagcaaggtcaaatccactgcagaaagtgtcaagcaaggtcaaataacacaaagttattattaggaaaaaggagaataaagggagaaataacacccctgtggacagtgaaagcacaccagtaaatcactacttcaaaacaagctcaaagagaataagaaaatgatacaagacttgaaagatgaaaatcagagtttttaaggctcataaataaggtgacagaaagaatgagaaataaaagaaaaattcattctagaaatgaggatgcaactagaagcaacacaggggatactaactgaagaaaaatagaagttacaaagaggaaaaaaatttaaattaaaaggaaatgaggctgggcgcagtggctcacgcctgtaatcccagcactttaagaggccgaggtgagcggatcacctgaggtcaggagttcaagaccagcctggccaacatggcaaaaccccgtctgtactaaaattacaaaaattagctgggtatggtggcacatgcctttaatcccagctactttggaggctgaggcatgagaatcgcttgaacccgggaggcagaggtggcagtaagctgagatcacaccactgcactccagcctcggggatagagtgagactaggtctcctaaataaataaaaggaaatggaaaagatataaaaagaatttgagaaacagtaacaagtatttaagacaaagaagattgaatgtatgggcagcaggagtccctgaggaagaaaactaaaccaatggaatagaacaaatgataaaaatgaattcaagacaactttcttaaaataagagattctaaactatatttaaaagagtatcatgtggccaagaatatcaatctaaaaagtccaacactaagatatattctagttaaaggagaaattatttagacatgtagaaaaagaaagcatatgacttacaagggggaaaattagattatgttcagatttttcaacagcagtgctttctgctagaagaaaatggagtaacatatttagaattctcagggaaagaacaagccaaggattttgtgtccagaaaaactgactttcaagtagaaaaaacagacaaaacgttaccaatttataaggcttcggggtatattaacatgagcctttcttaaggaatctattagagaatgtgcttcagacaatcaaaatagctagacctaggtcatcataaggactgatggtgagcactaaatatatagttagctgtagagctaagactgaaggaaggctgaggaggagagagtatcggatgtaattcccatgcactgtcaattggatacgataaaactttaaggggagcaggactgcatgcaaaaaaataatttaatgcattcagaaattagtattagtattgttattctgaaactgttgtctgagatatgtggtaaaaacaaataagtaattacggaatagtctaattctgtcattttctatacctttgaaatctgtattcttggtgtggaagaaaggagataacaaatataatagtatcaaatgtaatgaaaaagcagtatagtcttggatttgaattttcaaattgaaagtattaatatgaactcagaaggcgtctctcaccacaccccccattctcttcatctatccatctatttgtctcctagttctgttcactgaaaagactagatacaatcatctaccccagcagcactgagcatccttagcgtccagattgtgaacttgaaatatcatttctcaccaaaagaaaccagagtttcttggagaaatggctgaatccaggtctagatatgaaatgtgaagagcttgaaggacccatcttgtaatactggtcagcaaggaagttatcaaagcatagtaggaggatatcagaaattctcagaagccaacccgaagaggcttacattggccaaagagaggacagtttgaacttcaagaatgataatgtgccatgaattaaaactcaataaatatttgtaaatttatgactcaataatgatttaataatgtatttaacaagaataatttaccttaagaagatcctaagaaaccagttcattaccttgaaaacaggtaaagggaaagaatcaggcatttattatgccttttgtatatgagctgtacaactggatagccaactagtatatcctcattagaagcacctctttataaaattattacagctaataaatgacaaagacatagtaggattagaacatcactattttcaactccccataaatgaataaatataggcgttaagcatcaatgactgccaagatcacaaaaagacagctacattttgtgtgtttcctgtagtcttgccaaagagatccaccgtcagcttgatccattctttggatgtagctgcgtatttgcaggaaatacagaatatagagggaaatgttgaaccgcaccatgagaatgcaatcagcaaaatccagactgggaaactccacaggtcacatggcctgggtctttcaacagaaaagaaaatgaaaaggatggagaggggactgtggattaaaggaaacctaaaagacatttcagcagtgagatttccgaccatgcctgagttgagatgagcaaattcttccctcaagggcagaattgacagaataaccatttcagtgctctggaaattaaccaaaggtatataacatctgagaatcatttatgcctgaaaagctgctgagcttcagatatgaagcagaagtctgttgcattctttcctgggcattttcctatcccccaacacttcagcttggtaatgtggagggacaggttgtaaatattagcagtcttaactgctgtcactgaagggggcttacttgctttgggagtgggaagtcatgcctgtgcccagcagctttgtcagtggaaatgacaattctggccacagaagagcaggtatgaccagccactctattatcctgaactcgtggtcatggccagggcaagtatattcttggctgaggctatgcacatgtgtcgcggagaccagggtgggcccgagtcagctgcaaactcctgactagccctcaaactgcatgcacgtatagagaatatgcagaaaggccctgtgaaatgttaaagttgaggaagactttaaaatggtctgaactttgaatgcatttttgtgctgacagattgtcagagaaaggaagccttactgacttgaggtgtttgagcacaacttccgtcccatcattggctgactactgtgctacaaagatgcaggtgcaatccgtaaaaagccaggcttaaagataaaaacgaattttttaaaaacccaactgagcagaaccatcaggggctgcacaacaagggaagacagatttttctgaattagcctatgccggttactaaataaagatagaaacaacaaccttcagggggaaaatcagagccagagtagctacaatgtattatctgaatgtccattttcacctaaatttgagacattaaaaaataacaggaaagtattgtctcaccctcaagaaaagaggcagtcagtaggaactatctctgatccagctgttggattcatttagcagacaaaggcttcaaagcagcaattacgttcaaagaactgaagaactaaaggaaaacgtggaaatgaatcaacagacagacactctccaaaaaacaatagaaattacaaaaaagaggaaaattgaaattctagaaaagtatgacaattgatgtgaaaagttcaataactggccggccacagtggctcacacgtgtaatcccagcactttgggaggccgaggcctgtggatcacctgaggtagagagttcgagacccacctggccaacatgatgaaaccccgtctctgctgaaaatacaaaaaattagctggacatgatggcaggcgcctataatcccagctatgtgggaggctgaagcaggagaatcccttgaagccgggaggcagaggttacagtgagacgaaattgcgccattatactccagcctgggaaacaagagtgaaactctgtcacagaaaaaaaaaggaaagttcaataactaaggctgggagcggtggctcacggctgtaatcccagctctttgggaggctgaggtgggcggatcacccgaggttagaagttggagaccagtctggccaacatgacgaaaccccgtctctactaaaaatgcagaaattagctgggcgtggtggcagatgcctgtaatcccagttattggggagtctgaggcaggagaataacttgaacccgggaagtggaggctgcagtgagccaagaccacgccactgcactccagcctgggcaacagagtgaggccttgtctcaaaacaaaaacaaaacctgaaaagttcaataactaaaatgaaaaatttaccacagggtcttaatagcagattcaagatagcagaagacagagtcagtgaagttgaagattaatcaatagaaattattcaatctgaagaatatggaacaaaaagattgaaaaaaaataacaaagtttcagagacttatggaacaagaccaagtttaccaatatgtgtgtcatgggagtcttagaaggaggatcatgagagaaaggtacagaaaaatatttgaagaataaaagccaaacacttgccaaatttggtgaaaagcaatagtctacacaatcaaaagctcaacacacctcaagtagggtaaatacaaagagatctacacccagacacatcatagttaacctacggaagccaaacacagagataaaaccttgaaagcagcaagagaaaagcaactcatcatggataggggagcatagatataaataacagcagacttgtaattgaaaacaatggaggttagaaggcagtggaatattcaaaatgccgcaagaaaaaattcaacccaaaattctatattcagcaaaactatcatttaaaaatgaaggtgaaataatgactttttcaaataaacaaagactgagagaattcattgctactagacctaccttagaagaaatactaaatgaagactttcaggatgaaatgaaatgacaaaaggtggtaactttaatatatggaaagaaatgaagagcatcaaaaatggtaaatatgtaggttaatttagaagaccacataaatctatttttcttcttttctctcaagtttaaaagatataagattgtataaagtaataattataactctattattgggcttataacatattataatgtatgtgacagtaatagcacagaagaggagaaagggaattgagctatatttgtgtaaagtttctatattctgccattagaagttgattatgataaattaatttggagattttaatccctacaacaaccacatagaaaattacttttggatgcatacagtggctcagccctgtaatcccagcaccgtgagaggcttgaggccaggagtttgagaccagactgagtaacatagcaagaccctgtctctacaaaaaaataaaaacttagctgcatttggtggtgcgtgtctatagtcccagctacttggaggctgaggcaaaagaatcccctgagcccaggagttcaaggttacagtgagctgtgatcacgtgactgtacttcagcctgggtgagagtgagaccttatctctaataataaaagaaaaaaaagaaaattttaattactattattatgtaataatactcttttcagttagctctctcaggttgaaaagaaaatttacttttaaaaaatagtaaaggtcagacatggtgactcacgcttgtaatcccagcactttgagaggctgaggcaggacgatcacttgagcccagaagttcgagacgagctcaggcaacatagtaagacctcatctctaccgccccaccaaaaaaaaaaatacacgtatatatatatatgaaactgggtgtagggatgcacacctgtggttccagcaagttgggaggctgagctgggacgatcgcttgagcccagaaggtgaaggctacagtgagctatgatcatgccatttcactctagcttgggcaacagagtgagatcttgtctcaaacaaacaaaaatatttaaaaaaaatcaatagggggcatttaaacactaaaatttatttactccacatgaaagaaggtattaaagttgggacagagaaataaaaaagaaggtaagcttttttacttttttttttttttttgagacaaggatctcactgtattgcccaggctggagtactgcggtgtgattgtggctcactgtagcctcaacctcttcggcataagtgatcctcccacctcagccttccatgtagctaggcctacaggcgggtaccaccatgcctggctaatttttaaaattttttgtagagatgggattttgctatgttgccctgtctggttttggactcctgccctcaagagatcttcctgccttggccttccaaagtagtgagtttacaggcataagccactgtgcccagctggaaacatttatttttgttttatcatttcttctttattggttagaatatttttgtataaagatgcttccagggccaggcacagtggctcatgcctgtaatcccagcactttgggaggccaaggcaggtggatcacctgaggtcaggagtttgagaccatcctggccaacatggtgaaacctcatctctactaaaaatgtaaaaatagccgggcatggtggtgggcacctgtaatcccagctattcaggagactgaggcaggagaatcacttgaactcgggaggtggaggttgcagtgagccaagatcacgccactgcactccagcctgggtgacagagcgagactccatctcaaaaaaaaaaagaaaagaaaaaagaaaagaaaatgaataaagatgctttccccatcaaacatgtggtttccctgaggtataataaacataggaaaggcaggttgcagtttgatttttctaccttttatttactagttttcaaagtagtaaattgattgccttagtgtcctccttttttgaccagttaggattttatttatttttaaatatcattttgaactcatggatttaattatatttgagcctttaagtccactgcagttattattctttttgattctcatcttgtttgttctgtcttcaggttgagtcttgagtccttttgatgtgatccttgacataatttttgttactctttaaaatgattaacttgaagccctattttaattggaatatattacagctggaaagtgattttctttaagcagtactgggttaattattattcagtgttgaaatgtgattggatgtgaatggtgttgagctgttttttcttcataggtatgggaggtatcgccagcatgccaccgcttacagctgttgctccagtgccaatgggatccattccagttgttggaatgtctccaaccctagtatcttctgttcccacagcagctgtgccccccctggctaacggggctccccctgttatacaacctctgcctgcatttgctcatcctggtatgtgacttgctgaaaccataggctgagtttttactacttgtattttgctgttcattattaaaatattttctcttcacgttctgattatgtttaaatgatattttagtccagaggaaaatatctttatttttttcacttgatttcacattttttccactgtattaaatgggatatgttagtgtggagagagtcaaagagaattatagatttctgggtaccactgtggacaaaggtgagctcagcagtgaaagccacaaatgtaattttctttcaagggctgagaagagcaattgaagttgaactgtagttgaacattttctatttttatgtatcagttactacttttctttagccactatgaattgctaataagcaagccaatcccctaggaatagaactatgttgggggttgtgggaaagaataaaaaagaacagtttatactattttatggtattacatgcctgcttaattgaaggaaaggatttaaaagtttctggtttaattaattccactttgagactttattaagtcttttttcctttagttaaagtataaaactgtagatgtagatagccttggtctaacatcttaatgaattcatatcaatatggaaagtattatttttaaagtactttgactacatctaagtaaattcagtattgacgacatgggttttagcatcatacttgaaacatttctgcgcctttggccccctgaatttgttgtatatttatcaggatatatatttaagttatggccaaataagctaaatgtatctcctttttttagattttttcttgtcacatgtagttcatcttgcatatatgaccatgactgtggacatgatggtagcccagaaagtgtgtgcagttgtttttccaggagcataagcaaatccacacactctgagtcttctattcttttgtgactaatggcacatgttgcaagtcatttgccatcaggcaagagtgagggaatgtggctaagacgcagtgttttttttctgacactcaactaaccaaccccagtgataatcagacacaaaagctgaccttccctagtgtcacatgttatctggccaagactacagtttgtgacttcttggctcttacatctggaactaatacttcagctccttcagtgcagtgaataaaataccattttatatatttaagctgttacctctttaactgttggaataggtcctataaaatgtgatacaaaatgtttaatgaagagtaaaattttatggaaatcagcattactacatagtaaggtgattttcagtagaacaagtaaatctagaaacctttttggcaggaggacagagggtaaggagggaaaagctcttttcagtctaggctggcaagaagggggaattatttctgcctcagatttgttgactgtgcattttaatttttgtaaattggggaaagtttcttatctttgtagaattaaaattattcaacatttatttttacagcagccacattgccaaagagttcttcctttagtagatctggtccagggtcacaactaaacactaaattacaaaaggcacagtcatttgatgtggccaggtaagtttgcttgtttttaaatgggaagtttggttaaggccattacctgattaaatcataaatttgaccatgaatcatctatattctttttgttgttgtcatcttttttgtaggcttttgtagagtgctaataataattttcttaatttctggatagtgtcactagtttttatcattaatttgttgcagagatgagagaaatcaaggacataacatttccttaaaggctttgtgtatttttttttttttaaagaggataacaaatggatagtaataaaatgtttaaaaacagtaagataaaattctgggtataagggaaaaaagcaaatgaactattttatgtgtttatgatttacaagtttatgtataaaatttttgtatgaagattggagttatagttggccttatttttaattctatctcagataatcttgtggagtttatatgggtaattagtaaaatcctattaaagacgatttattatgaaaagaattatccagatagtggacaattcacattaatcaaatgtgtggctcaattttattaaagctgacatgacattattgcttatgttttggccaaccttggtttcaattattacctttcatatttttattttactcctatgttttacccttgcatactgctacattaagaagagaaattaagtctcttttaagccatctcagaacttttgggccgggtgtggtggctcacacctgtaatcccagcactctgagaggctgaggcaggaggatcgcttgagctcatgagtttgagaccagcctgggcaacatagggagaccttgtcgatacaaaaatttaaaaatgagatgggaggatggctggagccagggagatcgaggctgcagtaagctgtgattgtgccactgcactcttgcctgggtgagcctgcctaaaaaaaaaaaaaaagcttttggaatttatcctgtcttatgtcaatcctcactagaaattgttaagtgaatcaagtcattttcccactttcaagagaaaagcatgttgaatataattcagtgatgccttcattaccttttaaaaatgatttaaagaaaatccataaactgaaaagcactgtgccaaaagctttacattaactcattcttccccatgagatgattctgttactctctgttatagatgagggacaagctcagagacattatgttactcgtgcaacagaacgtaactcataagtgacagagctgagtcaaactgagatgtctgattttaaggcgtgtgttcttaactatgcaagttttctctaaaaaacttaattgtaggatacaggtatttatttgtgttccatttaattgcggttttacccttaagatgcctcaatatgtattgggcatctactttgccaggcacatcattaatcctattcaaccccatagctacctatgcagtagatgtctcaagatggtgcatgaggaagcacacccagagaagctctagtcctcacccatagtttacagcttagtgcatggtggagctgagagttaaacctatatcatcttacactaagttcctttttaaaaaaaattctcctgggctgggtgcagtggctcacgcctgtaatcccagcactttggtaggccaaggtgggcagatcacaaggtcaggagttcgagaccagcctggccaacatggtgaaaccccgtctctactaaaaatacaaaaaattagctgggcgtggtggcgggcacctgtaatcccagctactcgggaggctgaggcaagagaattgcttgaatccaggaggtggaggttgcagtgagctgagatcgcggcattgcattccagcctgggtgacacggcaagtctctttcttaaaaaaaaaaaaaaaaaaaaaaaaaaaattctcctataccatgctgaagttttgagtttattatgactttgcagaagcaattttgaaatctgctttattgatttgtgacattagaatgaactatcagtattagtgaacattagtgctattgaaacaactgttttatgttgtcacctttttaataacttaaatttctagccaatttttgcaatgcagtattgaacttttgggtacatcttcatgagtttttagtctatttaaattctcaggaatttggcagaaaactctgatgtgataagtgtaatctgggacaacttgtgtatgtaacacccaacattcctggcgtgtagcaactagatagttagcttcttgacaaataggtgggagttggaatcagcaaaatattagttagttaacatgagagggttggtgcagaagtacccacagcagaatagatcatggtaagtgttttttattaagaaattcataaaaattgaaaaaggtgaattcatataagtacttctcgagtgtttgggaggtatttcctatacttgaactgtatataatagatataagtgcatagataacacatggaaatgatgattaaaaagttcagtatttcagtaagattgtgcttttacatgtttgaatagatatttttgttgaagtgaaattgcagacagagcattagctgtaatctgtcctggaaggggaatgccagttttactgtctgagctcagccattgggtttaattcagatgtcgaagcttaacaagccattggtaccagtgtgatatttgtgtggacagtggcatctgaggaactaatcactaaggaagtgtagacgcagcctaactactggcaagtgtgtccttgggccagctcaggattgtggcacattggcaaggagagatcagtattggattgtagtcgagaaagtgaagctgtctccattcccactctgcttatgtgtgaccatggaaatgttctgttctctctctctctgggaaactgtccaatgggtctgaatttaaacttaccagaatggagtaatttcacttcattaagaaatgggtcctgtatattcacgtatagaaagttaaaacattttggagaattagtacctttaaaggcagttattggtttgcttttagcattgctttttaaccaaaaaagaagtgttttagaaattagaatagcctggacattattgttttacctcagttacaagaggtttttcatacttttatagaacctttaaattattatatatacaacttgaaacagcctctcagtctattgtgtttatccatgattctggaaaaataattatctatttgagggaaatgtttatgatcttaaaaatgggaaatacccatggcaaaaaaaatcagaagtagtgataataaaatgaataaaatatgaaagttagagatgattatctagagaagttcttagtttactgtcattaaggaactttaccaggctgttccttatggataatcctctttctctcctttttcttttccccacagtgtcccaccagtggcagagtgggctgttcctcagtcatcaagactgaaatacaggcaattattcaatagtcatgacaaaactatgagtggacacttaacaggtatttacaaataaaaattagtgaaatatgatctttgttttcaatgtaaactgtttctagatattgggtcatagatattttccatgtctgtgtgcttatttcttggcagtgtttcctttgtctctgttatctcatgttcttatccactgataactctttacatagttatatcattctctcatgccccattgctttgtggtaaaatggaatatagaccagggatactcctgtacgctgaaagccactgatatgcaaatcaaggcactagcaaagaaacacttctttgaacaaaaactagcttcaacttctgaagtccagctttgaacttgatgaacttgaagctgtctgttcactaggttagagttggaggcagcaggcagggtaaaagcagggagttgagaacatggctctgtctcagataactgcctagatagggctcaccactttggatatttctttatctattaatataaaaggccagagttaacttaggtgatctcaatggatttttttaaaagaagaatgattctgttatctacgtcagaaggatagacaggaattttagcatactgttcaaaatttttctcacgaaggtttaaatacttgttagaaagttataaagaaggctgggtgcagtggctcacgcctgtaatcccaatcccagccctttgggaggctgaggcgggtggatcacctgaggtcaggagttcaagaccagcctggccaacatggtctctactaaaaatacaaaaattagccgggtgtggtggtgggcacctgtaatcccagctactgaggcaggagaattgctggaacctgggaggcggttgcagtgagtcaagatcatgccactgcactccatcctgggctgcagagtgagactccgtctcaaaaaaaaaaaaaaaaaaaagaaagttataaagaaaagcataactttaatgaaagaaaatagagacctctgatatgaatattaaatgttaaagggaaaaactaactgccctctaacaaatatgaaaggaagggaaaaaaattaggtttcctgtgtggtggagtggggtaaggggaggattataatccaaaacacttttaagaaatgattcttactattttttccttgctattacttaaaattgcaatttttactcccaaaagaaaaaaggtatcttatgtttaaaaatgtcagagttggacgagattttgaagggttctaatctaatcttgaactctggtccctttaaggatctcagcagtcaccccaaataagcatgtatttatgtttgaatgggtgaatagtaaatacacacagattctcgatgtgtcatactgcctcataaagcagtagctgtcaaaaccagcctaccttatgcaggctctgcttttttttttgagatggagcttcactcttgttgcccaggccggagtgcaatggtgtgatctcagctcactgcaatctccacctcctgggttcaagtgagtctcctgcctcagcctcccaagtagctgggattacaggcatgtaccaccacgcccggctaattttgtatttttagtagaaacagggtttcaccatgttgctcaggctggtctcaaactcctgacctcaggtgatccacccacctcagcctcccaaagtgctgggattacaggcatgagccaccacacccggcccactgaaggtatatttaatagcatatttttaagtactgttttacatggtttgtttgacaccagtgctccatacaaacccagaactacattgccaatgaatccaaaaatatttcttgaaaacgttggtgtttgctgtgagttgattaaaatagtattcaattgagacattgattgagaaattctctctttcttggtgggatgtgtgttttatgaatgaaatgcagtatctacattccaaatataatgacccaggcacttgagcatttagaacttttaaatatctgaggcagaaagtaaaatttgaaatatactggaaagaaagcagattttgatattgtttatctgcatacttattgctactttgatccagcaagaatttaaggtgggaattttacttttgagccagacctttgtatagtcatgtcaagtagaataatttattacagtaaattttaaaatgggaataaacaatagaaatttaattttttttccctttatgtacttaggaatcaatatgaagtatgttttatactaaattagaatgttgatggaaacagctgatttgttgaggtggatggaacataaaggtcattgtcttgatcacaattataaaaataattttatgaagtcagaatccccaaagcagttcactcagctgcaggagaagcaaaatatcaagaaagttgagaaaaggtttcagtatataacatggcccaaaagaaatatataatttatatttgtaatctcttgtttttcatccttcttgcttttgttttttgtgggtttttgttttcaggagctaaaaagcacttcttttctttctttttttgaaacagagacttgctttgttacccaggctggagtgctgtggtgcgatagtagctcactgcagccttgaactcctgggctcaagcaatcctctcaccttagcctcctgagtagcagggactacaggcgtgcatgcaccaccacacctggctaatttttttaaaaaagttttctttagaggtgggatctttgttgtccaggctggttttgaactcctgacctcaagcagtcctaccaccttgtcctcccaaagtactgggattacaggcacccaggctgaagtacagtgacataatcatggttcactgctgcctggatttcccaggctcgggggatcctcccacctcagcccccaagtagctgcgactacaggcatgtgccaccatgcccagctaattttttgtagaaactgggttttgccatgttccccaggctggtctcgaactcctgagcttaagcgatctgcttacctctgcctcccaaagtggtgggattataggcgtgagccaccgcgtctggccttaatagtggcactgtttaccccactgactatctgggttgatttagccgatacatcctgttggacaccctgttcttccttcatggcttgatgtgtaactgttgcatgcccttaaaagagactgccttataaaatagagagggatcattctttaattaaggttatgtaagaagctctagaactctggtattcctgttaataatgctagcccttcttctcaaagaggtattttattgttgcattctgaaacaatgaatatgctatttggtaattcatctattaatcagaaaagctaaagtcttagtcattgttttaaataaagctcatttcatgtagttactctctcctttctagccatacttccctgcccaaacatggatgccagaagtggggtttgtgtgcttgggatttctggttttattcctatgttcccttataagccagtactccaaaaccgatatccctttatgtacctaggtttccacagaagagttctgtgcactcaaagctcaactgtgtgttgtccaaatgtgctaagatgctatcttagctgttgctgatctatttttaatattttgcaacattgatttaggacatatgtagacaaatagtagaattacaagagataattgtgatcttctagtgtggggattggcaaacattttctgtaaagaatagcacaataaatattttaggctcataggtcatatgttctctgctgcaactactcaactttgccatcgtagcatgacaacaaccatatatcatgcttatatcagtggatatggctgttttaataaaactttgcttaccaaaacaggcagtgggccagatctggcctaagggctataatttaccaatccctgttgtagattattttcctcatttcacagatggaagaacttcattttagaaagttaaagtagttttgttaatgtcacatgccattagggagtcaggactagaatccaagtcccctgatatccaggtttagagctagttcttcacatttattgttaggctttttatgtgtaatagataaaatattaacttccttttttatagttctggagtaagggcaattgttacaagtgtaaattaaatcacccactaaagttttgttaattctactttgttaccaacattctagatacaatgttacagactaaagaaagtgatgcctgaactttgctcattccattgtaccacagtcctttagaatcttcacatgaattcagtagattgttttttattcttagatgctcccaaaacacacacgtgctcatgtatgcacacacatccagcaggaatgtgttcatatattcaccaaaagttagaatgctcactattaatagtagccctaattgaagactaactgaatgcctatcaacagtataatggacaggccgggcacagtgactcatacctgtaatcccagcactttgggaggccaaggcgggtggatcacgtgaggtcaggagttcgagaccagcttggccaacatggggaaaccctgtctctactaaaaaaaatagaaaaattagccaggtgtggtggcgcatgcctgtagtcccagctattcaggaggctgaggcagaagaatcattgaacccgggtggaggaggttgcagggagccaagatggcgccactgcactccagcctgggtgacagagcgagaccgagactccatctcaaaaaaaaaaaagaaaagaaaagaaaacagtagaatggacaatgaattaggatgtaatgacacaatgatacactccatagcagtgaggattaatgttctacaactctacacgacaatatattgagcaaaataagccaggtggaacagcggacaggctatttggttagaagttaggctaccttggtggtagctgagtctaaaagagaggcaaataggggcatctggggtgcgattatactctctttcatgacctccatagtgtttgagtattttcactttggaaaattaattcagctgtgtacatgtgcacatgtatatatccacatgtatccgtatgtgtgcttttctgtcaggattttatatgtaaataaaagttgaactattgtcagtaatgttacctgccattagagcacctctcatgtgctaatgtgatgctaagctcattgccccaatggatcatagactggtttatctgaaatgagcaaactaggatccagactacctggcccagtcactcagcaaagtctagactaagccaggactagagcctacagctccttggttccctgacctctactgctggccatgcaaaaacacatccagttttgtggtttttgatgaggtgacgtttgaataaagaaatagcaaaaagcaaaaacatatacaccagaatcttcccaacaaaattgccacagccttccattcctctgtccagcagtcttcctgggaccacatcttgagaggcagtgctggaaaggaagacgtatttatttctccctctctgactgtagtttatttaaactgagtctcctactgtgcgtttgtctgatgtctaaggccactttcataccagaagtgaagatgtttatgattattttaagaaatgagagcttattttgagagaagagtagaaattccaggaattcttcttttttttttttttcttggctaacataggaaatgtgttttgttttgtttttttaattgagacagtgtctcactctgttgcccaggatggagtgcagtggcataatcttggctcactgcagcctccgcctctggggctcaagcgatcctcctacttcagcatcccgagtaactgtgaccacaggctcatgccaccattcccagctaattttttgcacttttggtggagatggggttttgccatctggtcttgaactcctgagctcgagccatctgcctgcctcagcctcccagaatgctgggattacaggcacgagtgaccacaccaggctggaaatgtgttttaatcctggctattagcgcttcctgcaactttttttttttttctttttaagtctgtttagtgaaacagtttcccggagatctctccgaggtcccttcctcctctaagattctccgaatcttccctgaatttgcctgaggttgagcagggtggagacagcaggtggtagcagcggcaaaagatgttaaacttaaagagaataactttcaagtttgtaaataaagcccaatacaaataaagatggtaatgtggacaaaaggtcaggttatattttgaaactctaaatctttcacatggtcattctttatcaaacatccatttaacaaaaatttattatgtgtcagatgctgtgctctgtgtttctcctctttttcattggggcttaatttcctttttacaaagccctgcggtagtagcaaatgttatttaaagcattgtgattgcatgaggtcatggagtagtccacatacgcagaaccctggtcctcctgtacagtgagtatttgctgactcatctgtatgtccttttcctggttcctgtttaggtccccaagcaagaactattcttatgcagtcaagtttaccacaggctcagctggcttcaatatggtaaggaatgaaaagttctttggtttggataaagtggaaacttggttagattggtgtggcctcatgggttttagattaataccgttttttatgggggaatatgtagaatttgcttaatttcagtgagttgtaatgattgcctcttttataatactatttcccctctcaattttgaaaaatacaaaagcagattaatacaataaattctgaaggagtgataatacaacttaacaattctcaactcgtgaccagtcttggctctccctgtctttgatttctttttctttttttttttttgagatggagttttactctagttgcccaggctggagtgcagtggtacgatctcggctcaccgcaacctccacctcccgggttcaagcgattctcctgcctcagcctcctgagtagctgggattataggcatgcaccaccatgcccggctaattttgaatttttagtaggacagggtttctccatgttggtcaggctggtcttgaactcccaacctcagatgatccacccgcctcagcctcccaaagtgctggaattacaggcgtgagccaccatgcccagcctctttgattattttaagccaaatcttagttattatataatttctactgcaaatattttagcttttatcttcaaaagagagggattttcctttttttcattcattattattattattacttttgagatggagtctcactctttcatccagatggcagtggtgccatcttggctcactgcaacctccacttcccaggttcagcctattctcctgcctcagcctccttagtagctgggactgcaggcatgaacccccacgcttggctaatttttgtttttttagtagagacagggtgttgccatgttggccaggctggtctcgagctcctgacctcaggtgacctgcccacctcagcctcccaaaatgctgagattccgggggtgagcactgcgcctgaccgactttcttcttagcacagtcataacagcaatagctcacctaagtttttcagtagtcatccttatcattaaattaatcagggaatgttcacattccttagagtgcctcagaatgtttttatagttcatttgttcagctcaggactgaaataagcctgtattttgcaatacttgagttttccatcttttatgtctcctttaatctataaatttccccttgtcttgttctctgcttcttttcccaagtcccccaggccgccccccaaccaaaaaaaaaaaaaaaaaaaaaaaactccgttaaaaacaaaccagatcatttgtcctgtagtttcttaatggcttaacttttgaagagtgcgtcactgtgggattgtctaatttgtttctgtatttcctgtaaattgataattagatctagagcaaagtttcccaaccccagcactattgacattttgggcccgataaatctttgttgttgggggatgtcctgtatactgtaggatgttcagtagcatctgtggccactactcactggatgctagatgccagtagcatgagctccacacccagcatgacaatcagaaatgtctccagactttgatagatgtgccttggggtacaaaatcttccctggttgagaattgcggatcagatttgatttttttttttgttttgttgttttgtttttgataagactgtgccagagaggtctctgtgtactctcctcaaaaggcacataatgtctctattgtgtaatgattttgaatagctatcgatgagcattgcctgggtcctacaggcttccttaaatttaaatgttaactagaatggtttcttaagaagtgtgcatgttatagctgtatgttggtgattgtccctggaaaataaactttgtctacaagactcactgcaaagttcgtgattttcttgcaggccacattgatagggttgtttcacaaatgatcaagctctaatgcagcttcctttgcccttctcttcccttctgttttgtatgaaagagcttgcctttggcagtagaccagaccagttaataaacatcttatatctttgacacacccagaactctttaaatcagggtattgaacagtatcctagggccccctgaaatataaacttaagatctaacattaatggaggttggttgacaatttattaggttgttctcatgataccagattatattgaaatatttattttaaatttctcatttataacttatcctatttgagaaaaacgcttgaggcttcttctgttagaatgttatattctggtgctacacactaaaaaagatattttaattaaatgcttataatcataatttaggtaagtgtggtgaaaaaacaagaatttcagccaccttctaactggtttacctaggactggctaattgtgagacacaaaaaggaacagaataaggaagagcgggcaggggtttcattttatttcatttgcatttctttttaaaactgggtatcttgcatatgggtatcttgcaaaactagaggaacagaaaaaagatcagcagttgccaggggatgggggcaaaggagggagttgctacaatcagatgtggaattttaggtagagctgacactattctgtatgttgtggttcatgtttgtcaaaactctcagacctatactctagaaggtgtgcattctactttatggaaattataacaaaaaaagtttatagcacctaaggaaatttcagaattaagaaggtttcttaatttttggcattggcaaaaccagtttcccattgcatttgtcctgttgacattctagtgaatggatgtgttgtcatgtatcttcttttgatggtccagaaattgtttagtaaaatcacattcttggacttgccaggagaatgtttgctgtaattagctacttgggcaagttcattatgaagaatgatggagattgaatcctgagattgaggaagaggaaacacttagactctgtggctggagttcataaagatccactgtgtaggcctagattaaggggtggccagctctgcccagtgggccgaatctggcctgcatctgtttttgtgaagaaagtttttatcgtacaaatagccatgcccattcatttatatgttgtctatggctactttctgccaaaatgacagaattcagtatgataaggattgtatgtcttataaactgtaaaatatttactacctgaccctttactgatagtttgtcatttcctggtctagagcagaacatttaacaatatagagctgggtatggtggcttatgcctataatcccagcgatttgataggctcacttgaggccaggacagatcagcctgggcaacacagtgagacccccatctctacaaaatattttaaaaattagctaggcatggtggcgcacaccttgtaatctcacgtttgggaggctgaggcaggaggatcatttaagcccggaaaggctgtggtgaactatgatcttgactgcagtgaggctgcagtgaactgtgatcatgactgcagtgagtctgcagtgagctgtgatcatgactgcagtgaggctgcagtgaactgtgatcatgtcattgcacatcagcctgggtaacagtgagagctcatctgttaaaaaagattcatggaatatgagtgtattatatgttaaatatgcaaaggttggggaagagtatcattataatcatagcatttgttgaatgaggaacactgtcccaactacctgtaattttatctttgcagcagtataaaataggtactattttgacaaaatgagggacaaagagactcagttggcctgtggtcaataagaaaacataacttttaaatcactaatgaatagtaaaaagcatgaattttcatgaaaccggattacagttaactttttgttgaataggaatctttctgacattgatcaagatggaaaacttacagcagaggaatttatcctggcaatgcacctcattgatgtagctatgtctggccaaccactgccacctgtcctgcctccagaatacattccaccttcttttaggtaaggaacatgggctctgatcaggaattgtatgcggagtatatgaattccaaacttggctttattgactatgtgtcttacctgattttcatccctgacaaggaaactaagtatccgtgaattctagagactctcatctaggtctatgttaatcttgggcccattttgttcttcaaagtacttgaagtatattagtgaaacaatgaagtaaaacatcaatagattgttgattttctaccaacctatgtcatcaatgcttaccagaaattttcacaacagatgccagcagcaagagagaaactgcatgagcctatgcatagagaagaaaccaaggagatcacacttgtgaattccacacatttcagtggtaacaaaagctgctagcaatgtagaaattataatcaggaagacaaagaaaattaccctggactgaaagacagtctcagtaaagatgtcaagagagtcacctgaggtccagtattgtgactggcatcctcatttacatccatgcatgcatgcacacgctgtccaggacagctctgtctcctggctttgaacataaaaactgaatatgagatcttacaagtacaaaggagaatgaaagaaagattaagatttctgacctgagtcctcaaactgcaggaaggactggggcaaaatcccctttaaatgaagagaaatagagccattactgtcagcacacacgtggtacaggagcaagctgaggaaactgtgactatgtaggaagcaacagatagctgaggcactttgcctgtgaaatcccacaactgcaacattggaagctgataatgaatgcgtaaaaaggattgggagacggtttaaacacagcaaagttaaaagtgtaaagtggggagggtggtgcggtggctcacgcctgtaatcccagcacgttgggaggccgaggcgggtggatcacttgaggtcaggagtttgagatcagcctggccaacatggtgaaaccccgtctctactaaaaatacaaaaattagccaggcgtggtggcaggtgcctgtaatcccagctactcgggaggctgaggcaggagaatcgcttgagcccaggaggcggaggttgcagtgagccaagattgcaccattgcactccagcctgggggacaagagtgagactttgtctcaaaaaataaaataaaataaaatgacataaataaataaataaataaaagtgtaaagtggaagaaattagtaaacaaagtgatttgttttacgaactatatagacattgcatgtgtttcttagggggtgaaatggagagatgggaaagggaagagagatgctcctagtgagctgagctgctgatcttcccttggaggaatttaaggttacttgagagggcaatggaaatagcagctcccacttagtgctcaccatgtcccaggcattgttcttaccactttttgattattaactactttcatcctttggaattgtttcaattttggtggtgattcttaagcttggcactcagagtctgatgacattccaatattcattaaaaaactctttgtaaatagagaagaccaaatctttatattttccttactgtaaatgaaatttgctccatggcatggtaaaatctttaaaaatccttcttcataacttgtccaactccacccagacagctctgtgtgaatctatttttctttttccccgcaattgcagaagagttcgatctggcagtggtatatctgtcataagctcaacatctgtagatcagaggctaccagaggaaccagttttagaagatgaacaacaacaattagaaaagaaattacctggtaaggcagcctttatgttgagttaaatcatttagattaaacgaaattagagatttcctatctctaagacaaagatagaggtaaacataaatttagtttttgacatttttgccttgtaacttaactgaccttagttggagataattgttaattaagcttgtggatttgggtctggatagagaaataagaacattatgcactctgctaatgcaccgttgttctaacttgtaacttgaaatctgattataaactgctaaacaaaaattatgtaaatgttatccatagaatatacagcactaaaaactgatgagtattaaggtgattgcttaataccaccagtgcagaaatagaaaatcaaatcatctactgttgttttctcatgttgttataagagaattggaaactccttaattgcaggaacctattttaaatttaatgtgaacctattttattttatttattttgttttttgagatggagtctcactctgttacccaggcaggagtggagtggcgcaatctaggctcactgcaacctccgcctcccaggttcaagtgattctcctgcctcagcctctggagtagttgggactacaggcacatgcaccacgcccggctaatttttgtatttttagtagagatggggtttcaccatgttggccaggctgatctcaaactcctgacctcaagtgatccacctacctcagcctcccaaagtgctgggattataggcgtgagtcactgtgcccagctgaacctattttaaataatactcatttacaatgataaatccatcatactattaaaatattctaaggtggctatgaattattaatgatgagatgataatgatactaagaagcaaatgaaattatggagtcttttatgataaatactttgtcagtgtcattttgctgcatttaagatgctcagcagttaattggtctggtcagaacactggctgtcccagtttattgtctaaactaaattaccttttgttcactgatgaaatactattggaaatattttacgtgcaagcctgcatgttgagcaaagaatctaaatgttaatacatggttcatactttctagaacctttaaaatatattagaggatttaagacatccatataagcaatcacttcagcagtatgtgagtgggataaattcctggagagtattatagatgcacaacagacctcacttatggttggttggtgtagactggggaagatatgaggaattaaatgtctgtggaagaggtcacagttgagttgagagttgaagatgaatagggtcaccacaagtggaagtgagaatagttcaggttttgataacaatgagaatgaaatttcaatggcagataaggacaggaatgcttggaatgcagaattttctttttctgtttttagtagacattcatttaaaattttgaacaggaagcaacattatcagagatttcatttgtgcattcattccttcaacagccgtttattatatgcctcctacatactaggaatattgccagatgctggaattaaaaagatgtatagagacttggagagttttttaaattgagatgagattcacataatacaaaatgtacagttcagaggctgtcttagtctgcttggactaccataacaaaatagcatagaccgggcagcttgaacagtgggaattttatctctcaccgttctggaggctggaagtccaagatcacggtgtgcagatttggttcccagtgagggccctcttcgtagcatgcagacagcagccttcagtttttttgctcacatgggatttccttggtttgtgcatgcagagggagacagatctctcctctctctgttttctctatctctgtctctgccttttttttttttgagacggttgtttcgctcttgttgcccaggctggagtgcaatggcgtaatctcggctcactgcagcctccgcctcctgggttctagcgattctcctgcctcaacctcccaagtagctgggactaaaggcatgtgccaccacacccagctaattttgtatttttagtagagacggaggtttcaccatgttggtcaggctggtcttgaacttttgactttaggtgatccacccaccttggcctcccaaaaagtgttgggattacaggtgtgagccactgcgctcggcagtccctgtctttttataaggatattaatttatcataagggccccactctcaacggctaattttttttgttttattttgtttttgagatggagttttgctcttgttgcccaggctggagtgcagtggcgcgatcttggctcaccacaacctccgcctcccgggttcaagcgattcttctgcctcagcctcccgagtagctgggactacaggcatgtgccataatacccaggtaattttttatttttagtagagatagggtttctccatgttggtcaggctggtcttgaactcctgacctctggtgatctgcctgcctcggcctcccaaagtgctgggattacaggcgtgagccaccgtgcctggccagctaatctaatcttaaccttccagaggctccatctccaaatatcacattagggtaattagggcttaaacatatggattttggtgaggcgacacaaacattcagttcctaacaatgacatttagtgcattcacagtgccttgcagccacaacctctcttgtcccaagatactttcctcacctcacaacaaaactccatatccatcactccctccagcccctggcaaccaccaatctgctttctgattcttgggatttacctgttgtggatatttcatataaatggaatcatatatgactgtttatgactgacatctttcacttggcacaatatttttgagattcatccaccttgcagcatgtatcattacatcatccctttctgtgggagggggactttgaatttttttttttttttttttgagacagagtctgctcgtcacccaggctggagtgcagtggcgcaatcttgtctcactgcaacctctgcctctcagctttaagcgattctcctgtctcagcctcccaagtagctggggttaaaggtgcctgccaccacacctggctaatttttttgtatttttagtagagactgggtttcaccatgttggccaggctggtatggaactcctgacctcaagtgatctgcccacctcagcctcccaaagtgctgggattacaggtgtgagccactgcacccagccaggactttgaattttaagatatcagagtagaggataccatctcctctgaaatcaccaaaggtgagcaagaaaaccaaaacatacttgcccgctttcatctctaatcgctgactacagtacgtgaaggaagtctgtctaaagcagtgaagtccaaacaggaatgtgggaagaagccaaagatggatgctcacagctgcagatctcaaggcagagtgagaagcaatggttcttagatgtggaccagggactggcatgctgcacagggtggcaatgagtgctcccctggccggcgttggtaccaaggaggattgcgtgaggccaacacagaaatgaaatagacactgctgaggacagtaagggacaaggatgatgggattgtagaaaatgaagaaataaaatggacataaagtattagaaaaaaaaggatagaactgagtaatcattctaaatttataattgatgtgttaaagaaggaaactgaataatgggttagaaaaaattgttgactgactgtgatctccatagggatcagggcacagcttgttcttcagtgtgaaaagccgaatgctcacctttcactctgctttgagaaatcttgttagaatagaggactcatcagcacggttacaaggcaaagggaaggagggagagagacagagactcatggtccagaagagagggggttaattcctagggcaagctcatgggaagaagggaaaggatggagtaacagggaaggaaaggagtctggatggtgatgtagaactgctagataaggatcttttagaaacagtgtttggcgtggaggagaagatataaacagagaggttaggcaaagggggttttcgttgtgctcattaacaaggacacagaagcttagggagttctgggtttgggtttgtactacaaatttcaaatacattggtgagttttcctttgaaaagagtccgttgaaaatcttgagttttcatagttgctgtgttccttgtctgaagtaacgtttgaagataagaagcgggagaactttgaacgtggcaacctggaactggagaaacgaaggcaagctctcctggaacagcagcgcaaggagcaggagcgcctggcccagctggagcgggcggagcaggagaggaaggagcgtgagcgccaggagcaagagcgcaaaagacaactggaactggagaagcaactggaaaagcagcgggagctagaacggcagagagaggaggagaggaggaaagaaattgagaggcgagaggtaagcaggcgagagtggagccacccggagttagtgtgcgatcaccccttttcagaattatccaagtgatctattcacgccatctttgtctttttacaattcagtagttttagtatattcccaaagttgtgcaaccatcgtccctaattccagaacattttcatcactccagctctttacccattaagcagctactccccatttctttctccctccagctcctatcattaattttactttctatctttctagatttacttattcaggacattttttataaatggaatcatcaatatatggacttttgtttctggctttcatttagcataatgttttcaaggttcatccacattgtaaaatgaatcagtcctttattcctgtttatggctgagtaatatttcgttatatgggtataccacattttttaattcattcagcagttgatggtcattgtggctattataaacaatgatgttatgaacattaatgtacaagtttttgatgatacaattttgtaacaaaccactgataccagtaaagtgtttttccagactgttttctctgtatacacctatataaaaatataaaggtttatatggcggagagtgtaagggctgtataattttttaaaaaccactgtaatagtatcataccaattacattgttctgcaatcttcttttttttttttttttttgtttgagacagagtctcgctctgtcacttccaggctggaatgcagtggcatgatctcagctcactgcaacctctgcctcctgggttcaagcgattctcctgcctcagtctcctgagtagctgggattacaggtgcccgccaccacgcccagctaatattttgtatttttagtagagatgaggtttcaccatgttggtcaggctgatctcgagctcctgacctcgggtgatccacccgcctcagcctcccaaagtgctgggattacaggcatgagccaccgcgcctggcccatgcaaccttctttttaaactcttttaaaaatatgtctgggacatcctccctatattctatggaaggcttcgtaaatttagcgccatacctggaaaggggctaagcaaatcttgtctctctttccaattttagtacattactgcagaagcaacacatggttctttcatgtgaatgaaagataaaaatgaggaatttttcgatgtaaaaaaatagcctgagtgctgtgcctcaagcctgtaatcccagcactttgggaggctaaggagggatgatcacttgaggccagtagttggaggccactgcattccagcctaggtgacagagcaagaacctgtctcaaaaaaagaaagaaacaaaacttatagccataactcctttttttttttttgagacagactctcgctctgttgcccaggctggagtgcagtggcacgatctcagttcactgcagccttcacctcctgggttcaagtgattcacctgcctcagcctccggagtagctgggattacaggcgtgagccaccatgcctggctgatttttgtatttttagtagagacagggtttcgccatgttgcccaggctggtctcgaactcctgacctcaggtgatccgcctgcctcggcctaccaaagtgctaggattacaagcgtgagccactgcgcccggccccgtaactcctttttgttcagacagacactaacaaaattttaattttcagaatgaacaaagataggcaaacttttcttcaacgtaccaaaaaaatgatattctagagtatttattcagaattatttaatagacatttaccatgtatcaggtgtagttggatgacccatgagtcagaggcaattcccatagactgtcagatgctctgatatgtactctatctagcagtcgtcagagccagtcgttggagggagcaaaagcttttgtggtaaaaaggaaatgaatgattaggaagtggggagtcgcagacttttaaaacgagttaagtaataatttctcttttggtggagtaaaatcaactcttgtttgtttttgttcaggggtgttttagtttgattttactacataaattttccttcttggcgtgtcagtaaataagaaggagcatttttagttagcacatcaagcattcttgaaggcataaagaatggaattctaatggggaaataatcctgtcatcttacgtaaatatagtattatgtaaatataatacccagttctgtgtattccctttattcccatagaaggaatactgtatttttatgtaattttttgttttctaatgtgatttcttgtaatgtttaatatttcatccctaaaaggaaagacttcctagatgccatttttgtgaaaagacattgtgtagtgtaagaactgaaaaattagtaatttgtctctgtaaatgtcacaggctgcaaaacgggaacttgaaaggcaacgacaacttgagtgggaacggaatcgaaggcaagaactactaaatcaaagaaacaaagaacaagaggacatagttgtactgaaagcaaagaaaaagactttggaatttgaattagaagctctagtgagtgaagtttggttatactttgaaaatatactaagatggaaccattaaaaacagtaataatttttattatctttcatttgttcaagaatgataaaaagcatcaactagaagggaaacttcaagatatcagatgtcgattgaccacccaaaggcaagaaattgagagcacaaacaaatctagagagttgagaattgccgaaatcacccatctacagcaacaattacaggtgaggaaatatgcctcttaaaagctattatattaaactggcatccttttctctaattcatttcatttacttacttattcagtaaacattaagcaactgtcttgtactaggcactgggaagcaaaaatgaagtagacagggtccttgtgtgaaaagtagcctgtcaaggagacaaactcagcaaatatttactgagcactgcttcgggccaggtgcttttgcagtttctgaggctacagcagggacagacactctgtcttctgggagcttaccctctgtttgcaggaggaacagagactaacaaaataaagtgtgtactgtattagaagatgaaaagtgctatggagagtgagtagggaagggaatagagagtcctagggataggaaatgttgtgattttaactaaggtagccaagacaggtctttctggatggtgacatttgagcagagacttgaaattaatgacaggctaagccatgtgggtatctggcagagcaagatctaggcagggaaatagtgccaaagtcctgaggtcgtagcaggactctgagatgccagttacagcaaggagactactgggtagagcaggtgggagctggatcacacagaacctgtagtccaccaacaggactttggctttactgtggtaattacaataaataagtacacttaagtattttagggggtcatatgagagctatatgtatactaaatagttggagacatacagagcacttttagtagttctgtcttcattttaaagcctatccaaagttgttataatatcacctggtttggtatcaagtgctgaactacaggggcatcaaattcatgtaaatattgcctgtggatgatcatatttgcctgtgattcctttatgttaggctttttctcagcatgatgtttttgagatgtgtccatgttactgagtgaatgactcttttgtttcttttcatcactgagtagtgtttccttatgtgtccattcacctactggttgatattcaggttctttccagtgtggaacttttatgaataaaactgcagtgagcatttatgtacaagtctttatgtggaaatggtttatttctcttgggtaaacttttaggaatggaactactgtgtcatgtaagtgtatatttaaccccataagaaactgtcaggctgggcacagtgggtcacacctgtaaacccaatactttgagagggcaaggtaagaggattgcttgagctcaggagtttgagaccagcctgggaaacatagcaagaccccatctctaaaaaaaaaaaaaaaaaacttaaaaattagctggcatgggggcgttcacctgtagtacctgcctgaggcaggaagaccacttgagcccacgatatcgaggctgcagtgagctatgattgagccactgactgcctgggccacagaatgagaccctgttcaaaaaaaaaaaaaaaaagagagagaaaagagaaaggaaagaaagagaactgacaaactgcaaagagtttgtaccattttacattctgatcatttaatttgtatttccctgaaggctaatgatgttgggaatcatcttacatgtttattggcgagtattttttactgtgcatcttcgttgaagtgtctgaacaaatcttttgcccattttttattgggctgtttgtcttactatttacttgtaaaagttctttttatattcttaacaagtcctttgtcagatacgtgttttgcaaatattttctcccaatctggcttgggtttaatttttgttagtggtattttttaaagggcagaagttttaaattttgatgaagttcagtttaccgttttttttcttttggtgttcatgctttttatgttctatctgagaaatctttgactaccccatgactgcaaatattttattttcttctagaagtttttggggcttaaaaaaataatttttacaagtttttataaattgaaaaaaacttaaaattttaagtttcatagttgtatcttatatgtttaggtctatgagctatttcaagttgatttttgcagatagtataaggtaaaggttgaggtttatatttttacatactgatacacagttgttatagcaccatttattaaaaacactggcttttttcccattgagttaccttggtagcttgttgaaaatcagttgaacatatttgtaatggtctattctggactctattctgttcttttgatctgtctgtcctttaccagtacctcaccctgttgatacctaatttttgaagtcaagtgatacgaattctctgttattgttctttttagaattgtttttggttattccaggtccttaacatttccatgtacattttagaatcagcttatcagtttttacaaaaatgcttggaattttgttggaattccattgaatttataaatcaatttgggaagatttgacatctcagcaatagtaaatctatggcataaatctctattttggtagttataaatttctctcagcaatgttttgtagtttgcagtgtccaagtcttgtagatactttgtaaagtttatccctaagtattttgtggcttttgatgctattgtatattgcatatttttattttagtttccagttgtttggtgccagtatatggaaatagaatttatttttgtatattgaccttatatctgtgattgcttaactaacttcctttgtgtgtcttactttgttgaccagaacctcccatactatattggatagaagtgggaagagccttgttccctctcgatgaaggaaagctctctcaccatagagtatagtgttaaccagggttcttgtaaacaccttttatcaggttgatggacttctccttttgctgagggtttttatgatgaatgggtgttgaaatagatcatatgttttttccccgcatctattgagataagtatgtgttttttctttcttattttgttaatatgatgaagtacatggttgccatttgaatgttaaatcagccttccattcttgggataaaccactcttggtcatggtatattaccctttattaaaatatttcactacattccatttcccattattttattaaggatctttttaaatctgttgaattcaattcaacagagatattggtttttagtgttcttctaatattcttgtctagttttgatatcagggtaatgctggcctcagaaaatgagttggaaaatattccttcctcctctattttctaaaagtgtttgtgttgaaatagcatttcttctttaaattttggtggcattcaccagtgaaggcctctgggcctggagctttcttgaagacttaattataaaattcattatgcagatatagggctattctgattttcttcttctccttgaatctgttttgattatctgtcaatgaacttgtttatattatctaaattattaaatttacttgtataaagttgtttataatattctctttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctataatattctcttattgtatgtaagtctgtagtatctgtagtgatgtctcttctttctttactgatattggtaatttgtgtcctctcactctgtctccgtgcttccttctccttttccttcctaaccccttcttctctcctttctcctactctatctctcctccttcttcttttcttgatcagtctatctggagtttgtttatttttaaaaaataagttcttggctctattgatttttttttttttagtaagcccttggctttattgattttctctgtggtatgtctgttttctgctttatttttgttctttttctcttgtttcttccatttacttatttggggtttaattttcttttctcaagcttcataaggaggaagtttagataattgattttggacctttcatcatttttgatacaaacattttaagctttaaatgtccatctaaacactgacattgccatatcccacaaatttttaatatgttgcattttcatatttattcaattcaaaatcttttttaaattttctttgtaatttcttctaattctttcacctttattgagatttatggctcagcatatgctctgtcttggggaatattctatgggcgcttgaaaagaatgtgcatgctgttgtaattaggtagagtgttccctaaatatcagttagatcaagttgattcatggtggtcttcaagtctcctgtgtcttgactgattttgtgactacttttattagctactgagagtggaacactgaaatcctgatcattgtggatttgtatatcttcctttcatttctgttcaattattgtttcatgtactttgaagtcctaagaaactccttatacatttgaaatttgagatttgtaaaggaaaaagtaccagaagttgattgctggaaattattttaaaatattacaaaatgcatgcacctttttaaagtatatttttcttttcttttttttttgagacaaagtctcactgttgcccaggctagaatgcagtggtgcgatctcggctcactgcaacctctgcttcccgagttcgagtgattctcctgcctcagcctccccggtagcagggattacaggcaagcgccaccacgcctggctaatttttatattttttgcagagatggggtttcaccatgttggccagcctggtctcaaactcctgacctcaggtgatctgcccaccttggcctaagtgtatttttctatgtgttaactctctttatgtgtcttttgttaactcttgaggtaaagtttcataaaatattctcctggaaaatttagggatgaaggccatgtgtttattaaactaagtattatcacctaatactatatgaccaagtacaatttttattaaagattgatgtttagactgttcacttattgataatatgataaaaatcaagattcccaaaaatgtaatgaagtgaaaaataaaacattctttgaagaaagaaaagtatgtagtaggtaatcagatattggttccctttctgtacagggattagcagatacttgctttggagataagtcagatctgatttgtgtattctgttttatcaagatttttttttctggtatggattattcataggagaagatgcttctaaattctagctattgagttaactctttctaccatttagacatgcattacacagagatttattccacataagccagtctgtatctaaaggtggttattccaaaatggactggtttttagcttctgatgaaaaattttaattaaggcatttttagtttttcaaacaaaaagtcaatacatagagctcattttttatcaaggtaaaaataaaagtcaaatattctttattataacctaggaaggctgccattttactgaaacatgcagaaactatacaggatattttcggctaaatttaagcagatactgttcttggcaagttaaccacaaaaattccaaacagcctgtgcagtgtggcttaacttttttcttgtgtcagttaaaaaaatagttgcttcaaaacttttgtgtacctgtttaaaattccatccagtgtggtggaaaaatatatacagcagctaagattctagttgttaaaaatctttgatttctgtttctaacttcaggtatacggtaaacctaagttcagccttagtaagtatcaaagttcaggatagagtaatagggtagctcctatttagaccactgagttagtttacaaacagtaggatcactgcatttgcatttgatcccggtgccattggaagatcattgcttcaatttatctctgtggagtagtacttaatgtacattttttgaagcttataaatatccggtaagtcaacaaaaatataagaaatatcagggaagctataactgtgtagggaaaagcatttggcaaacagagttaatttcttggaaagaaagcaggagccacacctaattaataattaaatgcagcttcaccatgcaggatttgggaagagtctgagaaaactgacttaagctctgcctggatcttaatgtagatgtggtagccttccctgtcattcattactattttcctccttccttcccaggaatctcagcaaatgcttggaagacttattccagaaaaacagatactcaatgaccaattaaaacaagttcagcagaacagtttgcacagtaggtgttttatttttaaagttgaccttttctttattctttctttttttgacatggagtctcactctgtcccccaggctggagtgcagtggcgcaatctcggccaactgtaacctccgcctcccgggttcaagattctcttgcctcagcctcccaagtagctgggactacaggtgcatgccaccacagccagctagtttttgtatttttagtagagatggggtttcactatattggccaggctggtctcgaactcctgaccccaggtgatccatccactttggttccccaaagtgctgggattacaggtgtaggccaccgcacccagccttttcttattttttaaccagcaagaatttccttaagtgaaatgagaacattaaaaaacattttcctcactgcaaattaaagtttttcttatctttgcgacgtttttctaaaataggagattcacttgttacacttaaaagagccttagaagcaaaagaactagctcggcagcacctacgagaccaactggatgaagtggagaaagaaactagatcaaaactacaggagattgatattttcaataatcagctgaaggtaactcttctatgtgtgcctgcatgtgtgtcctacctttaatttttttaactgtccaaatgattagttgctatttaatcacaggcagaaaaatttattatgccattgtgagacaatctaaattgcacttttctccttgaaaatataagaatgaatttggcatctataaattagggctgaatgagtggccccagcatgacatctatttttaacctgaatcatattttgacacatctccattcttttgtctgtttatagtcacatcaagttgattccaaaagctttatctttcttatgttctttgaatactactaaaagggattgttttcttttttaaaactaagaatttttctgccacttcttatcttcattgcgcttaaatgtagatctttattttgttacctcatttttaaatcttactgttttagtggagtaattgcttttgtctcttgtggcagaagtggtgtatggttttgtcacatttgcacagtaaaattgggaaaatgccaaaactctgaggaaatgtaaaatggttagatcacagcctttttcagatttggtgtttctgatttaactttacaactgtatcatcttaagaatgttaattcttggccgggcgtggtggctcatgcctgtaatcccagccctttgggaggccgaggcaggcggatcatgaggtcaggagatcgagaccatcctggctaacacggtgaaaccccgtctctactaaaaatacaaaaaattagccgggcatggtggtgggcgcctgtagtcccagctacttgggaggctgaggcaggagaatgatgtgaacccaggaggcggagcttgcagtaagccaagatcacgccactgcactccagcctgggtgacagagcaagactctgtctcaaaaaaaaaaggaatgttaattcttaaaatcagaacacaaacagtttatttcttataaacaatcatatactactttagatgtatgtagatattagcatttttgttattcttataagaaattggatgttatacttttttcccctccaaatatttgttttccttttctaacataaaattctttttaagccaattcagcttttgacagtgggaagaagtaaaactcctattctataattctaaaaacaaaattaaaaattagcatatttgaaacttttataatagttgacctttggattgagattctaggccaaattgtctagacatctgagtttgaggtatgtgtgctgttctttcagagtattaggtaatgatcttttctcaattgtacgattccaggaaagtgctcttaggggaaatattatttgagccaacttagtgtttttcttcactttgctttcatgcttacatggtgtgtgtttgtgtgtacactatatatgttctatattcatgcatatatgattatgtgtggtatgtcagtattggaagtacagctgtaaattaaccatctctagaataagtgcaattagaaacaaaaaaacaaaaaagaataagttcaattaaagtatgctcacattaactttcattgtcacttgtctcttttataagcaaaaaaaaaaaaaaaatagcactgttgcaaagcctatgttgctttttaatagtctcttgggatataaactgttaaatattaagctctcttctgaacccaggcagtagtccagatttgtgccttcacattgattctttttctagaaatttgactcccctaaaaaaggttcaggtattagaaaatgatactctagtgagaggcttttgataaatgtctagaagattaaataattttggtgattgaatttctgttgccattactaaagagaacacccttaatatgtggcgagtcacccctactttgtttaattgactatggctgctttcagtatcacagagtttcttacataaaggccaattttagcccccttttccactagccctttttccaaatatgcttatttttaaataagagtatttcttcttgttttttaattttaattttggctttctcttattaactttaattaatatgatgagtttaaaaaaaatcacaggtcaggtcgggtgtggtggcatgtgcctgtaatcccagcactttgggaggcaggtggatcacttgagcaagtggatcattcgagactagcctgggcaaaagggtgaagccctgtctctacaaaacacacacacacacacacacacacacacacacacacacacacactagtcaggtatggtggcatgtgcctgtagtcccagctacttgggaagctgaggtcagagaatcacttgagtctgggaggttggggctgcagtgagccatgattgtgtcactgcactcctgcctgggcaacagagtgagaccctgtctcaaaaaacaaacaaacaaaacagtaaacaaatcacaggtcagtataactatattgttttgttatttaacacgcatttggaggacttagtgaatatgttgtgttatggttattatctctagtattcctctcaaacctgataaagccaaaacaaacaattaaattggagaatcaaaagatttatagaatttgattgagacaactcagagatggatttatcatttagtctcttaagtgtcacttgcccacttttctttgttgtagccacactggaaaatgaaatactttttttgtaactttagagcatgtgtccattagcaaccatgttttcttggatgaagagataggccaggaggagccagtctcctgactcttggggtttcttcagtgcccctcttgatcggcagtgcctttagagcatccacgctgttgatgcaaaaattacttctgccttcctgggatgtgtcatttcacacatctaacctgatagtgtgaatttgttgtatcctaaaccttcctttccctaaaggaagccagctggagagtacagaaaagaaattagggcttcctgttcttttgtatttcatgttcacgtagattgttcacctggaagaaggaaatgcagttccctcattataggttagtactgtaacactggaggaataccttacagagtacagaattttaaaattagttgatcaggatactaaatctatattaagtggctggctccacaaatgaggataacatttaacaaaaattgattctcactattttgggtaaattgcaataagtcattcacctactttgatgcatgctcagagttatgtccagtttcttaggtataaaggtaatacagggaataatcgtaccctggttcagcccagattctgagttataagacagtgattaggaagtataggaagcgtatttagtcaaaaaactaaatacacttatactttccttttcttttaacatacaatctgatttagttctttctctagaatgtcttgctcagattaatttgtcttttgtgggtttctcccattttcttcagttcaggaagaattccttccttccctacccaaaatctgataagcaaagatagaaattctcaaagcattaattaaagaggaaaaagttacaggttaacaggtatttgtctcgtataggaagcaacctgttgaaaacataaggcatacttataatcgtgatcttctgttaaatggctccatattcaaagtcgtgggcctttaagtttctacctaatccatggaaattgaaggctcattttttgttttccaaaaaaggctgtttttccatgcgttttaatagatatttaccttttaggtgtcatatttatatattcaaaaaaagatcctaagatgtaaatatctttctatttaccacccaaaccaataattacttgagaaaggaaacaggaatcttactgtagcaaataaactttgcttttgggttttaaataagtctgtaaaaacagggagggtgggagaagaggagaaacgatagcaccctgaaatattgaagctcttatcctacaaattccccaattggcagcctttgtacttatgctgcccttgctatgcatgataaattttaggtttttgattatcaaatgaaatatttgaacagtgaattaaccaggaataattaattttgttgtgattattgctagcatgaattagtacatcttaaaatagttttaattcagtgggtaaaatttatttaccattaatttctgcttttaaaatgtgttctgtatgtaacaaataccttattaagaaatcggtagtcttctcagatccacgttctagaaacaacaatttaaaattattatctatgacttctacttcagtttacatgaaaattaaaactcccaacttttttggagactctgtgtaccaaaagggtagtttttcttacacacagtgcttacctataggcataaaattatgattcaaacaagtgttaaataacattactgctaggactttttggacagtagcacctgactttaccttgaccttggcgatgtcagtagttactgtagcagttttccttggcactgacagcctaatgttccatattttaatgtcttagctctaagatggagcagcagcacaaagtacagcttgtagttttccaggctcctttaagaggtcaaataaggagaatccaacacccaacggagctagattttatgtttcatgttgaaaagttgagtccttgttggttcctgtctagtcagtgtgtactggacaagtcctaatgtgaatggccgtttacatttgagcatttctttcttccagtcagtggcaatggaggaggcagtgttgcagtgcctggcagttctcctgggctgcgtcatccacttagacttctttctaaaggtctccatgccctactcaggcaatgcacatctttctcagactaagaatgatgaaccatctccagctctgtgcttcagtttcccctgcgcagatgagtgctcagtgtctaagatagcatttaccatgaagtactaagccttctttataaaagttaattactagttattattaatcgtggagtatgattgattctttcctattgacgagttgcgtgtgtgtatggtggtgtaaactgaattacaggctggacaaggtactgtatactgtagtcttgtctttttaacaagcattttagatcattgaatttgagcttgtctgcaaaaatgtgaaagcgctcagttgttatttgggtcatgtgcatgtttccatcatgggagacatactgtgatcagtatactattccaaatgtgtatagcattttattttctagcaaagtttgaatatttaagactaattcacaattatgatttaattccttagtatacttgggaaatccaggcttctaaaattagacacaagaggctgttagaaatataaattctccccataatgctacctgttctaaaaattgctcttagaaccgaatcgatgttgaaatgagaaggccagttgtagtaaatgaggttgtttgcttaactaaagcctttatactcttggtttcagacactagctttcatgggaggctcattcattatgaaggcagtgaaaggcaaaatgtttagcaaccagaggaaaaaagaaaagagctggagaaagaactgcagaacagagtaagaagtcagggaaaaaaatgcttgtgaagggaaacaatgaaggaaggagaaagactcagaaagaggaggcacagagacagtgagagaaatcagtatgaattcaaatagccatgttgctttgtcataattagtagaataatgtttggttctttcattctgttcaagctaaaattttatttttacctatatgatcctttggaaaagacctcttatgcacagaagtaataaagtgctctaactctcattctgtcagattctgtgccataccagtaggctgcttggttgagttttttagttacagcatgggttttttttctttttaaggttgtaaaaatttaataaaagataatttgggaaagggttaagaagaactcagtcttttgaaaaaatactttcttctcttaatggaatattgctttgtgactgaagcagacactttgagggaaattcagattttcaggacaaaatggaatcagttttctctttctggtaatgcttcccaagggtacttcccaaagcctcatggcagagggtgtctgattacctattactattgcagagaggacaagagcttctagctcttctgcccacctccttccacacacacaccttgctccaatctcccttagcacttgtgacacattgactaccattttgtgccatgggaaatagtcttattattttgttaaatactgacttcaaatttaaatttttgaacatgttttcaaacagtatatcccatttcagaatttaaataaccagtcaggccaggtgcagtggctcatgcctataatcctaacactttgggagttcgaggcgagtggatcacttgaggtcaggagtttgagaccagcctggccaacatggcaaaatcctgtctctactaaaaatacaaaaattggctgggtgtggtggcatgcacctgtaatcccagctgctcgggaggctgaggcaggagaatcacttgaacttcatcacggcagaggatgcagagagccaagatcatgccactgcatcccagcctgggcaacagagcaagactccatctcaaataaataaataaatgaataaccaatcagtatatatttttctgtatagtcctctcagttttaatgcatcgagaatgaataaatgtagcctggtacagtgacatatatctcaggaggctgaggtgggaggatcacatgaagccagacgttcaaggctatgatcgtgcctgtgagtagccgctgtactccagcctggacaacacatgtctctaaataaataaattttttaaatgaatgaataaatttataattttatgataaatgggctatcagtttaccttgatttgggtatagtttctgtgttctgaaatcgttatttttcaaaattttccatacaggcacaagttctcacctcatggggtttgttaactggccttctttaatagctcttcatttgtttcacaaccacttaatttgaaaaagttaatgtattttaaaactccaaaggccttctataaattttgataccgtatactacatattatccctaggtgagaaataatgtttatttacagaaaagcacttctactttggactttttatggatgtgatattatagataaacacctgaaatttctgatgctggtagctacatcattttttaatgaggtcaatttaatattaacagtatgaagattattataaatgttatatgtgagctaaataattttatcttgatttatggttttgagttcatgaaatttaagtaattaagttatgtttgtttttgtctctcatttccaagagacatcctgaggcgaaccaaaagcaaaatccttcaaaaaagttaaatatctaaatcagtaaatacatttccattaactgctggtctcctttcatagacccctgttgctatttttttctcttcatatacattatgcaaagtaatgtttgtgaaaaggaatcctatatattgttcaggcgcatgctactttatatttcaagtaatattgtttcacataatacatgtatttttgagtgtctctaagaccagatgaaggagaaacagtcacagttattaaatcaagtgattctgtgccttttagcttagcaatagaacaaacttcttcagtaaacctgagccacatttctcaggggaaaaatagttggattttcttgggtattcaatttgtcaaacagattgcttttgaaatactttggctctgtgccataggatgtccaaagatgttttatggttcaaatatcttagttctttaggggaaataagtgacttttccctctttggtctagggaagaaaattaaaagcaagttgattttcgtttatcttaactaatacaaaacagaatcttgatatgccagtaatttgttattgtggttcatgagctgtgcttgatcaaagaccccttgagactaataaaagctgtgagctttctccaccagaaaaatgcccatataccccaagtctgcatgcaacatagtatccacagggctgaagcttattcatggaacctggttaagaaactctgtattttcatgattctgcataaattgtgattttttaaaaaaaacttattttaatatttaatattaatatttaatatatgtgtgtagtatatatactacacattttatagttttattttttctgcataagtatttgttacatgcagctacaatttcttgactacttaataatttcttatttaagaaagtactgtaattatgttttattggaagataatatcaaattattacatactctacctagtgtaaaacatgtcatacacttgaatagaattcataaaagaaaaatcaacaaagttgtacactccgtactatattgctagattaatatccatccaagaaacaagtttttgtagaattactggttttagaaaaaaaaatcacttaactttaggaagaaccgagtgagatactgacttttgattcgtggtaatttgtttgttttctttctgttataatagcaaaataactgtgacaaattccatgtggatttaatagaatttgcagggtcatttaaatcaagttgcctaccaggaaatgttgatactttcagtgtggtgaaattttccttagccatttcccccaataatttgctcatttcctagatatgtaatttaatggcactagatttgtttgtcactttgaatttttttctttctgaaggagttaaaaggatacttcttaataactgtaactgtacttgagtctctttaatagtatggagaagaatgagagaatagtgtagccatctgctcccctatgtgaaaggactgggtattctacaaggactttgttctggcaaaggaaggagagtcattcactcatttttttaagagtatatatttcttcattctatagattgccttctcggaagttcaactttttaaaaagcttatcaacttagaaatcatccatgttctgcttatgttgattcatgccatagtaaactctttaagtccaagaaaagagaagacccagaatgcctgcctctgggcagcatgttgatttccttacaactgtgtatctcagcagtgtttgacttggatgaaggaaatgatagaaaaactttgccatcttgaaatctggatcataaggtgccagagccttctgttagcttatttgtcgtctgttattttatggttcctgcaagctccattccttggaggtgcttgaaactgcaacttacataatcagttcctaagatcggttcaaatactgctatactcaaaaacaagtgtgtttaaaaaatttaagtatcttttttcatgtatttgatacatttaaaaattatttttgaaactgtgtcataggtaggttttttttctgtagattcttcaaaatcactttttcttacaagcttttcaattttatagtctctcctaatgtattactagctttacttaaatccggtaatcaatgatctataaatccatatccagttacaagagcctagtatagaaaggaaatgtgcggtataattcttggggaaaaatgaaaaatcttcatttgtgcctatgggctatctattatagtatgttgatacatcatggccagtgtccattctggttgtgcagtacctgttgttgaatattttgaatatcactcatgaatacattttttcctggatgaaataaggacttttctttatttaatatataatcagattcctgaacatcaagctgaaatgttatttctcttccggcatttcttactcctttgtagggtttaatttcagctcagggttattttgcttatgcttttttcacttattcttgcagttaagaataaaattctaaataaaacagatactgaaataaataaatactttatttgtttgttagacattgtgatgaacaatgtctaagatttatcagatcccaaaactagaagaacacctaaagatcatccattctgattcatctgccagctcatatcagggacctgagattagaatcctggtttcttgattcccagttctgtaccttttttattttttatttttttgagaccgattcttgccttgtcacccaggctagagtgcagtggcgcgatcttggctcactgcaagctccgcctcctgggttctcgccattctcctgcctcagcctcccgagtagctgggactgcaggcgcctgccaccatgcccggctaattttttgtatttttagtagagacggggtttctccgtgttagccatggtggcgtaacttttaagtatagtcttttgctgtaaattattttttctgaacctatttaagaatttgatggtcttgaaaatgaaattttcattcatattattactgattatttattcttgattccaggttactatgaaaaccagtactactgattttttaacacattaaaattaagttttacatcccttggtatggcagtgagaaagatgatgaaaaatggacttctttctccctagggttgattttctgatctcagcactttaaacagtcagtgtgaggctgcatcattgctttccagtcttagccttcttttccccttccctctgttccacatgtcaggtctgctgccatagggaacagtccaatttgtgccttacaaaggtaccttttcctgctgtgtcctgcctggatgttcccagtgtcatctgctaggttccctactgaagccccttcttcctttctttttcctccttcccccttccttcctttccttttttccttcttcccttcttctccattttccccttccccttttcctccagtaccttcctcttcctaagtacctccccccagacccctatctccagttaaactttttcttttatctcattgttcttttaaagcctctcagcgtcacttacagtttataaaacatttgtgtatggattttaactttaaccttagcaaaattagtaggaaaaggttagcctaacccttaggatttttttccaataacaagtgcattttaatactgactttctacagacaaaccgtctacctttgttgttcaatctctgaatgaatctaaaggtaggaattttagggcctggaagaaacctacctgcccatctagtcttgccagtgagaaaggtgatagaagacgacagggcaaatcttagtccttaactctccccatagagatccctgggccatgtactgggaggaccagccctggttagatcaagaaatcagctggaaagataccttggctctactgggcactttgactcatctgatttatcgctggcccacataagacgagtttcagtgactcaatctattggtgaccatttgatttctatggaatcagggagtttcttcctcagcagacgtttccttattcttcctattttcaggtgtctaaacttgtgacttgagtactttaaatatcatagaatgcattttattttcagtagcctgctaaggaaattactgctattcctgcagctagtagtatcaagtgaggaaattggatccaaggtattcatcatcaaattatagctttttacttttaacctgattgctggtttagtttggggcagttagcgacttgaaggatagatttagtaagaaaagatgctctggaagaggagcaacttgaagaaaaatagaccctggggggaagaattgaggtcaaagaattgaggagcaaagagatgtccatttgttctaaggcagcttagtgaaaggtggaggtgaggtttgaatggaggtagtcagtgaagaagaggcatctgtattttcaaagccagtaaaggttggtgttgattgataatcaaaagaagcttaagttttattcatgatcatcgtcatatcttggaactggttacgttccattatgattgctgagcctttagcagcagagctcacctcctgcccttcgctagcaggtttcttctagagcagatcatggaaaatggtataatgtgtatggctcattagaatgtaatcttaagtggcctttggaaatcagtcatgtcaaaatgtggtgtgattctagctttccaagttgactttttccaactctgaaacgttatctcctaagtgtcctaggcttcccactatgaaatgttgcatgctgataaatagttgatgtacctgtcactcatgtcgctacatgaactgtttctcggttaattataggaactaagagaaatacacaataagcaacaactccagaagcaaaagtccatggaggctgaacgactgaaacagaaagaacaagaacgaaagatcatagaattagaaaaacaaaaagaagaagcccaaaggtgagtcttctttggattgtggactcatctggaaggaactttgaggatttactattctttgcttggcttctccaagtagttactgcaccagaaagagccttcagtctttagtgtgcatgtgaagtgtgagtgcaaacacaaacacgtgtatatatgaatctttgcatgtatcagtaccctctgaagtttttggttggttcccagagctctctcaagctactactatgtagataaatggaattatacaaggaaattgggacacttggtgtgctcatttgcatgctaatggccagttcacagccttttactaacagctaacaggggttggagtgcctggtttaaaatccaagccactgagctagtgccccacacagggcttctccagcagggtcagggtgggcctcttctgtttttcaactgcaaattaaactttagtacaaaagggggaaatttgccaccgctgcttagtgtgtaggatacagacatgtttttatctgtttttgtttgaagatttatttgtgatatttttatttttacttgtaacttactgtagtaaattgtagaaatttgtgtctgattttgttactgggtatttgccttttaaatgtcagttaattttagactccacgaaacaaaaatgaccaaatgtcccaatgacagccccgtaaattataaaagttggtaattgaaattagattaaggccaggcatggtggctcacacctgtaatcccagcactttgggaggccgaggtgggcggatcacgaggtcaagatattaggaccatcctggccaacatggtgaaaccctgttctattaaaaatgcaaaaaattagctgggcacggtggcacgcgcctgtagtcccagctacttgggaggctgaggcaggaggatcacttgaacccgggaggcggaggttgcagtgagctgagatcatgccactgcactccagcctggcaacagagcaagactctgtctcaagaaattagattaaaaaggcgaagaaacggatacttgaggcaagtcattgactttagtgggctgagttcagttaacctgccaagagctgtgcatactttcttatgggtatatagagtcttctgtttgtttttcagtgccagtggggaggtatctggggtcccagaccaatttacaggattgttttatggttttcttgggggtcagactaaggatctcctccttggatgttgattaactccatccttttcttacccccagagtttataaaatgcttttattattcacactataccacactgaactgttaaattcctacagtgtagaaataaacataaaatacagaaaaatacataaaatagcataatacagaaaatagcataaaaatataatatggaatatgtattccaattatatagataaaaactgcaaattaacgtcagaaattagatggttatacagtatatatggtgaccttcattggtagaaaatataaagtaattcttttttttttttttttaattttttattttttgagacggagtctcgctctgtcacccaggctggagtgcagtggcacgatctcggctcactgcaacctccgcctcccaggttcaaccgactctcctgcctcagcttcccaagtagctgggactacaggtgtgtgctaccacgcccagctaatttttatattattagtagagatggggtttcaccatgttggtctagaactcctggctggtctagaactcctgacctcgtgatctgccctcctcagcctcccaaagtgctgggattacaggcatgagccaccgcgcctggccactgtttttattatggtttttttgttgtcatgaataaccatatccttacccctccaaaaaatgtttttatactttcttaaaagacattttaaaaattgtaaataaaatgtttaagatttaagtttaaagacttctgcattaaaatatcacattcatacagagtagaaataaatgtaattttttgacaatggagaataaaagtataatttgtttcaattatgttcccgtggcagattcctaattctagccgatgacctgtgtgcgttagccatgtcacaggatggcagttcagggtggagactctgggaccaggctgcctgggattgaagcccatgcatgtatggctgtgtgacgtggacaagtcatttaatatctctgccccagcttcctcatttgtaaaataggagtaatactaggactaccaacctgattcgcagtttaaaggagttaatatatggggagctagttattattatgtcatttgttattacatattagtttcatttaaagtattttctgactttataaagtattatggaatgagaaaaatcattctcagtcttttactgtgggtttcaggttgaggccatcaaaaatttcaaggcctagatttaattacaattatctatttgtggtagctactttgaaaaacaaaatcaaagtagttgaagtcaataaaacaatcccttgctttcaacttcaggtttggggagcaatgtgtgtgcatgtaaatgtgttgttccctttgctggggggaaatttttacagtgttgggtgtattttatttttatagaagttatgttctctgtgttttatggctttgtttgtttgttttgtcagtttaataccagctttattattaagaagtatttttcttattcttgtaaccactttgtaaaatacatcagaaattttctgtgttttcctaaatcatgtgatttcttctcattcagaactggagccctgattcagttgccccatctgaacaacaatgttcccttgatgttcccatcccatttactggatggagctttttttgtgaaaagaggcaacagtagtgttaacttagagttgctttcttgctgtaatcaagcgtgtttgttggcagacgagctcaggaaagggacaagcagtggctggagcatgtgcagcaggaggacgagcatcagagaccaagaaaactccacgaagaggaaaaactgaaaagggaggagagtgtcaaaaagaaggatggcgaggaaaaaggcaaacaggaagcacaagacaagctgggtcggcttttccatcaacaccaagaaccagctaagccagctgtccaggcaccctggtccactgcaggtattagaagccaaaaataattatagaaaataagtcatcttctctcccagagcctcctgaaaaatgcccctatctcatcagtacctgtcttggctacattaacagatgagaacgtcagtctcttattttgagcatggccagctcttctttccccagggtcatttgagatctgtgtaattctcccaccaccatgccagcctctggcccacgttacactggcatccacgagtcctctacggagctaacaagtggcgtgaagttccagtggtcttatatgctgcaaaagaacctgctgtttctctggtttgttatttccctccctggaatttctgagctgtttctgcaacagaaagtggcacctttcacccttgcctccactgatggggcattcgctgtcttcggtctgcattgcataaaactgcttttactttttgaaaaatgtaaaagcataatttgccttttctttacttctcttttctttcttctctttccttttcttttttctttgagacagtgtctcactctgtcgcctaggctagagtgcagtggcacactcatagttaaatgcagcttcaaactcttgggttcaagcaatcctcctgtcttagcctctcaaggagctgagactataggcatgcaccaccatgcccagctaattttttttttttttgtagagatggggggtctcactttgttgtccaggttggtcttgaactcctggcctcaggcgatcctcccaccttggcctttcagagtactgaaattacaagcatgagccaccatgcctagcctaatttgccttttttttttaaaaaagggataaatgaaagactgaacaaaaagataaatgaaagaccaatctaatcggaatagctagaaaaagctatcctttataatatctgatgtgagctagaatgtatttaagattcttgtgtggttgtgtgattgtacagttttgcaaataatgttcagtggaagcaagtcattgctttttctttgtgtggtaaattataccagttttgcttggtcatccatgtgcttctttagtgcttcagtatacagaaagaaaagaaagaaaaaacactttcaagctattctgtaaaggtttactggtccccagctacatagtgggcagagatgggcgtgaggtatggagttgcattaggcacctacctgccttcagatgcatgcagtccaggggaaagactggcaggtcatcagacctacagagtagcaaccatgtcataggaggggcaaattaattttttgatagttttttttttaatctgaaaataatttcaccattgatcttaggaagttagtttaagttcttcatgcgtcctcctagtataagatgaggatttatttttccccttcagtcagtaggaaatcttgcatgtcatacagttcaaaatcatgtggagataatacttccccctcgttgcttttcagataagataggtatatgtcaaaatacttgtagctcttgagtaaaaatgcccaaaggtctgttactagtttttgctaaccagaatccaaaatatcctccgctcatgtgcatttttaaacattttatttcatgtaaaatctaaattattttcatctaggtttcatccttaggctaattatttcccaaagaaatgtagaggaagagtgtcttcatcggggattatcagtataaccaaaatcagcacttagtttttatatgaccaggttaaagagcctaaaacatctgcattttcatgtttcagtatggaaactggtgcctctgttccctcccaaacaagttgactccttggctgattcagactttgggtcatatcctaactgctacattgtactcaacacactgggtagggaggagggcgggtattgatgctttacagatctgcactgctggagcccaaggaaagaggcagagacaagggacctttaggcagcctcgccgcacccaggcttggagtgacctttgtttagagagagtcactaatgaactctctcatgggtttttgttgctgacgtcagatttggctgtgctttggcattcagtatgtgtttcagaaattccttgaatggagggaaatagttcagaggttaagataggcaatagaggagaggttagttgtttggcttgttgtcatacatttgtgttctctgtaattatttatttttgtcccccccacctttttttgtaaacagaaaaaggtccacttaccatttctgcacaggaaaatgtaaaagtggtgtattaccgggcactgtacccctttgaatccagaagccatgatgaaatcactatccagccaggagacatagtcatggtaagaaagactccagtgagagggtcatttctgttgaagattagcctctgtcctctttttttcactttattcaacaattgtgagattgtcagtgagtatgaaacccaataatccagcatctagatttttaaagtataagctcaatcttctttcttttctattaaaatgaaagatggcatttaaaaaaatgtatcctaacatcattttaaaattgagttgataaagacagtgtgttcttatttttaaatctataaatgtctgataatttcagagtttagattactacttatatactatgagtatacatatatatgtaatacatatattttatatatgatgtatagacaatatatatactagtgtgcgtgtgtatatatatgtgtatgtataatatatactagtgtgcgtgtgtgtatatatgtacacatatatatacacacacaaaaggatcctccaaggtggaaggaggccaggagtctttaagaaatagttataagtgcaaaacactctatcaaatcattctcataattgcaataacttttgtatctttgcatcaaagcatcttttttccctttaattatgtgaacttttaattatgtaaaaagagtaatgaattatacagttaatctgctttcctactttgtaacagaaaatagtttagaattttgctttgttattgtttctttccttgaactaataatcattttatgatgtgactaaaactataggaaccagtttaagaaagaaaatcagacatggttgatctaaatcattttctaaaagaaaatagtagttccttgttctagttactctctttagagtcttagaagtagtcaactctgcattactcttaacattttttttttttttaaagataatttagattttttttttgttgtggttgacacaagttctcactctgttgcccaggctggagtgcagtggtgtgatattggctcactgcaacctctgcctccctgcaacctctgcctccctgcaacctctgcctccctgcaacctctgcctcccgggctcaagcaaagcgattctcccacctcatcctcccaactagctggaaccacaggcgtgcaccaccatgcccagctaatttttgtaatttttatagagatagggtttctccgtgttgcccaggctggtcttgaattgcctgggctcaaacgatcctcccaggtcagcctcccaaagtgctgaaattacaggcatgagccaccatgcctggcctagaatttgtaaagaactgtgaaagttaacaattgaaacaaacatgtttcttacccaaggactgtatgtctttgaagtataaagggtggtgtacaggtgattttactattactcatgcattcatcttgccatatacacatcatatctgtggatctttaataggctaaaatacctagaaataacaatatgtttggcacttagagaaatgaattcctgtgtccccttttttcctaatagctgctttctctgtaattaccatgggctagaagaagcaaggccaaacatcccaaattattttttcttttttttgagacagggtctcactctgtcacctaggccagagtgcagtggcatgatcttggctcactgcagtttccacctcccaggctcaagtgatcctcctgcctcagcctcctgagtagctcagaggcgtgtgccaccacaccgagctaatttttatttttttacattttgtagagacagagtctccctatgttgcccaggctccagatctttaaaagttaaaatcaccttaacagtagcaaaaacctcttcaagtatactccatggcttcattcagcacacagttattgactgaaacatgctgggtgccagccttactcatcctttacagaaagaactgttggtttgggcatgccactctgtacacacaaatggtaacttgagccagcggggtgtgtttctgtcagctttcctctgacttcaccacctgctgtttcctacaccgtggtttctgatagcctgaagctactttactcatactgcctcatatttgaagtagtgtatcctgtaaagcagattaattgtaaaatatgtaaacaccatataataggaatctaaaatttctgaaaatacaatgtcacatcagtgaggacctcattacaattttttttttaatgttaaacaaaccagcctaatatttttgaaactggattttgttgcaacacaaggtgcagagaagcagctcgctctcatcctaaagtaagggaatgttatgaaatgtgatgatgaggaaatgttgcaggtgatctgtatcttaatgagaaagtgttgctctttttcgggaacatatctgggcttcacttgtaatcctaggcctgttgaaaccttttcctcgaattggctagttaaccaccagcttgatgagatgcgtagagtttagatatgctgtaagaataaagcatgtcattaaacatatattttgccttgctttcaaacctttgctttcctggtggaggttaaaggggaatgggtaagtgttgcctaactgtcaggaagtctgcatcttattcaatgttttgtccttttaagtcacttgaattctgtgtaagtacacgtatctctgggtgttgttgcggcagtaaaaatgtgtttgagtctgtgtagtaggttgtgctttttaaaaaaaaagtaagtcgtaagtcttctcagtttgtgtactgggtttctttttgttagattccttttaaggactaacttgaatgctctgtgtttggcaagggattaggtcaagtctccatctcaggccatagacaaaaaggagttccaagtagattaaacataaaagataaaattctgggaaaaaaatttttttaagcagactattggaataattttctggctaagaaaggccttttgaagctataaaaaccagaagtcgttaagaggcaaaaatggacagtcaacaatatgcaaaaattaaaatgtctatgtttcaaaatatatgagaccaagggttacataaagggttacccctgttacataaagattccgaacagttcactttgaaagacacccacaagccttaaacaattggcagagggtgggaagggacattcacagatgaagtaaaaagtcagttatttaaaaaatacatgaaaagatgcttagcttcttgggtgatcagaaaaatgcaagttataaaacaaaatagcattgttcctctgtcaaatgagcaagtttaaaagtctggtaatatccagctttgtcaagagtataggacagtggatataatatacattgttagcatggttgtataaattggttaagcgatttggaaggcaatttggcagtgcctgtttagatttaaaattctcgttccctctgccccagaaattctatttttctccttcctctcattcttctccttcctcttttgggcacatgcacaaatatgtgtgtacatggatgttcactgcagtggtgttggtaaaagcaaataaacagcccaatgtccatcagtaaagggatggcttaaataaattatgatacagctaaaaaatacaatgaagattaaaacttatgtagatcacatatacacataagatttccatcaaaaaagcagaatatgtgcagcataattgcattttggttcgaaataaaactatatatgtattcatgtgtttatgtatagttaacagttttgaaatatatatatcaaactgttaacaatggttaccactgggcagtaaagaaggggctttcgtgttgaattttatagacttctatgttattttcatttttataaatgtatctaatttgtaatttttaataaaacaaaataaattcaaggacaagtatattagagagtatctactcaggactgtaataatgtttattatatctcagacctcccaaatatgtaatgaaatgtagaatgtactactaggcataattcgttggcttgcagaagggacagcagtgtttcgattttgtactacaaaatgcattgtgatactccaggtgccattcagctgtgttatctttgtgaggataacagtcaatgcaaaaagatagatattgacatctaatagcaacaggtttgtatttttttaatttcatgaattttgcagttaacaaatgatgagcatgagacatgtagtacaacattactgtcagtctccctaggttgaaaaatccggggttcacttatacttttgtgggcacagtcatcagattctcagattcctcaaacgtctttgggacatagcttactataatatgttcgatttttagaagtctaacattgtgacagtgttttttaatgtaggcagtcttagccttaaaaatattttgtttttagaaaaacttagcctggttttatccaaaactataatttttcatgtttaacaaaaatttaatgtggtaccttgtatatagcactattctcagcactgtagataatagaaaattatcaagtctgccattcatatgtttaaaatctttttagaaaaatctagagaaacacatgaaaaggccaacatgtgatgaagttctcaataaacattcactaactctgctaggaatttaaaagaggagaggaatcagtgtaaagtgatgtgctcagggaagaccaaatgctttcaattgagtctgaccttgatggctaaggcttagatgcgtagaaaatacatggcctctcttgatctggaactcccaatacttggagggtgaattaaatcaaatttgacatccgtaacatgttagtagaacataagaaatgagaagacctatgctcactgctgttttgttgaagtttatcttgagaacacaggctgagtgtctaaatcagtacaatcttttggctttcatgggccacattgcaagaattgtcttaggctgcacataaaatacactaacactaataatagctgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaaatgcttatccttggactggtacaggcctgaatgcatccagattgctgagggagcttccaaaaaataaccatgccagggctcatccccagagattctgagaactctactgcatatacagccttcagaagtctgaccaggtggttctgttaggtagtcaatttcaggaaccgctgatctaacctaatctctttttcacgtcaggactaatcctaaatcatttctagaaaatatcctcttaaaaatatccaaagaagaatggacttctttagtagttatcagtcattagccagtcagttcattctggaaattgtttgtcttagtgttactcttataacaatttttaactcattcttttccttttcttctcctgacagacatttttttaaatgtagccaacaatacctttttcctctaccttccatagatttccatagattaaacatcagaaagtatctcatttagtaacaactggccataatatcactgcagttttgagggaccagtatacacgattacagggttggctcaaatctggcccaatcactgcctgttttataataaagttttattggaacacagccaggctccttcattcacatattgtgtgctacagtggcggatttgagtagttgcaacagaggtgaaatttgccagcctccaggttggagctttagaaagagtttttttgtttgtttattttttgtttttgagacggagtctctctctgtcgcccaggctggagtgcagtggcgcgatctcggttccctgcaagctccgcctcccgggttcacgccattctcctgcctcagcctcccgagtagctaggactacaggcacccgccaccacgcccggctaatttttttgtatttttagtagagatggggtttcaccgtgttagccaggatggtctcaatctcctgacctcagaaagagttttaaggccgggcgcggtggctcacgcctgtaatcccagcactttgggaggccgatgtgggcggatcacaaggtcaggagattgagaccatcctggctaacacggtgaaaccccgtctctactaaaaatacaaaaaaaaaaaaaattagccgggcatagtggcgggcgcctgtagtcccagctactcgggaggctgaggcaggagaatggcatgaacccgggaggcggagcttgcagtgagccgagatcgcgccactgcactccagcctgggcaacagagtgagaatccttccaaaaaacaaagacttttaatatcctcatctaggaatttggggagaaaccttatatttcaaaaccggcaaatccatggaaaatgttttactacctgcactcctcaacacatcccatgcagccactgtcagctggtctgaatacacaggctaaacctgtttgctacacttgtttatcatgttctatgaggggaaaaaggaatttctgcttcccccctttgtgacaaggtcagagattttagaaatattaatcttacctaatgaagatggcagccatggagcatataaaaattgagaaaagaggtgtaatatcatcggcctttgccaaacggacttgaagctgaagtggctgctgtgtatatttgactgttgcatcagcgagctacaatatgcagtgtgtaattactaacatttagtagagcagctctgtaacatagtcccagaaatgtgagcaatatctggtgtttgtacttcgcttaaatgatgtttcactagaattacccccaaatacgttggggtgttacagtgtgcctgataaatgaaattgtattgagaccaaaattgttaataataacatctcccttatagcccccagtaggtaaatgtacattgtgtaaaagtccacgttggaaccagtcatattacaaagcagtttgtgttcctatttcttggtctgccataatcttatgttttccaaaattggattggcattttgggtagttttccaaatccaagaagaaatatttttcattttcatatgttgacctttgtgccctttctaagtggttaatttaatttaggtgttaagaatgaaagtctcttacagcccctgaaccttaaaatgtaataatttattaaaattgatgtatacttgtaagagtaaattaagctaattgagactattgtttggggggctgttgagaccaacagatttctttgcttaaaagtgaaatgctgatttcactgttatccttagggatgggagaagctcttgcttaaggggataagaggctgatatggccccctccttcactcctaggtgtacactgcaccagcaggctttctatcacatctgaggacaggctgggtgttatcagtttactggagggggaggacatttccccagggcttcaggtcgcattccagatgtccaccagtgtctcgctctgttactcaggctgagtgcagtggtgtgattttggctcactgcaacctccgcctcccgggttcaagcagttgtcctgcctcagcctcccaagtagctggaattacaggcatgtgccaccacgcccggctaatttttgtattttttgtagagatggggtttcaccagcctgaaactcctgacctcaagtgttccatccaccttggcttccagaagtgctgggattacaggagtgagccactgcacctggcctaaaagtcttattaaccagtcaataccctgtgtttcaagggagtaacaatagatcatgggacataattaagcaaagcagctgacctttgaggaggtccaaaatgagcagacgagtaggagttcccgtcgatcaagggatccacttgagcccctaaaggattgcttatggcaagaaggtaaacctagagggagcagaggaccaggcagttagagcagggaactcctgaacagagaagcagattgttacctagagtgaaggtaaagtcaagaccaggcttttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcatgaacccgggaagcggagcttgcagtgagccgagattgcgccactgcagtccgcagtcccacctgggcgacagagcgagactccgtctcaaaaaaaaaaaaagaccaggcttttagaataggacagaagcccaagtaggagaactacagcgcaacatcagagctggacagcagaagagagaatttaaaaaaaatatctggcctggcacggtggctcacgcctgtaatcccagaactttgggaggcctaggcgggcagatcacctgaggtcaggagttcgagaccagcctggccaatatggtgaaaccccatgtctactaaaaatacagaaattagccaggcgtggtggtgggcacctgtaatcccagctactcaggaggctgaggcaggagaattgcttgaacccaggaggcagaggttgcagtgagctgagattgtgccagtgtactctagcctgggtgacaagagtgagactccatctcaaaaaaaaaaaaaagctaacacttttagtatgccaggcattggtgtaaatatttgtcagtcctcacagtgagcattataataagacaggtatttttattatccccattttacagatgaagaaacaggtgccacgagattaaacttgcccaaagtcaaccagttaatagattgtagaactagctcctaaattgagacggtctaactgcagagccctattcttgatcattacactttgcagtcttgacactaagttattgtgtgtttggctcaagctcctaacccactcctgcctgacatcacctttggtcctagaaccaaggtggctgatcttgactattgaacctactgagaagtctggcaggacctggcttggatagagacagctatgtttccagtgtggagcaaagttataatgtgtcaccatatcaccaaaatgtaaacaaggaaggaaagacatctagccatttgagttcagcataaaagaagatccaaatgggggaaaatttatcttaaatcctcatctagagaaacagttggggctgcccagaaaaagaacagtaagaacaaaacaatgactgcaaagtggctagtgtgttcatgtgggtgtaagtgtgagcagaaatgatagaactgtgaagccaaaaattcaacctttggaagtgttattgcattttatacaagggaactccttttttggttgtttggagaattctcagctttaaaaattgcttttatctgtgacaataaagattccctaaagtggagcagcaagcaggcatcccctacttgctgaatatattgtaaataacaggtagaaatcagaagtaagccttgccttgcattctgttttctccacctctaccccaaacatttgttaattcaaataagctaataagtattgaaccctattactcactgtccactgagtacatacagatagatgtttggtttgtttaatgtaatcattttttgctttatttttaattaatttttactgaatacttgaatggattagataactggtatttttgtcagatttttccaaaatcattgttaagaccctgcctactcatgtctgatttctaagaagcaactttaatttccagtgaagtgtttgatgttttactccttaggcagcataggaaggggtaaaaataagatataaggtttcataagataagacccttataagaattatagtaatgaaaataaaattttttttttgagacggagtttcactcctgttgcccaggctggagtgcaatggcatcatctcagctcactgcaacctccgtctcctgggttcaagcgattcttctgcctcagcctcccgagtagctgggattacaggcatgcgccaccatgcctggctagttttgtatttgtagtagagacgaggtttcactgtgttggtcaggctggtctcaaacttccgacctctggtaatcccccgcctcagcctcccaaagtgctgggattacaggcatgagccaccgtgcccagcccaaaaataaatttcccaatagcaaatgtgattgtcctccaaagtcattctcctgttgctcataaaatagtagggacaactcgtaaagaaaagtagaatcgttttggccattttggatgatccatttgagtcagaattaaaatgcaaaccttaaaagcatttggcgtaataaatggcctctgtgaaatttttaaacagtataatcctggattttcctgtgcactgaatatgcaagttaaatttatacaaaagaaaactacaggaccttaatacaattgattattgctgtaaataatgacttccttaattttctcatcatgtgtctgtggagcttttaaatgcctaaacacagcagcagtcagctttgcttctcgtggaaaccatttaaggccatggtttttttttttaaatcttccttgtccttatactgaataaatactacttagttattggaggttttcagagtactgaatttatattgattgcaccctttgctttcaactttaagtaataaactcaagtcaaattatttttaataatgacatgactttctgatgaagcctgttaagtcacttcccaaatcaaaatatttaaattacatgcctcaggactccaggcactttgtctcaactgccattattaggacagttatggggtaaggcttttttaaaaagtgcagagaataagagcttgaattatagtgcattttttttttcagcattactgcttagactcttttcccagacacttggactaagatgaagagattcctatgccatatgtcaatctaaagagggcagaggcttgggacttcactgtagttgggtgctgggtctattcaggggttaatttagttctacttaaagctgtgactttttccacaggtggatgaaagccaaactggagaacccggctggcttggaggagaattaaaaggaaagacagggtggttccctgcaaactatgcagagaaaatcccagaaaatgaggttcccgctccagtgaaaccagtgactgattcaacatctgcccctgcccccaaactggccttgcgtgagacccccgcccctttggcagtaacctcttcagagccctccacgacccctaataactgggccgacttcagctccacgtacgtgttggtgggctctttctgatgatttttgaaatcccaatttgatcatttcccccccacccccttaagtattttcatagtcttggattgtccttctatgtgagggagctggctcattttcagtactcctttctctagctggcgaattggagattacagtccctgaactggatttaatgatatcattgtctaacagtgacttaccatggtacaaaatgaagcctgttatcttgttttgttcaataatgtatttgtatctatcattcttgtggaagaagtggagaaatacagtttcctaataatctattttgacatccatgtcagtcagcaaattttcagagttatttcctgcatgcaaatagcacttttttttgccaggcagaagcaaaaattgaattcagtcatgtggttctgaataagatagaaagctgtttcctttaaagctttccactttcattaatcttatacaaatgtacagtagaatgaagaggtgtttgcacttggccagttagttctgtgccctggttcatcaggaaatggcattttaaaaactgtgtgtaagcagaggtttgaaatgatagatgaaatggttgttcagacttccagttatagggccatgacctagatgagcaattgtctaaaaatattttatactaggatacaagtatgagtgatttgaataagaagtgtttaaattttttttcaagtctaatcatctttcagaagaaacaaattgaaggcaaggaatccagatgtattgctggagaaggatcagatggaacaaatagagggaagaaagaataattactcagggcgggaggaagtggagggaaggatgtaaggaatagcaagtttttcatactttattttcacataaaaggctgaaggcgctaaagaaggtcccctcatctaatctctgctttaagaaaaaaaagccttccattagcttgacttccaagttgaaacttttccttactcttttggtcttgactgaaaagttctgagtttttaaactaaagcttaggctaaaatagaagactaataccatattttccaggatttgttttgctggggatcaaatcagtatgcctcttcttcaatatatgtatggtgtgcagttctcttgctataattatgggcaccttattttccaaatgaaaaatcaggaattattttgattttcagatttgtttgtatatcttataaggatgtaaaaagtaaattgcctttagatctgcagtcacacagacatgtttatctaaaattattttttattatttattattattttgagacagggtctcacttcatcacccaggctggagtgcagtggcatgaccatggctcacagcacccttgacctcctgggctcaagcaatactcctgcctcagcctcctaagtagctgggcctacaggtgcatgccaccatgcccagctaatttttaagttttttgtagagatgaggtctcactatgttgcccaggctgatcttgaactcccgaactcaagtgatcctcctgccttggcctcccaaagcgctgggattagaggtatcagccaccatgcccagcctgtttatctaaaattattaaaatcacaaaactagaactgtccctgggacccaggacaactggttgctgtcaggatgccacttgtaattgctgtggcatctaggcatactaccaggtacttgctgtagagtgcatgggtctgagaaatggtgttgagaagctccagctccataggtggcatgtagcttttttttttctcatttaactattgttattacaaatgataatgatcatgtgaggatgtttctccggggctttgcagttacagagtatttccctagcctgtatttcatgtaccctcacaactaaccttaagtggcacagtattgttcccattttatcaatgaggaaatcaaatgccttttcctctcctccttgttcttttatttatttttctttttgagacagagtcttgctctgtcacccaggctggagtgcagtggcgtgatctcagcagctcactgcaacttccacctcccaggttcaagcaattcttgtgtctcagcctcccaagtagctgggattacagactcaatgccaccacacccagctaacttttttttttttctttttgagacagagtctcactctgtcatccagtccagagtacagtgatgcgatcctggctcactgcaacctctgcctccgaggttgaagcatttctccttcctcagcctccttagtagcttggattacaggggtgcgccaccacacccagctaatttttgtatttttagtagagatggggtttcaccatgttggtcagactggtctcgaactcttgacctcaggttatccagccacctcggcctcccacagtgctgggattacaggcatgagccactgtgcccagcctcctccttgttctttcactgtagaaagccacattaagtatactaggtttgtgttgcacaggctcattggttgccatctttttcttttttctttttttcctcttttatttatttatttatttttttggtactttactgtgggtaaaaagctggcatattagggagtgcttgcttttttttttttttggtactttactgtgggtaaaaagctggtatattagggagtgcttgttattcatggtgttgtgcttttccctccaggtggcccaccagcacgaatgagaaaccagaaacggataactgggatgcatgggcagcccagccctctctcaccgttccaagtgccggccagttaaggcagaggtccgcctttactccagccacggccactggctcctccccgtctcctgtgctaggccaggtaaaggcagccagtgagagtgtgaagacttagcatgctatctagtgccaaaaacttcagcaaatgctttttggcaatgtcattttgaagcaagccttgttatgtgtgtcttggttggctggcagtatgggaatccagtgcaggagccagaaatctgctgtgaatagttgggagttgggggtgggggtgggacacagtcaacttctcctgcctgggttgatgaaggaagcttcattgcagaagtggcacttgagctgcatcttgaccagtgggtaagatcttactagaaaatggagagagcctgcctgtcagacagaaactgctgggaaggctcgaaggcagacagtcagaatgtatttaaggaaaatcacatacccctccatttgtctagaccattgagttttttttggaaaaggtagaccaattaaaggttaatgggaggctctgaaatgccctgctcggaaagaataatgtctgaaaggataaaggtggttattctgaatagttctcttttgcttaatacaataatgataaaatactcaaatttctatcaataatcatgccaaacagcaagtgcccatctgggaggcactggaggttccagcatcatttctgatctgagaacacccagatggaacacagggtctaggcagatccatctggaggagcggtgtgcaggaagattagagtggagggccggcagggcggtgccaccagtcagggggctgttggtgtcacccagctgagacctagggcaggcctggacccagctgagttcatgttcaccaagtagggaggtgccggtggaagcagaagaggcgagcacgtgggagagactgcagaggagagtgaagaggttggagtcacaatgcctatgggagccgaaggaaaggaaagagggctgggattgagaataagggcccaccttaaagcgggaagggagaaaggcagaaaatgaaatgaatgcgcagttaaagggaagagttgtgttttagttgtgttgagttgaaggtgaacgtgggaccctgtctggcaggctgtcggaatatagatctggaggatggaagagagcacgagactgggattatagattggagccattcccatagagaacattatcggatatcaggaaatgtgtgaggtcatccaaggagagggaatacagggagaaaatagcaaatccacaggcacgtgtgtgttctgtggtctggaagaagaagaggagctactcagcaggaaatggtactttcctttgcatctgtcctagctcagcatttagcacgtgtcacatgctcagttaacagtaactcagtgatggggtgggggtttgttccagagagtggaggtgggggatgggaggttgcttatgttactaagtaccgtggtcagggcaaagaagagaccattcattgtgacaggtagagctttgtaacctgggaaggagaaggatgaaaccacactgcaggggcgtaaaaggaaatgagcagcaagaaagtggaaagatctgcaaaaggaaagagaaggaccagagtgaggggcctcgggaaagcaagaaccagccatgttgccagtggagatgggaatggaaaagtgaagtgtcagaggatatagttggtataaggcagaaaacattaaaagcacagaaaagacaggagtctttttcttctggatgaggaagagtgaagagattggagaagataaagccaagaaaaatgttcaagttgggctgcatgatattgttctcagtgaggagggagcctggaggggctgcggagtgtagaagaggtttgggagcaggcgaatgagggatccgacaaagaagaatgaagaattgggccggcgcggtggctcatgcctgttatcgcagcactttgggaggcaggcaggtcacctgaaatcaggagttcgtgtccagcctggccaacgtggtgaaacctcatctctactaaaaaaaataaataaatacaaaaatcagccaggcatgacggtgggcgcctgtaatcccagctacttgggaggctgaggcaggagtatcacttgaacctgggaagtggaggttgtggtgagctgagatcacaccactgcacttcagcctgggcgacagagcaagactgagttctcaaaaaaaaaaaaagaattgcctggcttaatttaacctgagtccgtaatagatcattgcacattgcctcagctttctctagcaatgcttcacagcttgggactaggaataataatagttatatagctcaccactgttatttctatcatagcaatactgtgcatggatcttactaaacttccttccccctccccacctacacacatcttgcattaccatgggattgctaaactttaatagccttttggagaaagtatcatctctactttacagatgtggaaatcgagattcagagagattaaacagttgccaaagccagaaaattagtaagtgacagacctgggattcaaacccagagtccacatccagcccaggctggggtcattagggcccatcaatgtgaaaaggttgacaaagcagacacggggaagatttctcagggggagagattctgaaataccagtgagggcacagttgaaaggccaaccctggggtccatacgtagagaaatcagtgaagtggcggagaggattagacagtgcagaagggctgtgggatgaggagctacgcgggcagcaggtccactgcaagagggggaaaatggaaggtcgagaatatacaatcttaggggtgttcgaaatccagggaaaccccctcagctctgagggacttgaaggagtgaatgtacagctaagtggaaggaaataggatagggatgttgtgggtttaagaaggcaagaacccatgaagaccaggaattagaggttatcaacatagatgctgaaactatttgacctgttgtaaattctctgctcatcagacataatcataacttaatgtcagtataatataaatgacttctaaaggcatgtacaaattggttctgaagtaactctctctaggcattatcttttgttcttgtccattcatatatatgattgaaagttggtgtttcattttttactaaatgctttaagatactgtaatggtttaatgctatagcttaaaagataataaatgcctcaccctgcctttccagcctgacttcctcctccacccctccatgagactaggccacatgcagccccggattgtgcttctcttcccggaccccctgcagtgttccacctcgaggcttttgcccatgctgcgccctcggcctggagtgcccttcctccgaagccctagctgtcaaagtccttctcatccttcaaggcccatctcagatgctgccccctctgtgaaatttacgctgatgcccccaggcagaattcatccctgttttctctttattcctgcagtgaatagtaggaactcctttttagtatatttcattctgccaggtggtacacttggttgtttttatctctgtcttccccattacttgtgaattacctgctagtaatactgcccatctttatagtgctttgtggttaataaagtgcttttccctaaattatctgggggaggcagagactgtttttttcatctgtaatctcatggggcagtgcatgtagatgtacaataaatggtaattacaatgaatttatgctaaccaaatccctgttttctctgaaaaggaactaaaacaagcataatccagatagggcctatttccctgggtctacctaatctaaaatgccagttaatgatctcatgatagttcataaaatgtctgctccactgttaatcctccactaaaaatgccagtcaaattggaaatggggaggtgtcccgggcaacttgagagtgaaaatagaaccaaaatataaagggcacacagccagatgcaacagaataattgtgacctcctggctttttgaaatagagagttctagatggtcagacaatgactttgtgaagaggctggaaggctttggcctccacttttggaaataaacaattgttgggaaacagtgaagcatccagccctcctgctgtgctgcctcagggccctttgtggctgtgtgtgcttgtctggcctgtgcttgttggagaggtgccatgctcacgtctgccctaattgataacaaagcgcaacataacgagaggtcctttatgttattccacacaagggtgaaaaggtggaggggctacaagctcaagccctatatccttggagagccaaaaaagacaaccacttaaattttaacaaaaatgatgtcatcaccgtcctggaacagcaagacatgtggtggtttggagaagttcaaggtcagaagggttggttccccaagtcttacgtgaaactcatttcagggcccataaggaagtctacaaggtatttttgtatttatctgcttgtatttgatgaaaacaatattaggcgttatattactgtttgcactagttaagattcacagacaggagttgcgggattagtttgtcttctagatcttttaactgcaaaagttatagtatatagagtaccaaaagggagcctcttatagataagtgcattctttcttctctcatgaaaacctatgtgccttgtttttcattgccttatgcaagaaggaattcagctctgagacctggaacactcttgtgcattagttggagattatgactctctttatgcttattacccagtgctgtaccagatatatgtgaatacttggaaacccaaaggatctggggaaatgatcagaaggacttaattgtctttttcattagggtcttatagcatggaacctaaggttgttaattcctccaaccatattgatgttcaaaacaaattatgagctttaaaaggatgaaaatagcaaaaatattcaatgagcatctctcagtcagtcatgccttgaaataaactagtacataagccatgtgtccagtatagcaaagtgctgaaaaataagaatgcgagcttagagtcatgcctctgtagtaccttattatgtgtttttaacctagctaagtacaactatttcagctgtgggtcgtttaaagttttaaaagttaagcagttttaacagaaaaatcagtgtcattgtacgattttctttgaagataaaaattaaaatactctcttcttccattattgcagcatggattctggttcttcagagagtcctgctagtctaaagcgagtagcctctccagcagccaagccggtcgtttcgggagaaggtgagggcctgagttgtattatgttcttcagaagggtcaaggacattgtgtaaatgtttgaaatgagattgaatttcatcttaagatagactgcatttatgatcagtatattaaactacagtaaaatgtaagtttagctctttacagaatcggagtacttcatggaaaatactgtcaggtatattaatcatcaaaaactgaattttctaattatattttattataagccctttgacttttaaaagagacccattcagttcactaagaatcgagttttccgagcatctctatagctaaactatggtcattgcttcacctaacatagtctagtctcatctgacttcatagataagtatttcgttttaaaagtaactacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaataaaataaaataaaataaaagtaactacacagaccactagagttctcatagtaacatgaatgccatctgtaccatcccaaatgaaactgaaactcaatttctgtgctccatgaaaacaatcaaaccagacaatttaggactaaaaaaaaaaaaatcattttgagtatttattatgcaaataattgccttctttctcaatctccacttggtgacataatcctaaatattgtatggatgccaactgaataaaacttaggtaattcaggccctcatggtaaaaatctcacatcttttttacattcaatacagccatcatcacatcctaactggagagtgctccctgagttagatgggttttctgtgtagacatctgagcagtgttgtagttaacagatgccataactaaccaattctatagtaattctttatgggttccttgaatacattacaggagaatagaatgttttatttagtttgtctgccataatgagattgttaacattccttagaaaccttgcccagtgaaaaacagaattattaaaacagctgttttaggtggagacagcaaggattaaggtataatggtatttcagactcacagtaacaatgttcttttttcaagaggttttttaaagtaagaattttttttagttcatagtatagctataaaaccttatcactaaacaaatccagcatctaatttttgctattaccatgaaaatgattaacagagttccctttatacattctcattatcttaatgactttttatccactgttagggtaacaaggcaaaaagctcctttaaataccacatgcagtcagtttagtaaaaagcaacttatgcacctcaccaaaagataaagaaaaaaactttggtgtgttacatccaatcaaggctcactggagggctggagtttgtatcttgactcacccatctagtaacagtattattttgtttatgccttagcttctttgtctgtaaattggccgtgataactaccccttgaggtaggaaattattacaaggataatgagataacatgcagaaggcttttagaacaaagctcagtaaatgtctgctacttttatgtcgtttttgcttcattccctggattagtgataaagccacataaagtatgagcatcctcatccaatagcagtatggaggagtgtttgtttgttttgagacatgtactgaggactcaataaataggtcacaagtgaaccatgcatgtacttaaaattgggcaacataatagagttaaattctgatcttagtttgtatttattacagccaattttgaaatgacttagttattagaaatatttggaaaggttgctggctttgtgaaggggtgggaggacattagaaattctgagaaaagctatttacatatattaatgagccttttgtaaataccacattgaacataatcaaatttaaagtaaactgtaaaccagataaaatagatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaaaagcctaggataaaatggagaaaaaggggaaataagaaacctgtgcatctttctgtaaatcttttatcctgtacctagaacctccatccaggattttgtgtctggtgatctttctgagagtgtgatttggttctaagccttaataaaatccaccaagagtgatgcaaagttctacatctaattaaaaaggaaagtttcttctgtaatgcacacccttcaaattcaagacacaaaggaacattagttcttatcctttaagactaaattacatgaataataaaatgtgataaactgtgatttgtctttttaacttgttgaaaggctttctgggattgggttagacattccttttatcatcagtcctctctacctgtttgtgctcttgaatgacaactagatgcccatttttaactaaacaatatgtgtaactcattttgtgttctaacagcttcctatcatattgtgtatatggcacaataggacataagttttcaggcacttcaataaggaaaagtatgtcttatttaatttatgcgaaggatatatgctatctaacaattttttaaaaacctgtgacgtagtaccctcaaaactgaaatacacatatttaatatgcttaccaagagcctgcatatgaatgcatctgacccagtgctcagcacagagtaggtattgtgtaactcttagttaaaaataaatgtaaaaaccattttcattcaaaaagaaatcatgatgctaaatggtagatcactcttaaatactcaagtgtcggtaaacatgcagttgggttttttattcctgtgtctgggtcttcccaggaattgtctccctgtctgcagctactgaacttttatgtgcactgggggaatgtggagcccagggcattctgcagctctgtattttatctgtgactagcctttctcttgaatggatcttgtcctaacttccttattcgtaaacttgcttttgcaaagctgtctgggatttctttaaacaatcaagctctctccgtatctcaatatttctccccaccagaatttattgccatgtacacttacgagagttctgagcaaggagatttaacctttcagcaaggggatgtgattttggttaccaagaaagatggtgactggtggacaggaacagtgggcgacaaggccggagtcttcccttctaactatgtgaggcttaaagattcagaggtaaacccacattaactgtttcctctccctttctgtgcggtgattctctttgtggggagtcacgatgtttgacagcggaactttgttgggttttgctaagttctggaatgtgacagtaaatccagtgtgacctgtcattgtttgatcttgtcatttggcactgcgcagtaagcactggcttcccccaagcagaatgccatcagggctaagtggaggctgagtgtgatggggctggtccgcatcagctgggaggataatgttcagtattaagctctcttcctgcctgtaactgacttacgctttggagtaaactttcttgattagatcattatggtcattgatttttaaatgcccaagaatggtagcaatattttgcctgtataaacagaagtattctggtgataatcgccccagaatattggatattattagaaagtttttagaatttctggttttgcccacacagtagaaagacacaagatctaagggatgggtacacttttggctaggccttagaatctccgttgatcaggactgaatttaagtgctgttatccgtatgaattggaagtgctctcactgttgttaaatagagccctaaaaatttgatcacataaactgtggtcttaagatagtgcaagttgaatggaatggtggggtggacctaccacagagcatgggagtcagtcttgtaggagccacttgcacgttagtggagagtttcagggtataaatggagtcatttaacagatccaatgcacatttaaaaaaaccaacaagaattaactccttttttttttaagtgttgacagtcaattcacagttattttctttttctcctcatacctcctaggtactgagagagaaaaggctggcagggagcctgtaggggccgctttctcaggagtgagcaagtggacaaagttctctctctctttcaaatgccagtagtagagtgtatactgggctcttacatgtgcggctccgtgtactcggagctgctctgggagcgaggctgggcctggtgccctgctctaggagtcctgcccttggcctgctcacctctcctgcagctcccagaaatgattttatttgcttgggttttgtttttttaaggggtggcattgttttgctttttggtttttcttgctgcggtcttgagagcagctaagtggaattcccatggatggatttacataagtctgcccacccttggagaatctggcagaagcccggaagaaagtaattttgccctgcgagacagctggcatattggacttttcagacctggaaacagagaattcaattcttctccaggccagcaagtcgagtccaatgagagtcatacagatgatatttcaggggaattgggtaaaacactaaaagccaaactcaatttctactaccgtgcatgaaaactcttaaagtgactttaccttttggatcagttaaaatacgaaagccattacttgtaatgtattttaataagttacagttttctactttaataaaaccatccgaaataaattttaggaaaacacacagtgacttttttttttaaggtaagtggagttgtaaggtactttcttaaccacagtcttaaattattagccacagaagaactagcagtactagaaatttttagatatacatctagctatactattcaataataatgaaaaaaaaacctgaaaactcagctctttcgtcctacttgaatacagaattcagtgtaaaagcaaaatatccgacccaacctaacaccagacccagcttcagataccagaactgacgtctgggcatggggagagtcgtcccatcctgcttcccttctctgtatgggcaggtctggggcacagtctgggggactttataggtgcagggaggacagaacatggccttctgaatccatctcagcttatggggctggctgtggtttttcaaagggagcacattgaaactacttgaactctagggtactgccaattgccttgttctttttatggagtatagggagtagattctaagcctgtactaggaaagttaactggtcactggagtcttgtttcattggtattcctttttttgatatgcagcctattgaaaaatagtgagagattgcttttgtataactttgttcgttaataaagcagaatcagagtaaaaatttaacccgaacttttcctggtaaatgtttcttaaatttcaataagcaaaataaagagactgtaagttgtgttcctggtagataaatggcatatttttattctttcagtaactcatgttttgtttattaagccttttgttttgttttaattggaatgcttaatttactgcaagatagactcaagcataaattaatttagaataaagtactttgtaacaacagattccgttctggctcctgtcctgcctctcgtggtctctgttgttggcttacttggctggtttaaaattccatgagtatcccagagaggaattcaaccccagagcactttttaaacacttgatagttgggaagaaatatgctctgcctctatgcattgatagagaaatttcaatgtataaactctgtgaaattgggtggaaaggccacacaggacagccactgcctctttggatagagaggggtgaataggatgggggaagagaggttccagttgtccctgttagttttttaaaaaagaaagctcctgaagcaaatgtgcaaaatattaatattttaatgtgttaaaaccgggtagtaggctcgtgagttatattccctgtactttttatgtgtgaaatatttcataattagccatgtgaaaataagtccgagcttagtgtttaggatgtaaactaacagtcttcctagcctggaacctcctcttagatttgaccaggtccgagaagtgcctgtgcttggagccctctgggctcttacaggcgccatactctgctgtttttttctcttatagaaatgagtaaaagccacatgttttaattatttttttccatgttttcctgatctatatccttgtgtcaggtgatacagtgctatgttttcccagaatgaaaagtggggctttggggctcaagcgggtttgtatcatcattaatcgtttttaaagttgcatgatcaaaacttcagcatgcaaatgagaccttttgctctgttttaagggctctggaactgctgggaaaacagggagtttaggaaaaaaacctggtaagttacaaaccctgatgcttacttttcaatgttttgaatgtaattgatagttgctccccatctttgtgtattagggccagaagcctaaaataaaaagaatctttcctaagagtggtgagagtaagtcctttccttggaatccattaataattttacttggttatgagatttgtctgttgcttcacacatgaagagtggagacgttacctaacagaatgttctcttgggttgtcgagaaataattcaggtgaggccaggcacggtggctcatgcctgtaatcccagcagttttggagaccgaggcaggtggatcatttgaggtcaggagtttaagaccagcctggccaacaggggaatcccggtctgtaccaaaaaatagaaaaattagccaggcatagtggcatacacctgtaatcccagctactcgagaggctgaggcaggggaatcacttgaacccgggaggccaaggtggcagtgagccgaggttgctccacttcactccagcctgggcgatagaacaagactctatctcaaaaaataaaataaaataaaataaaataaatatatagataaataattcaggcaagatgctgggaagttataatacatggagctgtaggattatgggctcagctgcttctccgtcttcctcttaggcttggttagccctttttcatttcataacaatgcattcccaggacacaaacaatggagaagattagagtgtaggtcccattaatgtagaagccataggatggttttcctcggtacacattgaaggtacaaaattgtagtcatgcctctgaatccaaagtgttttagtttatttcagtaaaatcacatgtgctataaatagcacgaaaaagaaaagaaagaagcggatgtgaaataatacggtttctgtggcacgtcttcctggtctaggtcatttgaactttttggctatcatattcttagaaaattataggttgaaacagtcactgaattgccaagagacggatttgcttgtctgtctggtgcccagctccaactgggcttacatggctagggaaaagaagggaaatttcacgtagtctaggattttattttagtcagataaatactggatggagtatttagtcagataaatacagtggatggagatacattggaccaccccaccaaatctccgttttaagtgtaagttttctaagttttgtacacttgtcattccagagggtccagatatttcatagatgaagcccaggtgggctttgctttgcactgaaactagcaagaaaggacacaaaagactgcagagaatgttggggcagattgctggctgcgtatgccaggtcccttgaggagcaagaacatccagtgccaaataggacactagtttggtctttctccaaaccataaactcttggaaccaagagctggtctttggtgtgttgcaggagagtcctcatcccagcgtagacatcccagctggagctcccagtcagagcctaggctgggccagtagaccatgctgtggcctttcttgcttgccccaagctctgcaaagcatcaggcagggccaggcctgcaccatgaccgccaggtgcttctatcctggtggccgacccctgatagcatgcagaacagaatgagagcggcttgcttaagggccagagtcttacttgttccctggagtgagtagaaaagtaggaaatctcgtcagaacatgagacctttttgcgttcttcctttccattcttctttacttcattccctctttcttcttttttttctgtccttctttccttcttttctcctttcgttcacaaaccacacttggagagcaagggtagaggagcagaacagtttgttctctattgcttctagaagttcagaaagcagtagttgcagatgagccagaactcaggcagagaagggttctgtctcttcatactcagtctcctgggcccgtggaaatggtgtgtttcagagcctggtctgtggtaccgctggagtttttcccatgggacttttcacattcaggaaaagtacagaactgttcacatttttttccctgtgctgaattgtttttgcataaagttcccttcttaactccaggtccctcctgtaacgtgaaataaaaagaaagaaatttgccctgccatgatttgcacctgatattcagggatcactctcaaaatgtgagccataaagaagaaggctgtgtcgttgggagtgagaatctgcagcaacaacatagaaataagcccctgccgggctcccagtggtttctgaggaaaatgggcttctctttctactgtacttggcagctagaaaagctattgagtcctttagtcacttcaaagtagcactttagccattgggtgctactgtgctggggtgggtggtgaatgaggccccacccttggcctcagggcattctgggtaattatgggaggggtgtgacagaaggtgccaggagtgggcaaggagcggacttcgtggagggaagttggtaagtaagtttcacgggatgacaagggagtctgcagcccactgagggctcaaggatcagccaggcccttgaatgccgtgtctgcctggtagctctgggaacgggcgattcagggagccttactcgttgggtagaaatccagctcaatacattggttttgatgtgttcatctgtgaacctgggaggcgcctgcatcttcttggccttttctcctgctgactcttaacagtgcactgccgtgtttgatcttgtttttcagaaattgcccaggttattgcctcatacaccgccaccggccccgagcagctcactctcgcccctggtcagctgattttgatccgaaaaaagaacccaggtggatggtgggaaggagagctgcaagtcagtgtcttttttgtttatttacaattctccatccaagtttcaatacacaaaatctcaaagggacgctattttattgtaaagtacaaaccacccctcaccacctaaattctgtatttggatagtgagagatgccaaattttctgtgtttgtttggttcctaagtttcagacagccggtaacagatttctgagagctaggagcgcatacgaaaacatatctttcccattcctgaattcagatagagtcggcatagtgagaactcatatgacgagggatgcctgcatatccttatgtgccttggcattagagagtggagcttttcatcagtggtattagaaggtgtggcacaagagcagatttctttgcattcaaagccacatccatacatcacagtatttttagttcccgtgtgtgtgcgcgcacgtgtgtgtgtgtgtattgttaatcatatcatcttgtttacacattttaccattccagatacttcctataagtctcatttccagagacaaagatgctttaaaaagattactgttacgcagttctcatggtaaaacttcttagaatcattggtggatgcccaatctgcaagaaaattttcagtaggagcagaaaatgtgcatggtcttgaagtgacccccacagatcactcatgatctgcaggggaaaacacaataattatagagtggggaactaggacaagacctgaatgaggtgatcagaatgatgagcagtggggagaccagaggacatggtgtgtgtacagctgtgccgggagggaggagggagggagtgactggtcttcaaaaccgtcaggatcataaaagacaaaacctgtcgaaagggggctaaagaggcgtgaggactggctgcagtatctagactcagtgcagtatctagaccctgtgtgaaagaaaaccacgctgtcaaggacatttttgggataatggacaaaattgggttatggacactacattagacaaaattactgtaccagtgtaaaatttacagaaagcaataactgtactgtggttatataagagaatattcttatttttaggagatacgtgttgaagtatttaggggtagagttaagatgtaagcaacttgcaatcagatgaatcaaaaaaagaacttgcagagaagagggtggggggggagggagggagaacgcgcacaaatgagggagcagctgctgccaagtgttgacagtaggtgaattcgggtaaagggcctatgggtgttctgtgtgcttttcttattcttgccaattttcctgagtttgaaatcatttctaaataaaaagttgcctttaaaaagttactactatagcagttacttgagaggtaagccagctgacttttcatacagaaagtgtgtctccctccccgcatcctcccccatccaaagtgaagatcagcctcagactgccaggcgggcacctggccacctgcttcatagcttagtgaaggacagggcttgctccctggcttgcccacatggggcctatggaaggactgaattttccagcagccgtccgtctctctggcgtttgttgaacgtgggcctctgcgtaacacaggggggcctcagtaaggcttgaacggatataggaaggaatggtttctggaatgctttgtgaggaaggggcccatgggaaccctttggtggctattagtgggcctgtagactgacttacccaatctgctggtatttgtctgcccatgagcaggacggtatggaactacgtaagtttgagggggaagagggaggcaggaaacctttgccatgcagtggactagccacggaagacagaccctcaggtgctcctgaggaatggaggttggaacagcaggagcaggaaggaagaaggccttgctggggaaggcctcgggtctcacacagtcccgtctaccactctgtggaagtgagcctgaggccaggacaggaagagccacactggagagctgaatatataagaaacgcatcttggccagaatagaaggcacaacctggagtgtaactaaagatgaaactttccctggagagtttgctgatggacacccataaatgtccagatactactcactggttaaggaatctgacctctggaggcctggaaatccactcctttttgtcagcatgccttctcctgtgctggggagggagaggcctccttagaccctcgggtcccactccctgcttagagttgtgctgtatcacccattggtccttccagcatcatgcccctgtcctgttctggagacgtgggagactcccatcgcctgtcctccttgcctgccaggggaaggcttcctgcggggcccctctccccggtgcagcctcacgtcttaccgctgagcaatggcgtctccactccagcctctttgaaacaccagcaccccctgctctcctgccttgctgcctttgttcatgacatttctcaccagcggccaaccagctccaacctctccactttcgcaagagctgggagatcccacttctggaagctctctgtgaccatcccaaccagaagcaccgtgtccctcccctgagctccagcactggccccgtgccggcaccactctttagtattttatattactttgctttctgtgcacatttcttacttccacatgtagctgactagcaccttggaggcagcagccgtatttttcagtccccacacctctagcactgtgcttaagtgagtgtttgagtggttcttaggattctcaataaagtggctgagttgccatgacccaggagagctcctggcgctgtcaccagagtgactctcagcgtggatccacaaatgaggaaacaccagtgagttctgtgctgtgctgcagaggtgtgggaaagagtggtgtcattgcgagcagaatggtggtatactcggtagataaacgtggaaatttgtaaccagatggcttcagtcatcggcaggttcactgtaaacataaaagctttagtccttgagccaaggggatggaatctatcagacctcaaggaaagggaaacctgctctgtgttctgaaaatgacctagaggtatccctcttgataaactggcaggtgggagggcagaggtaatgtggtggaagttttcttttcttttagttttatttccttattttgggaataggtaattatagtcacatggtttaaaattcaaaagttacaaggggatataaatgtctccctcccaccttgtccccagaggtggctgtttcgatcagagccttgtttctagacgtgtgtgtgtgtatgtgtacgcatgtgtgtgtatgcacaagtagttttgggttctcttttcttggtggtgtacagaagggtagtcaaagcccgactcatgatccctaactcgagtcttttaatgggattgtgtcctaactgcaaaacccgcctcaccaactttgttataaactccccgggtttatagggacagtcatctactgtcccttcctaacagcatggtgcagaaacactccataaatgagtcttgtgttgaatcagattgaattaagtgagaaaggaatggcggtgaaaaatgtggctttagtcatcacatgggcctacgggtttgtgaaagtaacattgagtctccttgtgttctgtgtgtactgcatgtatgtcatcttgcatctaaggatgtatattacccataaaggagcatgcagacacatgagtgcatcttggcttgccactaactgcctgtggccttggggctgtcactcaacttttcatctggaaattgagaataataatactattatccttctggaattgtgtgcataaatgcacagggcctggctcataaaaagtactcagtgagggccgggcgcggtggcgcacgcctgtaatcccagcactttgggaggccgaggggtgcagattacgaggtcaagagatcgagaccatcctggctaacacggtgaaaccctgtctctactaaaaatacaaaaacaaaattagccgggcatggttgcggtgtgcctgtagtcccagctactcaggaggctgaggcaggagaatggcctgaacctgggaggtggagcttgcagtgagccgagatcgtgccactgcactccagccggggtgacagagcgagactccgtctcaaaaaaaaaaaaaaaaaagaagtactcagtgtgtattggtggccattattattattattattattattcctaaaacccatatacagtgttggcattaaccataatgtctacattacctgaaattaacagctgagtgctagcattacatgagtagaatttcctgtcccaggcaatccatggtatatcttaattttgtgatccacacagtctagccgaagcaaaaacattctgggctttgctgaccagtgattgccacaatttgaatttttagctatggtgttttacttttgtgacatagtaatccatagattttaccgttaatgtcatttgtttttcagttatatgtaagctttacataagtgctctgttataaagtgagctgtattataaaagatgcgcctttaaaaatgtttgatgtaattattttcttactaggcacgtgggaaaaagcgccagataggctggttcccagctaattatgtaaagcttctaagccctgggacgagcaaaatcactccaacagagccacctaagtcaacagcattagcggcaggtaaggagtttcgcatctctaactggaagatggtctgcatgccacttgagtttttccacttgattttctcattaaatatcttaggttgtttttcacatgtgctttaaagcacttcctgtacttgctgggactgacacccaactaatgtgatatggaatatgtctttcaaaaggaccagatatctaagtggcttttctgtgctggatacaacagaacccttgttggaatgctcttcttgcaggagtcatgaatgctgtggcattaaggccacattttcctcttgatttccttccagccatttaaattggggtttaggctagggggtgaggtgacagaaagggacacccaaaaataaacggctggggtctcagtaggtcatgagatggagctgggggccacgggggttggggggctataatgtggtgttcactgaagaccaaaatagctcccctgtgacattcactgtgggcagagggggcttcgctgggcaggcaggatgttgtactcactttcctggaggactggaaaagaacagagcacagcagttggcccagttggctattttctgattgaagggaccaaatgagatgcttcagcaagatctgagagaggtgaggtcagggggagcagatttctgctttaggtctttaagccatcattcttggttggcttttgtggaaagtgtagaatttttgttccaataccttgtggttaaatatctgtgctgtatgtacccagtgagataagattaaaaactggcagccttctcaagaaattaaaggatgggcaaactttgtgatgagccgcagtccccactgggcctctttgcttgagctgtggccttgtgtaggctgaggaatgtggttcccgcagggtttgctgtcccctggagagatgtgtcagtatccctccacttccatgtacagccccttcctcaggcccgctgaaattagttgctgaagtgattgaattagctggagaatttaaaaagcctaaacctatttattaataggttggttaagaaagattcatagggactgtgacctgttggtgcagactcatctgaagtagaagtgccaaagaatgagaacaattttacctcctgtaagcttgagagaaaatgagaaaagaaaaattgttcttgagggtggagatttctttcaggacaacattttgagatgcaaagatacagcagcagaaaaatcttttgaaacactgattttaggcctggcatggtggctcgcgcctgtaatcccagcactttgggaggccgaggcgggcggatctcttgaggccaggagttcgagaccagcctggccaacatggtgaaaccccgtctctactaaaaatagaaaaattagccaggcgtagtggtgcatgcctgtaatcccagctactcaagaggctgaggtaggagaatcggttgaaccctggaggtggaggttgcagtgagctgagatcgtgccactgcactccagcgtgggcaacagagcgaggctctgtctcaaataaataaataataaataaataaatcactggttttagttttccctaagatttggaattcttggaggtcaaatgatgattaccttccactttaaaccaaaaaggaaaaatgatagtaaagtccccatgatacatagctgtcctgtgcagcagaagataggatggggttgggctggtctttccagagtcagcagtaggaaggagttccgctgcactcaaaacgaaagccctcgattagcactgtacattttctgctgacaagtaaacatgaaaaagaggacgatatcataaaaactaaagacttagtgtgaaaattttgttgttgtcttagtttttaattcttcacctttattgcccacactgtaaaaagcccaacagaacagttccacctactgtcaccctcttctgaaaggacagaaatagtagctgggaatgttgaatggctgcgcggtacccgttgtgcattctccggcgggtgtgcagccgctcacccagccctgtctcctgcagtgtgccaggtgattgggatgtacgactacaccgcgcagaatgacgatgagctggccttcaacaagggccagatcatcaacgtcctcaacaaggaggaccctgactggtggaaaggagaagtcaatggacaagtggggctcttcccatccaattatgtgaagctgaccacagacatggacccaagccagcaatgtaagtgccctggtggctctgtcgcctcgcctctctggtatcttcccgtaaaacatgcagcattgctctgattctgctgagctttgtttgcagaacttaaagctagaccattgctgcattcgcagtcgtctctttgaagaccttctgtaatgcaagagtttatctcatggggttttatttctctttaattttcattccttctgtagcatgtcccctccctcccctccctcctttttcctttttttttttaaatcattttggcaccatgctgtttacatgcctgactcattttcctagcttgaattttgctcattgttttgttttgcttatgtgttgttttcctcctttttctaggaatcatatgttgtccatccccccctcaggcttgaaagtcctcaaagagacccactatcccatatcactgcccagagggatgatgggagatgcagccttgatcatgtgacttccagcatgatcacctactgccttctgagtagaagaactcactgcagagcagtttacctcattttaccttagttgcatgtgatcgcaatgtttgagttattacttgcagagataggagcaaaaattacaaaaacacacagggtagtgggtccttttgtggctttcctagttactcaaattgactttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccataaatctgagacttgatgtattttttcattttgtccagtgttaccaactaaattgtgcagtttggggcttttcccccttaccatagaagtgcagaggagttcagtatctctgttttaaagacgtatagaatgagcccaattaaagcgaaggtgtttgtgcttgtttgtgtgtatcagctgtaccttgttgagcatgtaatacatcctgtacataagaaattagttctttccatggcaaagctattaccttgtacgatgctctaatcatattgcatttaattttattttgcacagtgaccttgtagccacatgagaaagcactctgtgtttttgttcggtctcagatttatctggttgagttggtgttttgtttggggtttttaattttgcgtgtttgcatagcataaaatcagtagacaacaccactgaggtcgttacgatcaacgatatccacagtctctttttagtctctgttacatgaagttttattccagttacttttcatggaatgacctattttgaacaagtaattttcttgacaagaaagaatgtatagaagtctccctgcaattaatttccaatgtttacattttttaactagactgtggaatttctacagattaatatgaaatggagctcatggtccgtttgtgtgttagatatgctgtagctgaagccctgtttgtcttttaaacactagttggaagctctcaataaaaatgcctgctgctcacagcacagaaaatggggcagggggagcctcaagcacaatctagctgtcctcctaaagactctgtaatgctcactcccctcgcgttctcccggcgctgtcgggaggctgtgctggtggtcgtgtagaggtccttctcctttcacatggtgcagagagcgaggacctctcctcctcgttcagttgcacttcagtattttcacggatatgaatgtaaaatatataaatatataaacctgcggctttaacaactgtaatacaaccttttgaattagttccgtgtatagataattaaattcttcatacaaaagtta
